United States Patent 11,098,302 (IDENTIFICATION OF POLYNUCLEOTIDES ASSOCIATED WITH A SAMPLE) - sequence listing, part 65

SEQ ID NO: 223206 - DNA, 465 bp, Homo sapiens
  misc_feature: GYAE6OF02IIHM2.37.25.C03.1.454.CMB.1.raw
  modified_base (311)..(311): a, c, t, g, unknown or other
  misc_feature (311)..(311): n is a, c, g, or t
  modified_base (447)..(447): a, c, t, g, unknown or other
  misc_feature (447)..(447): n is a, c, g, or t
  modified_base (453)..(465): a, c, t, g, unknown or other
  misc_feature (453)..(465): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagccctgagagccgaagacacggccgtatattactgtgtgaaaggctggggatgggggggactactgggggcccagggaaccctggtcaccggtctccncagcctccaccaagggccccatccggtcttccccctggccaccctcctccaagacgcacctcgtgggggcacgagcggccctgggctgcctggtcaaggacctacttccatctacatactgagcggctgcaaggcncatagnnnnnnnnnnnnn

SEQ ID NO: 223207 - DNA, 457 bp, Homo sapiens
  misc_feature: GYAE6OF02HN4UC.37.25.C03.1.454.CMB.1.raw
  modified_base (442)..(442): a, c, t, g, unknown or other
  misc_feature (442)..(442): n is a, c, g, or t
  modified_base (447)..(457): a, c, t, g, unknown or other
  misc_feature (447)..(457): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctgggggatggggggactactgggggccagggaaccctggtcaccgtctcctcagcctccaccaaggcccatcggtcttccccctggccaccctcctccaagacgcacctctgggggcacagcggccctgggctgcctggtcaaggactacttccatctacactactgagcgggctggcaaggcgnatagnnnnnnnnnnn

SEQ ID NO: 223208 - DNA, 379 bp, Homo sapiens
  misc_feature: GYAE6OF02FX9FO.37.25.C03.1.454.CMB.1.raw
  modified_base (371)..(379): a, c, t, g, unknown or other
  misc_feature (371)..(379): n is a, c, g, or t
tcagtagtgtagatcacgaccggtgctcgatttagtagtgtagatttgggtttgggattcacgttgcagactcagtgaagggccggttcaccatctccagagacaattccaagaacacgctctatctgcaaatgaacagcctgagagccgaagacacggccgtatattactgtgtgaaaggctggggatggggggactactggggccaggggaaccctgggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnnnnnn

SEQ ID NO: 223209 - DNA, 374 bp, Homo sapiens
  misc_feature: GYAE6OF02G7WZ0.37.25.C03.1.454.CMB.1.raw
  modified_base (369)..(374): a, c, t, g, unknown or other
  misc_feature (369)..(374): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctgggggatggggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagnnnnnn

SEQ ID NO: 223210 - DNA, 581 bp, Homo sapiens
  misc_feature: GYAE6OF02GGE1C.37.25.C03.1.454.CMB.1.raw
  modified_base (580)..(580): a, c, t, g, unknown or other
  misc_feature (580)..(580): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaaggccggttcaccatctccagagacaattccaagaacacgctctatctgcaaatgaacagcctgagagccgaagacacggccgtatattactgtgtgaaaggcgtgggagtgggggactacgtggggccgagggacccgtggtcgaccgtctccctcacgcctccgaccgaacgggacccacgtccggttccttcccccgtggccaccctccctaccaacgacgccaccgtcgtcggggccacgacggccggcccgtcgggtctcgccgtggtacaacggaccttaccttaccattccgtaacaccgtacgtcggaacggccgggtacgtcgggacgaacgggccgacagtacgnc

SEQ ID NO: 223211 - DNA, 561 bp, Homo sapiens
  misc_feature: GYAE6OF02I0QC4.37.25.C03.1.454.CMB.1.raw
tcagtagtgtagatcacgaccggtgctcgatttagtagtgtagatttgggtttgggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagcaattatggtatcaactgggtgcgacaggcccctggacaaggccagtgagtggagtgggatggatcgagcgcttacaataataacacacactatagcacagaacgttccagggcagagtacaccctgaccacagatacactccacgagcacacgacctacagtggagcgtagacggagcctagacgatcgtcgacgacgacgggtccgttagttttacgtgtacgcgtaaggtagtaacgaagtaacgttagtttagtaagttggtaaccgttacggtcggggtaccggacgggtaacccgg

SEQ ID NO: 223212 - DNA, 574 bp, Homo sapiens
  misc_feature: GYAE6OF02IY0TI.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaaatagagcagactacgcagactccgtgaagggccggttcaccatctccagagacaattccaagaacacgctctatctgcaaatgaacagcctgagagccgaagacacggccgtatattactgtgtgaaaggctggggatgggggactacgtggggccagggaaccctggtcacgtctcctcagcctccaccaagggcccatcggtccttcccctggccaccctcctccaacgacgaccacctcgtcgggggccacgacgccgggccctcgggccgtcgcccgttggtccgaaacggtacctaccttcccaactcctacgaccttaactcggacggccgggtccgtacggaccgaacgggtccgacgtacgtagcag

SEQ ID NO: 223213 - DNA, 219 bp, Homo sapiens
  misc_feature: GYAE6OF02FWGRD.37.25.C03.1.454.CMB.1.raw
  modified_base (178)..(219): a, c, t, g, unknown or other
  misc_feature (178)..(219): n is a, c, g, or t
tcagtagtgtagatcacgaccggtgctcgatttagtagtgtagatttgggtttgggggaagaggaaggactggacggtccccccaggagttcaggtgctgggcacagcggccctgggtctgcctggtcaaggactacttccatctacactactgagcgggctggcaaggcgcgatagnnnnnnnnnnnnnnnnnnnnnnnnnnnnnnnnnnnnnnnnnn

SEQ ID NO: 223214 - DNA, 566 bp, Homo sapiens
  misc_feature: GYAE6OF02GU0WM.37.25.C03.1.454.CMB.1.raw
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagcctggggggtccctgagactctcctgtgcagcctctggattaatgtttagcaactctggcatgaactgggtccaccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggcctatatactgtgtgaaaggcgtggggagtggggggactacgtggggccgacgggaacccgtggtcgaccgtctcctcacgcctccgaccgaacgggcccacgtccggtccttccccgtcggcctacccctcctacccgaacgaccgccaccgtcgtcggggaccacgacggccggcccgtcgggctccgg

SEQ ID NO: 223215 - DNA, 233 bp, Homo sapiens
  misc_feature: GYAE6OF02IUB0M.37.25.C03.1.454.CMB.1.raw
  modified_base (231)..(233): a, c, t, g, unknown or other
  misc_feature (231)..(233): n is a, c, g, or t
tcagtagtgtagatcacgaccggtgctcgatttagtagtgtagatttgggtttggggggactactggggccagggaaccctggtcaccgtctcctcagcctccaccaagggcccatcggtcttcccctggcaccctcctccaagagcacctctggggcacagcggccctgggctgcctggtcaaggactacttccatctacactactgagcgggctggcaaggcgcatagnnn

SEQ ID NO: 223216 - DNA, 174 bp, Homo sapiens; identical to SEQ ID NO: 223166
  misc_feature: GYAE6OF02G80HV.37.25.C03.1.454.CMB.1.raw
  modified_base (174)..(174): a, c, t, g, unknown or other
  misc_feature (174)..(174): n is a, c, g, or t

SEQ ID NO: 223217 - DNA, 571 bp, Homo sapiens
  misc_feature: GYAE6OF02FOTFC.37.25.C03.1.454.CMB.1.raw
tcagtagtgtagatcacgaccggtgctcgatttagtagtgtagatttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccacacggccacgtcggtccttcccctcggccacccgtcctccaagacgcacctcgtcggggccacgacgccggcccgtcgggctcgccgtggtaccgaacggacctaccttccacttcctaacctaccttacgtggacggccgggtctcgggaccgaacgggcgaccatacg

SEQ ID NO: 223218 - DNA, 209 bp, Homo sapiens
  misc_feature: GYAE6OF02IU32T.37.25.C03.1.454.CMB.1.raw
  modified_base (181)..(209): a, c, t, g, unknown or other
  misc_feature (181)..(209): n is a, c, g, or t
tcagtagtgtagatcacgaccggtgctcgatttagtagtgtagatttgggtttggggggggaagagggaagactggacggtccccccaggagttcaggtgctgggcacagcggccctgggctgcctggtcaaggactacttccatctacactactgagcgggctgggctaaggcgcatagnnnnnnnnnnnnnnnnnnnnnnnnnnnnn

SEQ ID NO: 223219 - DNA, 396 bp, Homo sapiens
  misc_feature: GYAE6OF02IKRSG.37.25.C03.1.454.CMB.1.raw
  modified_base (364)..(364): a, c, t, g, unknown or other
  misc_feature (364)..(364): n is a, c, g, or t
  modified_base (370)..(396): a, c, t, g, unknown or other
  misc_feature (370)..(396): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatccggtccttccccctggccaccctcctccaagagcacctcgtggggcacagcggccctgggctgcctggtcaaggctacttccatctacactactgagcggctggcaaggcncatagnnnnnnnnnnnnnnnnnnnnnnnnnnn

SEQ ID NO: 223220 - DNA, 530 bp, Homo sapiens
  misc_feature: GYAE6OF02GRVZ8.37.25.C03.1.454.CMB.1.raw
  modified_base (529)..(530): a, c, t, g, unknown or other
  misc_feature (529)..(530): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccaggggaaccctggtcaccgtctcctcagcctccaccaagggcccagtcggtccttccccctggccaccctccctccaacgacgcaccctctcgggggcacagccggcccgtgggcctgcctggtcaacggactacttccatctacactactgacgcggctggcaggcgcatagnn

SEQ ID NO: 223221 - DNA, 614 bp, Homo sapiens
  misc_feature: GYAE6OF02IXR2B.37.25.C03.1.454.CMB.1.raw
tcagtagtgtagatcacgaccggtgctcgatttagtagtgtagatttgggtttgggctgagctggctttttcttgtggctattttaaaaggtttccagtgtgaggtgcagttgttggagtctgggggaggcttggtacggcctggggggtccctgagactctcctgtgcagcctctggaataatctttagcaaatacgccatgatctgggtccgccaggctccagggaagggctggagtgggtctcagccatttccggcaatgggtggtggcacgcactacgcagactccgtgaagggccggttcaccgtctcagagacaattccaggaacactctatatctgacaaatgaactagcctagagacgccacgacacggccaatactattagttgagcgaaacgaccccaaggtcaaccacagttggaagtcttttacgactttcgtgggggaccaaacgggacctaaacgggttccaaacccggtcttcgttaccgacgtccctcccaacccgaacgggcccctaatccgggttcccttccccgtggcccgccctcggcccttaccgagggtaccacctaccgtccgaacgacgtaccacggaccgccggtcccg

SEQ ID NO: 223222 - DNA, 664 bp, Homo sapiens
  misc_feature: GYAE6OF02IENOI.37.25.C03.1.454.CMB.1.raw
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagcctggggggtccctgagactctcctgtgcagcctctggattaatgtttagcaactctggcatgaactgggtccacaggctccaggcatggggctgcagtgggtctcaagtactagtgctcctggtaatagagcagactacgcagactcgtgaagggccgttcaccatctccagagacaattccaaagaaccncgctctatctgactaaatcgaacngcctagagtacgaccgaagaccgacggaccgtaatacttacgtgtagtagaaggcgtggggagtgggggactacggtcggggacctaacggggtaccctgggtacctaccggtcctccgtcgaccgtccctacccgaacccggtaaccggggacccctaacgttcccgggttacccttccccccggtacgggtacccctacccccgttccctacccgtaaacggacccgacccgtaccccgttaccgggtccgggggaccctacggaccgggtccccgggtacccgttccggggacccttacccgggg

SEQ ID NO: 223223 - DNA, 175 bp, Homo sapiens
  misc_feature: GYAE6OF02F29SE.37.25.C03.1.454.CMB.1.raw
  modified_base (174)..(175): a, c, t, g, unknown or other
  misc_feature (174)..(175): n is a, c, g, or t
tcagtagtgtagatcacgaccggtgctcgatttagtagtgtagatttgggtttgggggaagaggaagactgacggtccccccaggagttcaggtgctgggcacaacggccctgggctgcctggtcaaggactacttccatctacactactgagcgggctggcaaggcgcatagnn

SEQ ID NO: 223224 - DNA, 235 bp, Homo sapiens; identical to SEQ ID NO: 222904
  misc_feature: GYAE6OF02I0S0L.37.25.C03.1.454.CMB.1.raw
  modified_base (232)..(235): a, c, t, g, unknown or other
  misc_feature (232)..(235): n is a, c, g, or t

SEQ ID NO: 223225 - DNA, 593 bp, Homo sapiens
  misc_feature: GYAE6OF02GJUGC.37.25.C03.1.454.CMB.1.raw
  modified_base (591)..(591): a, c, t, g, unknown or other
  misc_feature (591)..(591): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggcgtggggagtgggggactacgtggggccagggaaccctggtcaccgtctccctcgacgccctccacccgaacgggccccagttccggtccctttcccccgtggccctaccccgtccctacccaagacgccacccgttcgtcgggggccacgacggccggcccgtcgggcctcggccgtcgggtacgaaacggtacctaccttacccatcctaactaccgtaacgtgacggccgggtctcgggcgaacgggccgactagtacgncg

SEQ ID NO: 223226 - DNA, 541 bp, Homo sapiens
  misc_feature: GYAE6OF02IXLTO.37.25.C03.1.454.CMB.1.raw
  modified_base (538)..(538): a, c, t, g, unknown or other
  misc_feature (538)..(538): n is a, c, g, or t
tcagtagtgtagatcacgaccggtgctcgatttagtagtgtagatttgggtttgggggaggcctggtgcagcctgggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtactattactgtgtgaaaggctggggatgggggactagtgggccagggaacccgtggtcaaccgtctcctcagcctcaccaagggcccagtcggtcttcccctggccaccctcctccaacgacgcaacctctacgggggcacaacgccggccctgggacctgcccgtggtaccgaaggactaccttcacgtctacactactgacgacggcctggcgtaacggcgcactagntcg

SEQ ID NO: 223227 - DNA, 518 bp, Homo sapiens
  misc_feature: GYAE6OF02F4IVO.37.25.C03.1.454.CMB.1.raw
  modified_base (490)..(490): a, c, t, g, unknown or other
  misc_feature (490)..(490): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaaggctggggatgggaggactactggggccagggaaccctggtcaccgtctcctcagcctcaccagggcccatccggtcttcccctggccaccctcctccaacgacgcacctcgtgggggccacgacgccggccctgggcctgcctgtcaaggctactccatctacnctactgagcggctcggcaaggcncatgn

SEQ ID NO: 223228 - DNA, 174 bp, Homo sapiens; identical to SEQ ID NO: 222845
  misc_feature: GYAE6OF02GDPKI.37.25.C03.1.454.CMB.1.raw
  modified_base (174)..(174): a, c, t, g, unknown or other
  misc_feature (174)..(174): n is a, c, g, or t

SEQ ID NO: 223229 - DNA, 525 bp, Homo sapiens
  misc_feature: GYAE6OF02F27X3.37.25.C03.1.454.CMB.1.raw
  modified_base (504)..(525): a, c, t, g, unknown or other
  misc_feature (504)..(525): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagacctcgtgaggccgtcacatctcagagacaattccaagaacacgctctatctgacaaatgaacagcctgagagaccgaagacgaccggccgtatattactgtgtagaaaggcgtggggaggtggggggactacggtggggccgacgggaacccgtggtcaccggtctcctcacgtcctaccaaccgaacgggccctagtccggttcccttcccccgtggccctacccctcctaccgaacgacgcctaccgtcggtcgggggccacgcggccggcccgtggggcctcggccgtggtacgaacggtacctaccttccatctaacacctactggacggcgggcgtggcgaagggcacagtagnnnnnnnnnnnnnnnnnnnnnn

SEQ ID NO: 223230 - DNA, 649 bp, Homo sapiens
  misc_feature: GYAE6OF02JPFIM.37.25.C03.1.454.CMB.1.raw
  modified_base (646)..(646): a, c, t, g, unknown or other
  misc_feature (646)..(646): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtagaaaggtcgtaggggagtagggggactacgttggggaccgaacggggtaaccctgggtacctaccgtccttcctacgacgtccctccgaaccgaacgggcccgaacgtccggttcccgttcccccgtcggaccctaccccgtacccgttacccaaggaccgacctacccgtacgtccgggggaccacgaccggccggtccccgtcgggtccgtccggccgttcgggtaaccgtaacggaccgttacctaccgtacgttcctacctaaccgtaccgttacggaacgggtccggcggtcggtacggaacggccggacacgttagngtc

SEQ ID NO: 223231 - DNA, 579 bp, Homo sapiens
  misc_feature: GYAE6OF02GLY1X.37.25.C03.1.454.CMB.1.raw
  modified_base (447)..(447): a, c, t, g, unknown or other
  misc_feature (447)..(447): n is a, c, g, or t
  modified_base (576)..(576): a, c, t, g, unknown or other
  misc_feature (576)..(576): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtagaaaggctggggatggggggactacgtggggccacggaacccgtggtcaccgtctcctcacgcctcaccgaagggccccaagtccggtccttcccccgtggcctacccctcctacccaagacnccaacctcggtcggggccacgacgccggcccgtcgggctcgccgttcggtcgaacggtacttaccttccacgtacctacgtactacgtacggacggccgggcctgggaccgaacgggccgacagttagnacg

SEQ ID NO: 223232 - DNA, 526 bp, Homo sapiens
  misc_feature: GYAE6OF02GITL2.37.25.C03.1.454.CMB.1.raw
  modified_base (524)..(526): a, c, t, g, unknown or other
  misc_feature (524)..(526): n is a, c, g, or t
tcagtagtgtagatcacgaccggtgctcgatttagtagtgtagatttgggtttgggggggggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggagtggggggactacgtggggccagggaaccctggtcaccgtctcctcagcctccacaggcccatccggtctcccctggccaccctcctccaagcgcacctcgtggggcacgcgccggcccgtggcctgccgtggtcgaagacctacttccatctacactacgtgacgcggctggacgaggcgacatagnnn

SEQ ID NO: 223233 - DNA, 520 bp, Homo sapiens
  misc_feature: GYAE6OF02FUEYA.37.25.C03.1.454.CMB.1.raw
  modified_base (515)..(515): a, c, t, g, unknown or other
  misc_feature (515)..(515): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactacgtggggccagggaaccctggtcaccgtctcctcagcctccaccaagggcccatcggtcttccccctggccaccctcctccaagacgccacctcgtggggcacagccggccctgggctgcctggtcaaggactacgttccatctacactactgagcggctggcaggccgnatagc

SEQ ID NO: 223234 - DNA, 591 bp, Homo sapiens
  misc_feature: GYAE6OF02JJK4W.37.25.C03.1.454.CMB.1.raw
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
tcagtagtgtagatcacgaccggtgctcgatttagtagtgtagatttgggtttggggggactacgtggggccagggaacccctcggtcgtacccgtcgtccttcagccttccgaccaaagggcccatcggtcttcccctggcaccctctaccaagagcacctcgtgggggtcgactagcggccctggggtcctggtcctggtacttaaagggctacttccatctaagctactgagtcgggctggcctaaggggcgctagtacgncgtggcangctcnctgagcagctngactnactgntnttangctngcngcgcncgtagctcgaggagctgatagtccgtntcgagtagtacgaagtancgacgataatatatatatagacgtactgtagtagagtagtatactactacactcgtacgacgtactactacaacgacgacgtactactactactactacgtacgtacgtacgtacgtacgacgagtacgacgtacgtacgtacgtacgtagtactacgtacgtaggtaggaggtacgtaggtaggtaacggttacggtaacggttacggtacggtacgggtacggtacgg

SEQ ID NO: 223235 - DNA, 589 bp, Homo sapiens
  misc_feature: GYAE6OF02GX5CX.37.25.C03.1.454.CMB.1.raw
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagcctggggggtccctgagactctcctgtgcagcctctggattaatgtttagcaactctggcatgaactgggtccgccaggctccaggcagtggggctgcaggtgggtctcaagtactagtgctccgtaggtaatagagcagactacgcagactccgtggaacgggtccggttcaccatcctccagacgacaattccaaagaacacgctactatctgactaaatgaaacagcctggacgagacccgaagacgaccggccgtaatacgttactgtgtaggaaaggcggtaggggaggtggggggactacggtgggaccggaacgggacccgtggtccaccgtctcctcacgccctccaccgacggccctacgtccggtcccttccccgcgccctaccctccaccgaacgacgccaccgtcggacgggcacgacggccggccgtcggcgtcgg

SEQ ID NO: 223236 - DNA, 173 bp, Homo sapiens; identical to SEQ ID NO: 222839
  misc_feature: GYAE6OF02GJRUK.37.25.C03.1.454.CMB.1.raw
  modified_base (173)..(173): a, c, t, g, unknown or other
  misc_feature (173)..(173): n is a, c, g, or t

SEQ ID NO: 223237 - DNA, 473 bp, Homo sapiens
  misc_feature: GYAE6OF02JEHLA.37.25.C03.1.454.CMB.1.raw
  modified_base (452)..(452): a, c, t, g, unknown or other
  misc_feature (452)..(452): n is a, c, g, or t
  modified_base (459)..(473): a, c, t, g, unknown or other
  misc_feature (459)..(473): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtccttccccctggccaccctcctccaacgacgccacctcgtcgggggcacgagccggccctgggcctcgccgtcggtcgaaggacctactccatcctacactactgacgcggctggcaggcncgatagnnnnnnnnnnnnnnn

SEQ ID NO: 223238 - DNA, 676 bp, Homo sapiens
  misc_feature: GYAE6OF02I9HG0.37.25.C03.1.454.CMB.1.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
tcagtagtgtagatcacgaccggtgctcgatttagtagtgtagatttgggtttgggggaggcctggtgcagcctggggggtccctgagacttctcctgtgcagcctctggattaaatgtttagcaactctggcatgtaactgggtccgccaggtctccaggcatgggctgcagtgggtctcaagtactagtgctctggtaataggagcagactacgcagacctccgngaaggccgttcaccatcncagacacaagttccaagtaacacgctactagtctgacaaatcgaacacgcctagacgacggaccgaaaggacgacggtaccgtaatacgttactggttgtaggaaaggtcgtgggaggtggggtactacggtgggaccgtagggaaccgtggtacgaccgtccgtcctcgacgcctaccacgacggtaccacgtccgtaccttccccgtacgacctacccctaccgtaccaaacggacgtaccgtaccgttccggtacggggacctaaccgacgggcccggtacccggtcgggtaccgtaccggccgttacgggtacctaaacggtacccttaccttaccgtaacctaccggtaaccgtaaccgttacggtaccggacgggtccgggtacggttcggtaccggaacggtcccggtagtacgtacgcgtacg

SEQ ID NO: 223239 - DNA, 567 bp, Homo sapiens
  misc_feature: GYAE6OF02HZJXS.37.25.C03.1.454.CMB.1.raw
  modified_base (273)..(273): a, c, t, g, unknown or other
  misc_feature (273)..(273): n is a, c, g, or t
  modified_base (565)..(565): a, c, t, g, unknown or other
  misc_feature (565)..(565): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatgggggctgcagtgggtctcaagtactagtgctcctggtaatagagcagactacgcagactccgtgaagggccggttcaccatctccagagacaattccaagaacacgctctanctgacaaatgaacagcctgagacgacgaagacacggccgtatattactgtgtagaaggcgtaggggagtgggggactacggtcggggcgacgggaacccgtggctacccgtctccgtcgacgcctacccgaaccgaacgggcccacgtccggttccttccccgtgcccgtaccctcctaccaacgcgcctaccgtcgtcggggcacgcggccgcccgtgggctcgcgtggtacaaggactacctcactctactactacgtcgcggcggcgtcggacgacgggcacgagtagnag

SEQ ID NO: 223240 - DNA, 597 bp, Homo sapiens
  misc_feature: GYAE6OF02GAT17.37.25.C03.1.454.CMB.1.raw
  modified_base (594)..(594): a, c, t, g, unknown or other
  misc_feature (594)..(594): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgtcaccatctccagagacaattccaagaacacgctctatctgcaaatgaacagcctgagagccgaagacacggccgtatatactgtgtagaaaggctggggagtggggggactacgtggggccgagggaacccgtggtacaccgtcctccgtcacgccctccaaccgaacgggcccacgtccggtcctttcccccgtggcccacccctccctacccaacgacgccaccgtcggtcggggcacgacggcggcccgtcgggcctcggtccgtggtaccgaaacggtaccttaaccgttcccgaacttccgtaaccgtacctacgtaggacggcgggtcgtgggacgaacgggcgtacacgttagntcg

SEQ ID NO: 223241 - DNA, 238 bp, Homo sapiens
  misc_feature: GYAE6OF02G9UKA.37.25.C03.1.454.CMB.1.raw
  modified_base (233)..(238): a, c, t, g, unknown or other
  misc_feature (233)..(238): n is a, c, g, or t
tcagtagtgtagatcacgaccggtgctcgatttagtagtgtagatttgggtttggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnnn

SEQ ID NO: 223242 - DNA, 486 bp, Homo sapiens
  misc_feature: GYAE6OF02GT01I.37.25.C03.1.454.CMB.1.raw
  modified_base (469)..(486): a, c, t, g, unknown or other
  misc_feature (469)..(486): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaggacacggctgtgtattactgtgcgagagccctccacctcagcagcagcggtgacttctggggccagggaaccctggtcaccgtctcctcagcctccaccaagggcccatcggtcttccccctggccacccctcctccaacgacgccaccctcgtcgggggcaccgacgccggccctggggctggcctggtcaacgggactacttccatctacactactgagcgggctggcaaggcgcatagnnnnnnnnnnnnnnnnnn

SEQ ID NO: 223243 - DNA, 485 bp, Homo sapiens
  misc_feature: GYAE6OF02F8E6G.37.25.C03.1.454.CMB.1.raw
  modified_base (467)..(485): a, c, t, g, unknown or other
  misc_feature (467)..(485): n is a, c, g, or t
tcagtagtgtagatcacgaccggtgctcgatttagtagtgtagatttgggtttgggctcaactctcttgtccgccaggctccaggcatgggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccgagggaaccctggtcaccgtctcctcagcctccaccaacgggcccatccggtcttcccccgtggccaccctcctccaacgacgccacctcgtcgggggcacgacgcggcccgtcgggctcgcctggtcaaggactacttccatctacactactggacgcgggctggcgaaggccgacatacgnnnnnnnnnnnnnnnnnnn

SEQ ID NO: 223244 - DNA, 381 bp, Homo sapiens
  misc_feature: GYAE6OF02JCPT5.37.25.C03.1.454.CMB.1.raw
  modified_base (371)..(381): a, c, t, g, unknown or other
  misc_feature (371)..(381): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatccggtcttccccctggccaccctcctccaagagcacctctgggggcacagcggccctgggctgccctggtcaaggactacttccatctacactactgagcggctggcaaggcgcatagnnnnnnnnnnn

SEQ ID NO: 223245 - DNA, 596 bp, Homo sapiens
  misc_feature: GYAE6OF02ICM90.37.25.C03.1.454.CMB.1.raw
  modified_base (420)..(420): a, c, t, g, unknown or other
  misc_feature (420)..(420): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtagaaaggcgtggggagtggggggactacgtggggaccgagggaaccctggtcaccgtctcctcacgcctcaccaagggcccagtccgtccttcccccgnggccacccctcctacccaacgacgcctacccgtcgtacggggccaacgcggacccggcccgttacggggctcggcccgtacgggtaccaaacgggtacctacgttccaagttcctaaccacttaacgtcggaacgtccggggccgtcggaccgaacgggcacgtaatacggatgac

SEQ ID NO: 223246 - DNA, 595 bp, Homo sapiens
  misc_feature: GYAE6OF02FWUYB.37.25.C03.1.454.CMB.1.raw
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (368)..(368): a, c, t, g, unknown or other
  misc_feature (368)..(368): n is a, c, g, or t
  modified_base (428)..(428): a, c, t, g, unknown or other
  misc_feature (428)..(428): n is a, c, g, or t
tcagtagtgtagatcacgaccggtgctcgatttagtagtgtagatttgggtttgggctgagcgtgcgtttctaggtggctattttaaaaggttcagtgtgaggtgcagttgttggagtctgggggaggcctggtgcagccgtggggggtccctgagactctcctgtgcagcctcgtggattaatgtttagcaactctggcatgaactgggtccaccgaggctccaggcatggggctgcagtgggtctcaagtactagtgccttccgtggtaatagngcagactacgcagacctcgnggaagggcccgttcaccatcnccagataactataccgaaagaaccacgtctactatcctgaactaatcgaanacgcctagagacgacgaagaccgacggccttaagtatacgtgtgtagaaggcgttggggnggtagggggactcggtaccggggcgtacgggtaccgtcggtacctcccgtctcctacgacgcctaccgaccgacggccacgttccgtccttcccgcgtacctccgtccctacaacgctaccgacccgtacggtcgggactcggaccggcgtaccccgtggacctcgg

SEQ ID NO: 223247 - DNA, 615 bp, Homo sapiens
  misc_feature: GYAE6OF02IESBH.37.25.C03.1.454.CMB.1.raw
  modified_base (612)..(613): a, c, t, g, unknown or other
  misc_feature (612)..(613): n is a, c, g, or t
tcagtagtgtagatcacgaccggtgctcgatttagtagtgtagatttgggtttggggggaggcctggtgcagcctggggggtccctgagactctcctgtgcagcctctggattaatgtttagcaactctggcatgaactgggtccgccaggctccgggcatggggctgcagtgggtctcaagtactagtgctctggtaatagagcagactacgcagactccgtgaagggccggttcaccatctccagagacaattccaagaacacgctctatctgacaaatgaacagcctgagagaccgaagacgacggccgtatattactgtgtagaaaggcgtagggggtaggtggggggacctacggtcgggggccgacggggaaccctggtaccacccgtctcctcgacgccctacccaccgaacgggcccacgtccggttcccttcccccgtcggcctacccgtcctacccacgtacgacctaccgtacgacggggccacgacggcccggcccgtggggtaccgtcggccgtcggtaccgaacggtacctaccgtaccgtacttacctaccacttacgtggacggccgggtcgtcggacgtacggcgactagtagcnncg

SEQ ID NO: 223248 - DNA, 545 bp, Homo sapiens
  misc_feature: GYAE6OF02IB3YQ.37.25.C03.1.454.CMB.1.raw
  modified_base (204)..(204): a, c, t, g, unknown or other
  misc_feature (204)..(204): n is a, c, g, or t
  modified_base (276)..(276): a, c, t, g, unknown or other
  misc_feature (276)..(276): n is a, c, g, or t
  modified_base (323)..(323): a, c, t, g, unknown or other
  misc_feature (323)..(323): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
  modified_base (491)..(491): a, c, t, g, unknown or other
  misc_feature (491)..(491): n is a, c, g, or t
  modified_base (510)..(510): a, c, t, g, unknown or other
  misc_feature (510)..(510): n is a, c, g, or t
tcagtagtgtagatcacgaccggtgctcgatttagtagtgtagatttgggtttggggaggcctggtgcagcctggggggtccctgagactctcctgtgcagcctctggattaatgtttagcaactctggcatgaactgggtccgccaggctccaggcatggggctgcagtgggtctcatccatcagttacaatggtcaaaaccntatactacgcagtattttgtgaagggccgctttcaccatctccagagacaacgccaagagctctctgtttcngcatatggacagcctagacgcgcgacgcgcggctcgtaatatttacngtgcgagatgggacggcggtggctggtgactcgggtcactcttaacgactactatcgctttcagtggacgtgtcggggacgaaacgggaccgaggtccaccgtctccgtcccncctccaccgacggcccagtcccgtccttccccgngcctaccctcctaccgaagcnccaccgtcggtcgggaccncgacgccgccgtggcctcgcctggtacaggtaccc

SEQ ID NO: 223249 - DNA, 451 bp, Homo sapiens
  misc_feature: GYAE6OF02HBM4B.37.25.C03.1.454.CMB.1.raw
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (443)..(451): a, c, t, g, unknown or other
  misc_feature (443)..(451): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctgggggatgggggggactacgtgggggccagggaaccctggtcaccgtctcctcagcctccaccaagggcccatcgtcttcccccnggcaccctcctccaagngcacctctgggggcacagcggccctgggctgcctggtcaaggctactcatctacactactgagcgggctggcaggcgcatagnnnnnnnnn

SEQ ID NO: 223250 - DNA, 589 bp, Homo sapiens
  misc_feature: GYAE6OF02I60YI.37.25.C03.1.454.CMB.1.raw
  modified_base (457)..(457): a, c, t, g, unknown or other
  misc_feature (457)..(457): n is a, c, g, or t
tcagtagtgtagatcacgaccggtgctcgatttagtagtgtagatttggggtttgggggaggcctggtgcagcctgggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgaatctcgtcggggccgtggccacccgtggtcactgtcctcctcacgcctccaccaacgggcccagttccggtccttcccctcgggccnccctcgcctcccgaggacgccacccgtccgacacggccacgacgcccggacccgtcggggtcctcggcccgttacgggtaccgaaccggtaccttacccgtttccaacttaccctaactaccgtactacggg

SEQ ID NO: 223251 - DNA, 561 bp, Homo sapiens
  misc_feature: GYAE6OF02F4E63.37.25.C03.1.454.CMB.1.raw
  modified_base (559)..(560): a, c, t, g, unknown or other
  misc_feature (559)..(560): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcacgcctccaccaagggcccaatccggtccttccccctgggccaccctccctccaacgacgccacctcgtcgggggccacgacgccggcccgtgggcctggcccttgggtcgaaacgggaccttaaccttcccattcctacacctactcggagcgggctcgggcaacgggcgccagtagnnc

SEQ ID NO: 223252 - DNA, 480 bp, Homo sapiens
  misc_feature: GYAE6OF02IKCP9.37.25.C03.1.454.CMB.1.raw
  modified_base (347)..(347): a, c, t, g, unknown or other
  misc_feature (347)..(347): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (457)..(480): a, c, t, g, unknown or other
  misc_feature (457)..(480): n is a, c, g, or t
tcagtagtgtagatcacgaccggtgctcgatttagtagtgtagatttgggtttgggctcaactctcttgtccgccaggctccaggcatgggggctgcagtgggtctcaagtactagtgctcctggtaatagagcagactacgcagactccgtgaagggccggttcaccatctccagagacaattccaagaacacgctctatctgcaaaatgaaacagcctgagagccgaaagacacggccgtatattactgtgtgaaaaggctggggatggggggactacgtgggggccagggaaccctggtacaccggtctcctcagcctccaccaagggccatcggtcttccccnggccacctcctcacgagcacctcgtggggcacgagcggccctgggctcgcctgggtacaagggactacttcactctacactactgacgcgggctggacaaggcncanagnnnnnnnnnnnnnnnnnnnnnnnn

SEQ ID NO: 223253 - DNA, 573 bp, Homo sapiens
  misc_feature: GYAE6OF02I430L.37.25.C03.1.454.CMB.1.raw
  modified_base (571)..(571): a, c, t, g, unknown or other
  misc_feature (571)..(571): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctactatctgacaaatgaacagcctgagacgccgaagacgacggccgtatattactgtgtagaaggcgtgggagtcggggactacggtgggcgacgggaccctggtcaccgtctcctcacgcctaccgaccgacggaccctagtccggtccctccccgtggccaccctcctaccaagaccgcaccgtcgcgggccacgacggccggccgtcgggctcgccgtggtacgtaacggtaccttacgtccacttcctaacacgtaacgtcggacggtcggacgtggacgaacggccgacgtagtacgncg

SEQ ID NO: 223254 - DNA, 877 bp, Homo sapiens
  misc_feature: GYAE6OF02IBSO9.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgttttagcaactctggcatgaactgggtccgccaggctccaggcatggggctgcagtgggtctcaagtactagtgctcctggtaatagagcagactacgcagacctccgtgaaggccggttcaccatctccagagacaattccaaagaacacgctctatctgacaaatgaacagcctgagacgaccgaagacacggccgtatagttactgtgtagaaaggcgtagggggagtagggggacctacggtacgggggacccgaacggggtaaccccgtcgggtacctacccgggttccctacccgtccgacgtaccccgttaccccgaaaccggtaaccggggacccctaaccggttccccgggtttcccccgtttacccccccggttccgggaccccttaaccccccggttacccccgtttaaccccgaaaaccgggtaaccggaccccgttaaccccggttacccggggttaccgggggggaccctaaaccccggtaacggggcccccggggttacccccggttccgggggggtccccgtttaccggggtaccccggtttacggggttaaccccggttaaaaaccggggttaccccgtttaaaacccgtttccccgtaaccgtttaacccgtttaaaccccgttaacccggttttaacccggtttaacggggaaaccggggttccccgggggtaccggttaccgggggtaacccggaaacgggggtacccggtaacccgtaaagggtttaacccgacggtcgg

SEQ ID NO: 223255 - DNA, 569 bp, Homo sapiens
  misc_feature: GYAE6OF02IQ37R.37.25.C03.1.454.CMB.1.raw
  modified_base (538)..(538): a, c, t, g, unknown or other
  misc_feature (538)..(538): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacacgcctgagagaccggaagacaccggaccgtatacttactgtgtagaaaggcgtggggagtcgggggactacgtggggaccacgggaacccgtggtccgaccgtctcctcacgcctccgaccgacggccctacgtcgtccttccccgtcgcctacccgtcctaccaacgacgccctacctcgtcggggacaccgacggccggcccgtcggcgtcgccgtcggtacaacggtctaccttcactactacacctacngacgcggcgtggacgacggccgacagtgatg

SEQ ID NO: 223256 - DNA, 609 bp, Homo sapiens
  misc_feature: GYAE6OF02G927V.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgacaaaatgaaacagcctgagagccgaagacacggccatatattattgtcgacgaaacgaccccaaggtcgaaccactagttggatcttttagactttcgcggggaccaaagggacaacggtccacgtctctcgacgtcctaccgaccgaacgggcccacgtcccggtccttccccgtcggtcccgccctcgccctaccgacggtacgccgacccgtccgacgacgtaccacgaccggccggtcccgtgggacctcgtccgtcgggtaaccaacggtaccttaccgttaccgtacttaccgtaccctaacgttacgacggtacggccgggtaccgg

SEQ ID NO: 223257 - DNA, 809 bp, Homo sapiens
  misc_feature: GYAE6OF02IZZP8.37.25.C03.1.454.CMB.1.raw
tcagtagtgtagatcacgaccggtgctcgatttagtagtgtagatttgggtttgggattcacgttggtcagactccgtgtaagggccggttcaccatctccagagacaattccaagaacacgcgtctatctcgcaaagtgaacagcctgagagccgaagacacggccgtatattactgtgtgaaaggtctggggagtgggggactacgtggggccagggaaccctggtcgaccggtcctcctcgaccgcctcccgaaccgaacgggcccgagttccgggtcccttcccccgtggtacctaccccttaccttcctaaaggacgaccaaccttaacgttcggggggaccaacgaacggtcccggaccctacggggccttacggcccttacgggtaccgaacgggtaaccgttacccgttacctaaccgttaccgtaaacccaacctttaacgtccggtaacgggtaccggggtaccgttacgggaaacctaaacgggaccggtaacgtaacgttaaccggagtacgtagacggtacaacggtactaaccgtataccgtgtaccgtagaaacctagttccgaaggttcctaacggtacgtacgtacgtacgtacgtacggtacggttacgtacgtacgtacgtacgtaccggtaacggtaaccggtaacggtaacgtaacgtacggtaccgtaccgtaccgtaccgtaccgtacgtaccgtaccgtaaccgtaccggtaccgttaccggttaccgttacccgttaccgtaccgtacccgtaccgtaccgtaaccgacgtaccgtaccgtacg

SEQ ID NO: 223258 - DNA, 488 bp, Homo sapiens
  misc_feature: GYAE6OF02I20B7.37.25.C03.1.454.CMB.1.raw
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
  modified_base (470)..(488): a, c, t, g, unknown or other
  misc_feature (470)..(488): n is a, c, g, or t
tcagtagtgtagatcacgaccggtgctcgatttagtagtgtagatttgggtttgggctcaactctcttgtccgccaggctccaggcatgggggctgcagtgggtctcaagtactagtgctcctggtaatagagcagactacgcagactccgtgaagggccggttcaccatctccagagacaattccaaagaacacgctctatctgcaaatgaacagcctgagagccgaagaccacggccgtatattactgtgtgaaaggctggggatggggggactacgtgggccagggaaccctggcaccgtctcctcagcctccaccaacgggccccagtccggtcccttcccccgtcggccacccctcctcccgaagacgccacctccgtgggggccacgagccggcccgtgggcctgcctggtacaacggactactccatctacactacngacgcgggctggacagtcgacanagnnnnnnnnnnnnnnnnnnn

SEQ ID NO: 223259 - DNA, 238 bp, Homo sapiens; identical to SEQ ID NO: 223241
  misc_feature: GYAE6OF02HT45C.37.25.C03.1.454.CMB.1.raw
  modified_base (233)..(238): a, c, t, g, unknown or other
  misc_feature (233)..(238): n is a, c, g, or t

SEQ ID NO: 223260 - DNA, 775 bp, Homo sapiens
  misc_feature: GYAE6OF02IONQI.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgagggccgttcaccatctccagagacaattccaagaacacgctctatctagacaaatgaacacgcctagagacgaccgaagacgacggccgtatattactgtgtaggaaaggcgtaggggagtgggggactacggtcggggaccgacgggtaacccgtgggtaccgtaccgtccgtccctacgtacgtccctacccgaaccgaacgggtaccccaacgttcccgggttcccctttccccccgtcggacccctaccccgttaccctacccgaacggtaccgacccgtaacccgttcccggtaccggggggtaccaacccggacgggtccccgggtaccccggttcggggtcccgttcggtcccggttacggggttacccgaaacggggttacccttaacccgtttaccccgtaagttaccccgttaaacccgttaaccccgttaaacccggttcggggaaaccggggttaccccggggtacccgggtttaaccgggtacccgggtaaaccggggacccccggttaacgaaccgggtttaccgggccttaacgg

SEQ ID NO: 223261 - DNA, 236 bp, Homo sapiens
  misc_feature: GYAE6OF02F05AI.37.25.C03.1.454.CMB.1.raw
  modified_base (233)..(236): a, c, t, g, unknown or other
  misc_feature (233)..(236): n is a, c, g, or t
tcagtagtgtagatcacgaccggtgctcgatttagtagtgtagatttgggtttggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnn

SEQ ID NO: 223262 - DNA, 467 bp, Homo sapiens
  misc_feature: GYAE6OF02GHF27.37.25.C03.1.454.CMB.1.raw
  modified_base (341)..(341): a, c, t, g, unknown or other
  misc_feature (341)..(341): n is a, c, g, or t
  modified_base (442)..(442): a, c, t, g, unknown or other
  misc_feature (442)..(442): n is a, c, g, or t
  modified_base (449)..(467): a, c, t, g, unknown or other
  misc_feature (449)..(467): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactgggggccagggaaccctggtcaccgtctcctcagcctccaccaagggcccatcggtcttcccccnggccaccctcctccaagagccacctcgtgggggcacagcggccctgggctgcctggtcaagggactacttccatcctacactactgagcggctggcaggcncgatagnnnnnnnnnnnnnnnnnnn

SEQ ID NO: 223263 - DNA, 640 bp, Homo sapiens
  misc_feature: GYAE6OF02JRWFF.37.25.C03.1.454.CMB.1.raw
  modified_base (216)..(216): a, c, t, g, unknown or other
  misc_feature (216)..(216): n is a, c, g, or t
  modified_base (252)..(252): a, c, t, g, unknown or other
  misc_feature (252)..(252): n is a, c, g, or t
  modified_base (635)..(635): a, c, t, g, unknown or other
  misc_feature (635)..(635): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctccgtggtaatagagcagactacgnagacctccgtggaacgggccgttcacatctccaganacaacttacaagaacacgctctatctcgacaaatcgaacagtcctagaaggcgaccgaagaccaccggtacgtataacgttactgtagtagaaaggcgtaggggtagtggggactacggtcgggaccgaacgggtaacccgtcggtaccgtaccgtaccgtccgtcgtaccggccctaccaacccgaacgggaccctacgtccgttacccgtccccgtcggacctacccgtcctaccgacgaacgtccacgtcgacggggccacgtcgaccggccgtcggacctcgccggtcgacgtaacggtacctaccgttacctactaccgtacctaccgtaacgtcggaacggttccggcgtaccggtacgacgggcctacggaacgtncggac

SEQ ID NO: 223264 - DNA, 601 bp, Homo sapiens
  misc_feature: GYAE6OF02GGUI4.37.25.C03.1.454.CMB.1.raw
  modified_base (66)..(66): a, c, t, g, unknown or other
  misc_feature (66)..(66): n is a, c, g, or t
  modified_base (171)..(171): a, c, t, g, unknown or other
  misc_feature (171)..(171): n is a, c, g, or t
  modified_base (244)..(244): a, c, t, g, unknown or other
  misc_feature (244)..(244): n is a, c, g, or t
  modified_base (347)..(347): a, c, t, g, unknown or other
  misc_feature (347)..(347): n is a, c, g, or t
tcagtagtgtagatcacgaccggtgctcgatttagtagtgtagatttgggtttgggctgagcgtgngtttctagtggctattttaaaaggttccagtgtgaggtgcagttgttggagtctggggagcctggtgcagcctggggggtccctgagactctcctgtgcagcctntggattaatgtttagcaactctggcatgaactgggtccacaggctccaggcagtggggctgcaggtggtctanaagtactagtgctctggtaatagagcagactacgcagactccgtaggaacgggtccgttcactatctcagagacaattacaaagaacacgctactactctaanactaaatacgaacacgactagaacgacgaccgaaacgacgaccggtaacgtattacttacgtgtagtaaggaaggtacggtagggaggtacggggtacgtacgggtacgggaccgacggtaccgtcggtcctaccgtcctccgtacgaccaccgtaccgaccgacggcctacgtccgtccctcccgtcgccctaccctccgaccgtacgaccgccgaccgtcggacggaccacggcgccggtccgtcggcgtcg

SEQ ID NO: 223265 - DNA, 483 bp, Homo sapiens
  misc_feature: GYAE6OF02IK517.37.25.C03.1.454.CMB.1.raw
  modified_base (239)..(239): a, c, t, g, unknown or other
  misc_feature (239)..(239): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (433)..(434): a, c, t, g, unknown or other
  misc_feature (433)..(434): n is a, c, g, or t
  modified_base (436)..(483): a, c, t, g, unknown or other
  misc_feature (436)..(483): n is a, c, g, or t
tcagtagtgtagatcacgaccggtgctcgatttagtagtgtagatttgggtttggggattcacgttgcagactccgtgaagggccggttcaacccatctccagagacaattccaagaacacgctctatctgcaaatgaacagcctgagagccgaagacacggccgtatattactgtgtgaaaggctggggatggggggactacgtgggggccagggaaccctgggtcaccggtctcctnagcctccaccgaaagggcccactcggtccttccccctggccaccccgtcctcccaaagacgccaacccttcgtgggggcacgaggccggccctcggggcctgcccgttgggtaccaaagggtcctacgttccaattctaacgacttacgtgaacggcggggcgttgggaccaaggccncgtaagtagnacgncnnannnnnnnnnnnnnnnnnnnnnnnnnnnnnnnnnnnnnnnnnnnnnnnn

SEQ ID NO: 223266 - DNA, 236 bp, Homo sapiens
  misc_feature: GYAE6OF02G6ELP.37.25.C03.1.454.CMB.1.raw
  modified_base (232)..(236): a, c, t, g, unknown or other
  misc_feature (232)..(236): n is a, c, g, or t
tcagtagtgtagatcacgaccggtgctcgatttagtagtgtagatttggggttgggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 223267 - DNA, 176 bp, Homo sapiens
  misc_feature: GYAE6OF02HBE9T.37.25.C03.1.454.CMB.1.raw
  modified_base (176)..(176): a, c, t, g, unknown or other
  misc_feature (176)..(176): n is a, c, g, or t
tcagtagtgtagatcacgaccggtgctcgatttagtagtgtagatttgggtttgggggggaagaggaagactgacggtccccccaggagttcaggtgctgggcacagcggccctgggctgcctggtcaaggactacttccatctacactactgagcgggctggcaaggcgcatagn

SEQ ID NO: 223268 - DNA, 175 bp, Homo sapiens; identical to SEQ ID NO: 222899
  misc_feature: GYAE6OF02IWNKB.37.25.C03.1.454.CMB.1.raw
  modified_base (173)..(175): a, c, t, g, unknown or other
  misc_feature (173)..(175): n is a, c, g, or t

SEQ ID NO: 223269 - DNA, 649 bp, Homo sapiens
  misc_feature: GYAE6OF02G9VCE.37.25.C03.1.454.CMB.1.raw
  modified_base (648)..(648): a, c, t, g, unknown or other
  misc_feature (648)..(648): n is a, c, g, or t
tcagtagtgtagatcacgaccggtgctcgatttagtagtgtagatttgggtttgggggtagggcctggtgtcagcctggggggtccctgagactctcctgtgcagcctctggtattaatgtttagctaactctggcatgaactgggtccgccaggcctccaggcagttggggctggcaggtgggtctacaagtaactagtgctcctggtaatagagcagactacgctacgtacctccgtaggaacgggtccgttacacctatcctaccagagactaacgttccaagaacacgcctctaactctgacaaatgaacagcctagagacgccgaagacgacggaccgtatattactgtgtagaaggtcgtgggagtcgggggactacggtcgggaccgaacggggaacccgtggtacctaccggtcctccgtcgaccgtccctacccgaccgaacgggcccctacgttcccggttcccttcccccgtcggtccctaccccgttccctacccgaacgtacgacctacccgtcggtcggggtaccacgaccggccggcccgtcgggcctcgccgtggtacgaacggtacctaccgttccactcctacctacgtacgtcggacggccggcgtcggacgacggccgacgactagcng

SEQ ID NO: 223270 - DNA, 175 bp, Homo sapiens; identical to SEQ ID NO: 223151
  misc_feature: GYAE6OF02HZJ7F.37.25.C03.1.454.CMB.1.raw
  modified_base (175)..(175): a, c, t, g, unknown or other
  misc_feature (175)..(175): n is a, c, g, or t

SEQ ID NO: 223271 - DNA, 176 bp, Homo sapiens
  misc_feature: GYAE6OF02IZBZ9.37.25.C03.1.454.CMB.1.raw
  modified_base (175)..(176): a, c, t, g, unknown or other
  misc_feature (175)..(176): n is a, c, g, or t
tcagtagtgtagatcacgaccggtgctcgatttagtagtgtagatttgggtttggggggaagaggaagactgacggtccccccaggagttcaggtgctgggcacagcggccctgggctgcctggtcaaggactacttccatctacactactgagcgggctggcaaggcgcatagnn

SEQ ID NO: 223272 - DNA, 796 bp, Homo sapiens
  misc_feature: GYAE6OF02IJGMX.37.25.C03.1.454.CMB.1.raw
  modified_base (206)..(206): a, c, t, g, unknown or other
  misc_feature (206)..(206): n is a, c, g, or t
tcagtagtgtagatcacgaccggtgctcgatttagtagtgtagatttgggtttgggggaggcctggtgcagcctgggggggtccctgagactctcctgtgcagcctctggtttcatctttagcaactacgccatgagctgggtccgccaggctccagggaaggggctggagtgggtctcaggtattactggagtggtaataccganatactacgcagactccgtgacgggtcgttacaccgtctccgagagactaacttaccaagaattacggtactatcgtaaggaaatacgaacgagtaccgtagaagacggacggaacggaaccgaccggtcccttactaacgtttactggtacggacgaaggtaacgaactacgaaggtaacgggaagttaacgtaacgaccaagtacgaacgtacttacgtaacgtaacttacgggtacggggacccgaaaccgggtaaccctttcggggtaccctacccgttaccttaccctacgaaccgtaccctacccgaaaccggaaaccgggaccccgtaacggttacccggtttcccgtttccccggtacggtaaccctacccgttacccgtaaccgtaaacgaacgacccgtaaccggttaccggtacgggggtaccgaaccggaccggacccggtacccggtccgggtccgttaccgccggttacggtaaccgtaaacgggtaaccttaccgttaacccgtaccgtaacgtaacctaacgtaaccgtacggacggaccgggtacgacggtaacggaacggtacggtacgaacg

SEQ ID NO: 223273 - DNA, 612 bp, Homo sapiens
  misc_feature: GYAE6OF02GOVJN.37.25.C03.1.454.CMB.1.raw
tcagtagtgtagatcacgaccggtgctcgatttagtagtgtagatttgggtttgggctgagctggctttttcttgtggctattttaaaaaggtttccagtgtgaggtgcagttgttggagtctgggggaggcctggtgcagcctggggggtccctgagactctcctgtgcagcctctggattaatgtttagcaactctggcatgaactgggtccaccaggctccgaggcagtggggctgcaggtgggtctacaagtactagtgctcctggtaatagagcaagactacgcagacctccgtaggaacggggtccggttcaccatcctccaagacgaccaattacccaaagaaacaccgctactatctgacaaatggaacagcctagagacgaccgaagacgacggcctaatactacgtgtagtaggaaggcgtaggggaggtcgggggactacgggcggggacgacgggaccgtggtaccgtccgtctccgtcgacgccctaccgaccgaaccggccctacgtccgtcccttccccgtcgcccacccgtcctaccgaacgccacgacccgtcggtacgggtacgacgccggccggtcccggtcggccgtaccgg

SEQ ID NO: 223274 - DNA, 661 bp, Homo sapiens
  misc_feature: GYAE6OF02JAC58.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacgacggccgtatattactgtgtgaaaggctggggagtgggggactacgtggggccagggaaccctggtcaccgtctcctcacgcctccaccgacgggcccacgtccggttcctttccccccgtggaccctaccccttcccgtacccgaaacgtaccggaccctaccccgttccggtcggggggcccaaccgaaccggtcccgggtcccggtacggggcccgttgtcccggttcgggtccgaaacgggttaccgttaaccctttccgtaaccttaccgtaaccttaaccgttaaccgtacggtacgggtaccgggtcgttacggggaccgaacggggtccgaccgtacggttacggaccgtg

SEQ ID NO: 223275 - DNA, 630 bp, Homo sapiens
  misc_feature: GYAE6OF02GFQM9.37.25.C03.1.454.CMB.1.raw
  modified_base (361)..(361): a, c, t, g, unknown or other
  misc_feature (361)..(361): n is a, c, g, or t
  modified_base (626)..(626): a, c, t, g, unknown or other
  misc_feature (626)..(626): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaaagaacacgctctatctgacaaatgaacagcctagagagaccgaagacgacggccgtaatattacgtgtgtagaaaggcgtaggggagtgggggactacggnggggccgaacgggacccgtggtccaccgttcctccgtacgacgccctaccgaaccgacgggcccacgtccggtcccttcccccgtggccctacccctccctaccaacgacgacctaccgtcggtacggggccacgacggcccggtcccgtggggcctcgccgttacggtacgaaacggtaccttaccttacccacttacctaacctacgtaaccgtaggacgggtccgggtccgtacgggaccgaacgggccgacgtaacgtagntacg

SEQ ID NO: 223276 - DNA, 381 bp, Homo sapiens
  misc_feature: GYAE6OF02ICUOE.37.25.C03.1.454.CMB.1.raw
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (375)..(381): a, c, t, g, unknown or other
  misc_feature (375)..(381): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctgggggatggggggactacgtgggggccagggaaccctggtcaccgtctcctcagcctccaccaagggcccatccggtcttccccctggccaccctcctccaagagccacctctgggggcacagcggccctgggctgccgtggtcgaaggactactccatctacactacngagngggctggcaaggcgcatgnnnnnnn

SEQ ID NO: 223277 - DNA, 602 bp, Homo sapiens
  misc_feature: GYAE6OF02JE372.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacacagactccgtgaagggccggttcaccatctccagagacaattccaagaacacgctctatctgcaaatgaacagcctgagagccgaagacgacggccgtatattactgtgtgaaaggcgtggggagtgggggactacgtgggccagggaaccctggtcaccgtctcctcacgcctcaccgaacgggcccacgtcggtccttcccccgtggccctaccctccctccaacgacgccgacccgttcgtcgggggacctaccgacggccggtcccgtacgggccgtcggccgttcggtaccgaacggtaccttaccgttccgtacttccttacaaccgttacctacggtacggccgggtacgtcggaccgaacgggtcgacccagttagctacg

SEQ ID NO: 223278 - DNA, 550 bp, Homo sapiens
  misc_feature: GYAE6OF02GW8VD.37.25.C03.1.454.CMB.1.raw
  modified_base (428)..(428): a, c, t, g, unknown or other
  misc_feature (428)..(428): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtccgccaggctccaggcatggggctgcagtggtctcaagtactagtgctcctggtaatagagcagactacgcagactccgtgaagggccggtcaccatctccagagacaattccaagaacacgctctatctgcaaatgaacagcctgagagccgaagacacggcgtatattactgttgtaggaaaggcgtggggagtggggggactacgtggggccgacgggtaacccgtggtcaccgtctcctcacgcctccaccgaacgggcccatccggtcctccccgtgccnccctcctccacgacgcacctcgcggggcacgacgccggccgtgggcctcgcgtggtcgaacggtctacgttccacgtctactactcgtgacggcggcctggaccgaggccgacgntacgncg

SEQ ID NO: 223279 - DNA, 703 bp, Homo sapiens
  misc_feature: GYAE6OF02I1G2J.37.25.C03.1.454.CMB.1.raw
  modified_base (148)..(148): a, c, t, g, unknown or other
  misc_feature (148)..(148): n is a, c, g, or t
  modified_base (244)..(244): a, c, t, g, unknown or other
  misc_feature (244)..(244): n is a, c, g, or t
  modified_base (311)..(311): a, c, t, g, unknown or other
  misc_feature (311)..(311): n is a, c, g, or t
tcagtagtgtagatcacgaccggtgctcgatttagtagtgtagatttgggtttgggggtaggccgtggtgcagcctgggggtcccgtgagactctcctgtgcagcctctggattaatgtttagctaactctggcatgaactgggtccncaggctccaggcatgggctgcagtggtctcaagtactagtgctctggtaatagagcaagactacgcagactccgtagaacgggccgttcacatccncagagacaatcaagaacacgctactatctgacaaatcgaaacacgtacctagacgagtacgaacganaccggacgtatacttactgttataggaacggcgtaggggagtacgggggactaggtcgggaccgaggggaaccccgtgggtaccgaaccggttccctaccgtccggacgtacccgtaccgaacccgaaacgggtcccctaacggtcccgggttccctttacccccgtcgggtacccgcccccgttccgaccctaccggtacggaccggtacccctaccggtacccgaccgggtaccaccgaacccgtaacggcccggtacccgttaccgggccgtccgccgttaccgggtacgtaaaccggccgttaacccttacgtaccgttaacccacttacccgttaccgacgtaaccgggcggtaccgttcgggaccgtacggtcggaactacgtacg

SEQ ID NO: 223280 - DNA, 235 bp, Homo sapiens
  misc_feature: GYAE6OF02GNI18.37.25.C03.1.454.CMB.1.raw
  modified_base (233)..(235): a, c, t, g, unknown or other
  misc_feature (233)..(235): n is a, c, g, or t
tcagtagtgtagatcacgaccggtgctcgatttagtagtgtagatttggggttggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnn

SEQ ID NO: 223281 - DNA, 634 bp, Homo sapiens
  misc_feature: GYAE6OF02HFXR4.37.25.C03.1.454.CMB.1.raw
  modified_base (318)..(318): a, c, t, g, unknown or other
  misc_feature (318)..(318): n is a, c, g, or t
tcagtagtgtagatcacgaccggtgctcgatttagtagtgtagatttgggtttgggctgagcgtcgcgtttctaggtcggctattttaaaaggttccagtgtgaggtgcagttgttggagtctgggggaggcctggtgcagcctggggggtccctgagactctcctgtgcagcctctggattaatgtttagcaactctggcatgaacgtgggtccaccaggctccaggcagtggggctgcagtgggtctcaagtactagtgctctggtaatagagcagactacgcagactccgtgaacgggtccgttacacctatccnccgagacgtacaattcccaaagaaccacgctctatctgcaaatgaactagcctagacgacgccgaaagcgacggccgttaatacttactgtcgtaggaaacggcgtaggggagtggggggtactacggtcggggaccgtacgggaacccgttggtccgtaccggttcctccgtcgacgtccctcccgaacccgaaccgggccctaacgttccggttcccttaccccgtcgccctacccgtcctacccgtaacgacgtaccgaccgttccgtcggggtaccacggaccggtcccggtacccgttcgggaccgtccgg

SEQ ID NO: 223282 - DNA, 595 bp, Homo sapiens
  misc_feature: GYAE6OF02ILWVS.37.25.C03.1.454.CMB.1.raw
  modified_base (591)..(591): a, c, t, g, unknown or other
  misc_feature (591)..(591): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactagcagactccgtgaagggccgttcaccatctccagagacaattccaagaacacgctctatctgcaaatgaacagcctagagagccaagacacggccgtatattactgtgtgaaaggcgtgggagtagggggactacgtggggccaagggaaccctggtcaccggtctcctcacgtcctaccaccgaagggcccaagtccggtccttccccgtaggccacccttcctaccgaagcgacacccgttcgtcggggcctaacgcgtaccgggccctggggcctcggcccgttgggtaccaaggtaccttaaccttccgaattcctaacctacctacgtacggacggtacgggccgttagggaccgtaacggccgacgacgttagntacg

SEQ ID NO: 223283 - DNA, 587 bp, Homo sapiens
  misc_feature: GYAE6OF02GAYRW.37.25.C03.1.454.CMB.1.raw
  modified_base (583)..(583): a, c, t, g, unknown or other
  misc_feature (583)..(583): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggcgtggggagtgggggactacgtggggccgagggaacccgtggtcaccgtctcctcacgccctccaccgaacgggcccacgtccggtccttcccccgtggcccaccctccctaccaacgacgccaccgtcgtcggggccacgacggccggcccgtgggccgtcgcccgtcggtaccgaacggaccttaccgttccacttcctaaccgtactaccgtacgacggccggtcgtggaccgtaacgggccgacagtacgntacg

SEQ ID NO: 223284 - DNA, 613 bp, Homo sapiens
  misc_feature: GYAE6OF02G18R3.37.25.C03.1.454.CMB.1.raw
  modified_base (409)..(409): a, c, t, g, unknown or other
  misc_feature (409)..(409): n is a, c, g, or t
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggcccggttcaccatctccagagacaattccaaagaacacgctctatctgacaaatgaacagccctagagacgcccgaaagaccacggccgtaatattactgtgtagaaaggngtggggagtgggggactacgcgggccgacgggaccctggtacacccgtctcctcgacgtccctccgacccgaacgggcccacgtcccgggttcccttcccccgtcggccctaccccttcccgtaccgtaaacgaccgacccgacccgttaccggtccgggggtaccaccggacggcccgggaccccggtcggggaccgttccgg

SEQ ID NO: 223285 - DNA, 237 bp, Homo sapiens
  misc_feature: GYAE6OF02GEMVS.37.25.C03.1.454.CMB.1.raw
  modified_base (233)..(237): a, c, t, g, unknown or other
  misc_feature (233)..(237): n is a, c, g, or t
tcagtagtgtagatcacgaccggtgctcgatttagtagtgtagatttgggtttggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 223286 - DNA, 626 bp, Homo sapiens
  misc_feature: GYAE6OF02GPJD3.37.25.C03.1.454.CMB.1.raw
  modified_base (624)..(624): a, c, t, g, unknown or other
  misc_feature (624)..(624): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtagaagggccgttcaccatctccagagacaattccaagaacacgctactatctgacaaatgaacagcctagagacgacgaagacacggacgtatattactgtgtagaaggcgtggggaggtggggactacggtggggaccgaacgggtaacccgtggtaccgaccgtctccctacgacgtccctaccgaaccgaacgggccctacgtccggtcccctttccccgtcggccctaccccgtccctacccgaaacgaccgtaccgtacccgtcggtcgggggaccacggacggcccggcccgtgggccgtcgcccgtcggtacgaacggtaccttaccgttccacttacctactaaccgtacgtacggacggccgggtcgtacggacgtacggccgacgagtcgncg

SEQ ID NO: 223287 - DNA, 383 bp, Homo sapiens
  misc_feature: GYAE6OF02HEE1A.37.25.C03.1.454.CMB.1.raw
  modified_base (363)..(383): a, c, t, g, unknown or other
  misc_feature (363)..(383): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaaggcccatcgtctccctgcacctcctccaagcgcacctcgtggggcacagcggccctgggctcgcctggtcaaacggactactccatctacactactgacgcggctggcaaggcgcatgnnnnnnnnnnnnnnnnnnnnn

SEQ ID NO: 223288 - DNA, 714 bp, Homo sapiens
  misc_feature: GYAE6OF02IDUIZ.37.25.C03.1.454.CMB.1.raw
  modified_base (145)..(145): a, c, t, g, unknown or other
  misc_feature (145)..(145): n is a, c, g, or t
  modified_base (328)..(328): a, c, t, g, unknown or other
  misc_feature (328)..(328): n is a, c, g, or t
  modified_base (712)..(712): a, c, t, g, unknown or other
  misc_feature (712)..(712): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccnccaggctccaggcagtggggctgcaggtggtctcaagtactagtgctcgtggtaatagagcagactacgcagactccggtaggaacgggtccgttcaaccattcctccgaagacgaactaacttaccgaaagaacacgctactactctagaacaaatagaacacgctagagacgacgaagacncggactatatactgtgtagaaggcgtaggggaggtacggggtactacggtcgggacgacgggaacccgtggaccgtaccgtctccgacgacgacccgtacccgaaccggaacgggtcccctacggttcccgggttccccttccccgtagggtacccctaccccgtaccgtaccgaaacgaccggtacccgtacccgttaccgggtcggggaaccaccgggacccgggtacccgggcccgggttccgggaccttccgggttacccggtacggttaaccgaaccggttacttaaccccgttccaacgttaccctaaccgtaccgttaaccggtacgggcgggtaacccggtccggaggtccgaaccgggtccaacgttagtacggnac

SEQ ID NO: 223289 - DNA, 540 bp, Homo sapiens
  misc_feature: GYAE6OF02I3HWX.37.25.C03.1.454.CMB.1.raw
  modified_base (532)..(532): a, c, t, g, unknown or other
  misc_feature (532)..(532): n is a, c, g, or t
  modified_base (538)..(539): a, c, t, g, unknown or other
  misc_feature (538)..(539): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaaggctggggatgggggactacgtggggccagggaaccctggtcaccgtctcctcagccctccaccaacgggcccagtccggtccttcccccgtggccaccctcctccaagacgcaccctcgtcggggcacgacggccggccctagggcctcgccgtcggtccaaggacctacttccactctacactctagacgcggcgtggcaggcgnagtagnng

SEQ ID NO: 223290 - DNA, 185 bp, Homo sapiens
  misc_feature: GYAE6OF02IUPV8.37.25.C03.1.454.CMB.1.raw
  modified_base (176)..(185): a, c, t, g, unknown or other
  misc_feature (176)..(185): n is a, c, g, or t
tcagtagtgtagatcacgaccggtgctcgatttagtagtgtagatttgggtttgggggggaagaggaagactgacggtccccccaggagttcaggtgctgggcacagcggccctgggctgcctggtcaaggactacttccatctacactactgagcgggctggcaaggcgcatagnnnnnnnnnn

SEQ ID NO: 223291 - DNA, 682 bp, Homo sapiens
  misc_feature: GYAE6OF02IWIV4.37.25.C03.1.454.CMB.1.raw
  modified_base (679)..(679): a, c, t, g, unknown or other
  misc_feature (679)..(679): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtggtctcaagtactagtgctctggtaatagagcagactacgcagacctcgtggaacggtccggttcaccatcctcagagacaattccaagaacacgctctatctgacaaatgaacagcctagagacgaccgaagacgacggccgtatattacgtgtgtaggaaggcgtggggaggtcgggggactacggtcggggccaacgggacccgtggtcctaccgtctcctcgacgtccctaccgaaccgaacgggtcccctaaggtcccggtttccccttcccccggtcggaccctaccccttacccgtaccccgaaaggtaccgccgtacccgttccgggtcgggggaccctaaccggaccgggcccgggtcccgttgggggcccttacggtcccggttcggtaaccgtaaacgggtaccctttaaacccttcccgaacgttacctaacccttaccgtaacgttaggaccggtcgggcgttcgggaacgtacgggaccgtacgtagtacggtnacg

SEQ ID NO: 223292 - DNA, 861 bp, Homo sapiens
  misc_feature: GYAE6OF02HRIB1.37.25.C03.1.454.CMB.1.raw
tcagtagtgtagatcacgaccggtgctcgatttagtagtgtagatttgggtttgggggagcctaggtacgcagcctgggggtccctgagactacctctgtgcagctctcgattaactgtttagcaacgtctggcatcgaacttgggtccgcgaggctccaggcagtgggctcgctacgtgggtctcaagtactaggtgctcgtgtagtagagcagaactacgcagactcgagtaaggccggttcaccagtctaccgagtacgactaactttaccgaaacgtaacctaccgtactacgttactacctagtactaaagtcggaaaccaacgcccgtagaacggaacggaccgtaaacggaccgacgggtaccgtaagtacggtttaacgtacggtacgtaacgtaaaacggcgttaggggtacgtacgggggaacctacggtacggggtcctaacgggtaaccccgtacggtacccgtaccggttacctacccgtacgtaaccgtacctacccgaaccgaaaccggggtacccctaaccgtttccgggttaacccctttacccccgacggtaccccgtaacccccgttaccgtaacccgtaaagggtaccggttacccgtaacccgggttaccgggttaccgggggtaacccaaacccgtaccgggtacccgggtacccgggtaccggggttacccgaaccgggtttcccgttaaccgggtttaaaccggtaaacgggtaccttaaacccggttaccgtaacggttacccttaaccgtaacccggtttaacgttaccgggaaggtacccgggtacgttacggggaccgaaccggtccggttaccctaaggttacgtagtacgg

SEQ ID NO: 223293 - DNA, 755 bp, Homo sapiens
  misc_feature: GYAE6OF02JBQKU.37.25.C03.1.454.CMB.1.raw
tcagtagtgtagatcacgaccggtgctcgatttagtagtgtagatttgggtttgggggaggcctggtgcagccgtgggggtccctgagactctcctgtgcagcctctggattaatgtttagcaactcgtggcatgaactgggtccgcgaggctccgaggcagtgggctgacagtggtctacgaagtactagtcgctcgtaggtaatagagcagactacgcgagaccgtccggtaggaacgggtccgttacacctatcctaccgaagacgaactaacttaccgaaagaacacgtctactactcgtagacctaaaagtcgaaacacgtacctaggacgaacgaccgaacgacgacggaccttaagtacttacgtaggtagtacggaaaaggtcggtaggggacgtacgggggtaactaccgggtacggggacccgtaaacgggtaaccccgtggtaaccgtacccgttaccgtacccgtaccgaccgtacccgttaacccgaaaccggtaaccggtacccgtaacgttccccgggttaccccgttaccccggtacggtacccttaccccgtacccgtaaccgaaacggtaccgtacccgtaacccgtccgggtccgggacctacggaccggtacccgccggtacggccgtccgccggttacgtaccgaaccgtccgtaaccgttccgtaacctacctaacgtacgtaacgtcggaacgggtccgtacgacggacgacgaccgacgaacgtgcgtacg

SEQ ID NO: 223294 - DNA, 931 bp, Homo sapiens
  misc_feature: GYAE6OF02IFLZJ.37.25.C03.1.454.CMB.1.raw
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagccgtggggggtccctgagactctcctgtgcagcctctggatttaatgtttagacaacctctggctatgaaccgtcgggtccgccgaggcctccgaggcagtcggggctgcgagggtgggtcctacgaagtacttaggtcgccttccgtagggttaaataggaacgcgaagtaaccgtacgcaaacggtccttcccgggtagggaaccgggggtcccgttaccaaccctagttccgacccaaggaacgaacctaacgttacccgaaaaagacccaccgtcttactactacgtacgaacctaaaacgtgaaaacctcggtaaccctgggaaacggaaccgaacccggtaaaagaccccggaaccgggtaccgtttaaacgttttaacgtttacgttaggttacggtaaacgggtaaacggggtacgggttaggggggtaacggggttaacggggggggtaaccgtaccgggggtaccgggggtaacccgggaaccggggtaaaccccggttccgggtaaccccgtacccggttcccgtacccgttaccgacccggtaccctaaccccggtaaccccgggaaaccgggtcccccgtaacgggttccccgggtttaccccgttaccccccggtcccgggtaacccccgttacccccgttaccccgtaacccggtaaacccggttacccggtaaccccggttaaccccggttcccggggtaacccgggggtaccgaccccgggtaacccgggtcccccggggtacccccgggtttccggggaccccggttcccggg

SEQ ID NO: 223295 - DNA, 730 bp, Homo sapiens
  misc_feature: GYAE6OF02JC8WO.37.25.C03.1.454.CMB.1.raw
  modified_base (231)..(231): a, c, t, g, unknown or other
  misc_feature (231)..(231): n is a, c, g, or t
  modified_base (720)..(720): a, c, t, g, unknown or other
  misc_feature (720)..(720): n is a, c, g, or t
tcagtagtgtagatcacgaccggtgctcgatttagtagtgtagatttgggtttggggtcgtcaactcgtcttggtccgccaggctccaggcatggggcgtcgcagtgggtctcaaggtactacgtgctcctggtaatagagcgagacctacgcagactccgtgaagggccggttcaccatctccagagaccaacttccaagaacacgctcgtaatcctgcaaatcgaaacncgtcctggacggtagaccggaaagaccacgggtccgtaataactttaacttaggtcgtagaaaggctaggggagtacgggggaacgtacgtcgggaccgacgggaaccctggtaccaccgtcgtcctcgacgcctccgaccgaacggacccaacggttccggtaccttccccgtggtaccctaccccgtccgtaccgaaggacgcgtaaccgtccggtgggggaccacgtacgtcccgggtacccgttcggggcctaccggtccgttacgggtacgtaaacggggtcctttaaccgtttacccgtaaacgttcgttaaacccgttaacgttaccgtacggtaccgggtaccgggttccgttaacgggtaccggaaacgggtaccgtaactaacgttacgggtctacggtacgacgtacgtacgacgtactaaacgtactagttcggactcgacgatccgtatcgtcgtaacgtctaccgttaggccttncgtactgtac

SEQ ID NO: 223296 - DNA, 659 bp, Homo sapiens
  misc_feature: GYAE6OF02IRVD5.37.25.C03.1.454.CMB.1.raw
  modified_base (258)..(258): a, c, t, g, unknown or other
  misc_feature (258)..(258): n is a, c, g, or t
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
tcagtagtgtagatcacgaccggtgctcgatttagtagtgtagatttgggtttgggctgagcgtggctttttcttgtggctattttaaaaggtttccagtgtgaggtgcagttgttggagtctgggggaggcctggtgcagcctggggggtccctgagactctcctgtgcagcctctggattaatgtttagcaactctggcatgaactgggtccgccaggctccaggcatggggctgcagtgggtctcaagtactagngctcctggtaatagagcaagactacgcagaactccgtgaaggggcccgttcaccattcnccagagacaattccaaagaacacgctactaanctgacaaatcgaaacagccctggagacgccgaaagtacgaacggccgtaatacttactagtgtaggaaaggcgtaggggagacggggggtaataacggcggggtccgaacggggtaaacccgtcgggtcaaccggtaccttccctacgtacgacccttacccgaaccgaaaccggggccccgaacgttacccggttcccgttttccccccgtgggacccttaccccgtacccttacccgaaacggaaccggtccaacccgttacgtcgggggaccggtacgaccggaccggcccggtacgggtccgtcgg

SEQ ID NO: 223297 - DNA, 576 bp, Homo sapiens
  misc_feature: GYAE6OF02H88VD.37.25.C03.1.454.CMB.1.raw
  modified_base (145)..(145): a, c, t, g, unknown or other
  misc_feature (145)..(145): n is a, c, g, or t
  modified_base (351)..(351): a, c, t, g, unknown or other
  misc_feature (351)..(351): n is a, c, g, or t
  modified_base (422)..(422): a, c, t, g, unknown or other
  misc_feature (422)..(422): n is a, c, g, or t
  modified_base (575)..(575): a, c, t, g, unknown or other
  misc_feature (575)..(575): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccnccaggctccaggcatggggctgcagtgggtctcaagtactagtgctcctggtaatagagcagactacgcagactccgtgagggccgttcaccatctccagagacaattcaagaacacgctctatctgacaaatgaacagcctagagagaccgaagacgacggccgtatattactgtgtagaaaggcgtggggagtggggactacgngggcacgggacctggtccaccgtctctcacgcctaccacgacggcctacgtccggtccttccccgtcgccnccctcctaccgaagacgcctaccgtcggtcggggcacgacggccggccgtcgggctcggccgtcggtaccgaacggtaccttaccttccacttacctaacctacgtacgtacggacggtccgggtcgacggaccgaacggccgacgtactcgnc

SEQ ID NO: 223298 - DNA, 941 bp, Homo sapiens
  misc_feature: GYAE6OF02GSHK6.37.25.C03.1.454.CMB.1.raw
  modified_base (110)..(110): a, c, t, g, unknown or other
  misc_feature (110)..(110): n is a, c, g, or t
  modified_base (149)..(149): a, c, t, g, unknown or other
  misc_feature (149)..(149): n is a, c, g, or t
tcagtagtgtagatcacgaccggtgctcgatttagtagtgtagatttgggtttggggaggcttggttacggagcctaggggggtccctgagactctcctggtgcagcctntggtttcagtctttagcaactacgccatgagttggtccncaggctccgagggaagggctggaggtcgggtctcaggtacttacgtggtagtggtaactaccggctattacgttacgcgagtaccttccggtagacggggtcccggtttacacccgttctccagacgacaacttccaaaggaactacgggtctaatcgtaggaaaattggaaactagtccttggacgtacgtccggaaggaaccaccgggccccttacgtaagtttaacctacggtaccgtacggagaagtattaccgtaaggaaccggggtaagttaagtaaggtaccgacggacccgtaagggtccgtttactaggtaaccgtttaacggttcggggggtacccctaaccggggtaaaccccttgggttaacccgacccggttcccgtaccccgtaccgaaccggtcccccttaccccgaacccggaaaccggggtacccctaacggttcccgggtttaccccgtttccccccggttacgggaccccgttaacccccgttccccggttaacccggaaacggtaaccggtacccgtaacccggtttaccggttaccggggggtaccctaaccggaaccgggtcccggggtaccccggttacggggtaccgttccgggtacccgggtttacggggttaacccgtaaaccgggttaccctttaacccgttttacccgtaccgtttacccgttaacccgttaaccgttaaccggttaccgggtaaccgggtcccggggtaccgttaccggggtaccgtaaccggggaccggtaaccgtaccggttacggaaccg

SEQ ID NO: 223299 - DNA, 777 bp, Homo sapiens
  misc_feature: GYAE6OF02IF72U.37.25.C03.1.454.CMB.1.raw
  modified_base (284)..(284): a, c, t, g, unknown or other
  misc_feature (284)..(284): n is a, c, g, or t
  modified_base (726)..(726): a, c, t, g, unknown or other
  misc_feature (726)..(726): n is a, c, g, or t
tcagtagtgtagatcacgaccggtgctcgatttagtagtgtagatttgggtttgggggaggccgtggtgcagcctggggggtccctggagactctcctgtgcagcctctggattaatgtttagcaactctggcatgaactgggtccgcaggctccaggcagtggggctgcagtgggtctcaagtactagtgctccgtgtaatagagcagactacgcagactcgtagaagggccggttacaccatctccagacgacaattcaaacgaacacgctctaatcctganaaatagaaacacgccgtgaacgacggaccgaaagaacccgacggaccgtattaactttacgtacgtggttaagaacgggtacggtagggggtaaggtacggggggtaccgttaacgggcgggggtacccggaaccgggggttaacccgttaccggggttacccgtaacccggtttacccgtttacccgtacccggtaaccggtccccgtttaacccgaaccccggaaaccgggtaccccgaaccggtttcccgggttcccccggtttaccccccgtcgggtaccccgtacccctacccgtaccccgtaaacgtaccgtaccgtacccgttaccggtcgggggcctaaaccggcggtacccgggcccggtcgggaccgtccggtacccgtgggtaccgtaacggtaaccgacccttaccactcccgtaactaccgttaaccgngtaccggccgggtcgcggttacgaacgggtccgtcgaacgttcggatccgg

SEQ ID NO: 223300 - DNA, 769 bp, Homo sapiens
  misc_feature: GYAE6OF02GILT4.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggggaaggggctggagtgggctcagcctatttccggcaatggtggtggcacgcactacgcagactccgtgaacgggccgttcaccgtctccagagacaattccaggaacactctatatctgacaaagtagaacagcctagacgacgaccgacgacgacggaccatacgttatttataggtcgaacgtaaaacgaccccgtaaggtacgaacccagtaacgttaggaattccgtttttacgacctttcggtacggggacccgtaaaggggacctaaccgggttcccaacccggttccttccgttaccgaccgtaccctacccaacccgaaaccgggaccccgtacgttacccggttccccgttttaccccccgtacgggtccccgtccccgtaccggtcccgtacccggtaacggaccgtaccccgtaacccggtcccggaacggtccgacccgaacccgtacgggtccccgggacccccggttggggcccttacggtccccggttaggtaacccggtacgtaaccctttacccgtcccgtaacctttccctaaccgttaacccgttacgtacggacgggtccgggtacccgtcggggacccggaaggtacccgg

SEQ ID NO: 223301 - DNA, 440 bp, Homo sapiens
  misc_feature: GYAE6OF02GZFYG.37.25.C03.1.454.CMB.1.raw
  modified_base (407)..(407): a, c, t, g, unknown or other
  misc_feature (407)..(407): n is a, c, g, or t
  modified_base (410)..(440): a, c, t, g, unknown or other
  misc_feature (410)..(440): n is a, c, g, or t
tcagtagtgtagatcacgaccggtgctcgatttagtagtgtagatttgggtttgggattcacgttgcagactccgtgaagggccggttcaccatctccagagtacaattccaagaacacgctctatctgcaaatgaacagcctgagagccgaagacacggccgtatattactgtgtgaaaggctggggatggggggactacgtggggccagggaaccctggtcaccgtctcctcagcctccaccaacgggcccatcggtccttccccctggccacccctcctccaagacgcacctcgtgggggccacgacggccggccctggggctcggcccgtggtaccaaggtacctaccttccacttctaccacgttactggacggccggggctggacgtaacggcgcaagtgnagnnnnnnnnnnnnnnnnnnnnnnnnnnnnnnn

SEQ ID NO: 223302 - DNA, 546 bp, Homo sapiens
  misc_feature: GYAE6OF02HJ1SH.37.25.C03.1.454.CMB.1.raw
  modified_base (544)..(544): a, c, t, g, unknown or other
  misc_feature (544)..(544): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaaggccgttcaccatctcagagacaattccaagaacacgctctatctgcaaatgaacagcctgagagccgaaggcacggccgtatattactgtgtagaaaggcgtggggagtgggggactacgtggggccagggaaccctggtacaccgtctcctcacgcctccaccgaacggcccagtccggtcccttccccgtcggcctaccctcctacccaagacgcctacctccgtcggggcacgacgcggccgtgggcctgccgtggaccaaggactactccatctactactacgtgacgcggcgtggacgacggccacgatagncg

SEQ ID NO: 223303 - DNA, 391 bp, Homo sapiens
  misc_feature: GYAE6OF02HLIAK.37.25.C03.1.454.CMB.1.raw
  modified_base (296)..(296): a, c, t, g, unknown or other
  misc_feature (296)..(296): n is a, c, g, or t
  modified_base (383)..(391): a, c, t, g, unknown or other
  misc_feature (383)..(391): n is a, c, g, or t
tcagtagtgtagatcacgaccggtgctcgatttagtagtgtagatttgggtttggggattcgacgttgcaggaccctccggtgtaaggtccgggttcaccagtctccagaggaccaagttccaagaacacgctctatctgcaaatgaacagcctgaggagccgaagacgacggccgtatattactgtgtgaaaggctggggatggggggactacgtggggccagggaaccctggtcaccgtctcctcagcctccaccaagggcccatcggtcttcccctggcaccctcctccaagngcacctcgtggggcacagcggccctgggctgccctggtcaaggactacttccatctacactactgagcggctggcaaggcgcatagnnnnnnnnn

SEQ ID NO: 223304 - DNA, 656 bp, Homo sapiens
  misc_feature: GYAE6OF02JB1R9.37.25.C03.1.454.CMB.1.raw
  modified_base (109)..(109): a, c, t, g, unknown or other
  misc_feature (109)..(109): n is a, c, g, or t
  modified_base (153)..(153): a, c, t, g, unknown or other
  misc_feature (153)..(153): n is a, c, g, or t
  modified_base (193)..(193): a, c, t, g, unknown or other
  misc_feature (193)..(193): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (319)..(319): a, c, t, g, unknown or other
  misc_feature (319)..(319): n is a, c, g, or t
  modified_base (368)..(368): a, c, t, g, unknown or other
  misc_feature (368)..(368): n is a, c, g, or t
  modified_base (647)..(650): a, c, t, g, unknown or other
  misc_feature (647)..(650): n is a, c, g, or t
  modified_base (652)..(656): a, c, t, g, unknown or other
  misc_feature (652)..(656): n is a, c, g, or t
tcagtagtgtagatcacgaccggtgctcgatttagtagtgtagatttggggtttgggggaggcctggtgcagcctggggggtccctgtagacttctcctgtgcagcctntggattaatgtttagcaactctggctatcgaacgtggggtcccnccgaggtctccgggcagtggggcttggcaggtgggtctanaagtactagtgcctctgggtaatagagctagactacgacagaccttccgnggaacgggtccgttcaccatcnccgaagacgtactaacttccaaagaacacgctctaatctagacaatagaacacncgtggaagaggaccgaagacacggacgtatacttactgtagagtaaggngtaggggacggtagggggactaacggtcggggacgacggaacccgtggtactacgtcgtctacgaccgacctaccgaacgacggacccaacgtttcccgtacctttcccccggagtacccacccgtaccttaaccgaaacggacgtcctaaacccggttcggagggggacccaacggtacccgccgggtaacccgtggggtaccctacgggtccgttaaccgggttacgaaaccggttactaccctttacgaacctccgttacgactaccggtaggtannnnannnnn

SEQ ID NO: 223305 - DNA, 658 bp, Homo sapiens
  misc_feature: GYAE6OF02GSTAH.37.25.C03.1.454.CMB.1.raw
  modified_base (655)..(655): a, c, t, g, unknown or other
  misc_feature (655)..(655): n is a, c, g, or t
tcagtagtgtagatcacgaccggtgctcgatttagtagtgtagatttgggtttggggggaggcctggtgcagcctgggggggtccctgagactctcctgtgcagcctctggattaatgtttagcaactctggcatgaactgggtccgccaggctccaggcagtggggctgcagtggtctcaagtactagtgctctaggtaatagagcagactacgcagacctcgtgaacgggccgttcaccatctcagagactaattccaaagaacacgctctatctagacaaatgaacagcctaggaacgacggaccgaaacgaccgaccgggtaccgttaattactttaacgttcggtaggttaggaaaacgggtcggtaggggggaggtacgggggtacgtacggtcgggggacccgaacggggtaccctggtccacgtcctcctcaccgcctaccgaccgacggaccctacgtccggttcccttccccgtcggaccctaccccgtccctaccgaacgacgcccgtaccgtcggtacggggcacgcggccggcccgtcggtcgtcgtccgtacgggtaccgtaacgtactaccctactacctactaaccttaccgtcgtacggacggtccgggtacgtacggacgacggaccgagacgtagntcg

SEQ ID NO: 223306 - DNA, 592 bp, Homo sapiens
  misc_feature: GYAE6OF02H20HB.37.25.C03.1.454.CMB.1.raw
  modified_base (258)..(258): a, c, t, g, unknown or other
  misc_feature (258)..(258): n is a, c, g, or t
  modified_base (590)..(591): a, c, t, g, unknown or other
  misc_feature (590)..(591): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtccgccaggctccaggcatggggctgcagtgggtctcaagtactagtgctctggtaatagagcagactacgcagactccgtgaagggccgttcaccatctcagagacaattccaanaacacgctctatctgacaaatgaacacgcctagagacgaccgaaagacgacggaccgtattattactgtgtagaaggcgtgggaggtaggggactacgtggggaccgaacgggacccgtggtacaccgtctcctcacgcctacccgaaccgacgggaccctacgtccggttacccttccccgtcggcctacccctccaccaacgacgccaccgtcggtcggggccacgacgccggtcccgtgggcctcgccgtggtaccgaacggtacctacttcctactcctaactaccgtacgtaggacggccggcgtcggcgaacggccgacgtatagnng

SEQ ID NO: 223307 - DNA, 650 bp, Homo sapiens
  misc_feature: GYAE6OF02HZB1T.37.25.C03.1.454.CMB.1.raw
  modified_base (293)..(293): a, c, t, g, unknown or other
  misc_feature (293)..(293): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
  modified_base (441)..(441): a, c, t, g, unknown or other
  misc_feature (441)..(441): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcaggtgggtctcaagtctagtgctcctaggtaatagagcagactacgcagactccggtaggaacgggccgttacacctatcctaccagacgactaacttccgaaaagaccacggtctacgttacncgttgacaaatgaacacgcctgacgacgaccggaagacgaccggaccttatactttaccgtgtgtaggaaacggnggtaggggtaggtcggggacttacgggnggggaccgacgggacccgtaggaccaccgtcctcctcgacgtccncccgaacgaccgggccctacgtcccggttccccgttaccccgtgaccctaccccgtccaccgaacgacgcctaccgtcggtacggggcacgcggcccggtccgtggcctcggccgtacggtacgtaacggtacttaccgttaccacgttacctacgtaccgtacgtcggacggccggtacgaccggtacgacggcgtacgacgtgctag

SEQ ID NO: 223308 - DNA, 241 bp, Homo sapiens
  misc_feature: GYAE6OF02JOOIC.37.25.C03.1.454.CMB.1.raw
  modified_base (233)..(233): a, c, t, g, unknown or other
  misc_feature (233)..(233): n is a, c, g, or t
  modified_base (237)..(241): a, c, t, g, unknown or other
  misc_feature (237)..(241): n is a, c, g, or t
tcagtagtgtagatcacgaccggtgctcgatttagtagtgtagatttgggtttgggggtacgtacgtggggccgagggaaccctggtcaccgtctcctcagcctccaccaagggcccatcggtcttcccctggcaccctcctccaagacgccacctccgtggggcacgagccggcccttgggcctgcctggcaaggactactccatctacactactgagcggctggcaaggcnatgnnnnn

SEQ ID NO: 223309 - DNA, 725 bp, Homo sapiens
  misc_feature: GYAE6OF02GYUF7.37.25.C03.1.454.CMB.1.raw
  modified_base (722)..(722): a, c, t, g, unknown or other
  misc_feature (722)..(722): n is a, c, g, or t
  modified_base (725)..(725): a, c, t, g, unknown or other
  misc_feature (725)..(725): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggcctccgggcagtggggctgcaggtgggtctcaagtactagtgcctctggtaatagagcagactacacagactccggtaggaacgggtcccgttacaccattcctccaagagaacaacttaccaaagaaccacgcctctactcttcgactaaatacgaacacgacctgaacgacgaccggaagaccgtaccggaccgtaatattacgttaggtaggtaggaaaggtcggtagggggaggtacgggggggtaactacgggtcgggggaccgtaacggggtaacccgtcggtaccgtaccgtacctcccgttacgaccgtacccttaccccgaacccggaaccgggcccctaacggttcccggttccccttacccccggtccggaacccctaccccgttaccctaccgaaacgaccgtacctacccggttccgggcgggtaccacgaccgggtcccggaccggtcggccgtccgtacccgttcgggaaccgtaacgtaaccgtaccttaccacttaccgtactaccgtacgtacggtaccggtcgggtccgtacgggacctacggggcacgatgnagn

SEQ ID NO: 223310 - DNA, 813 bp, Homo sapiens
  misc_feature: GYAE6OF02GMHVD.37.25.C03.1.454.CMB.1.raw
tcagtagtgtagatcacgaccggtgctcgatttagtagtgtagatttgggtttgggctccaactctcttgtccgccaggctccaggcgatggggctgcagtgggtctcagtactagtgctcctggtaactagacgcagactacgcagactccgtgaagggccggttcaccatctccagagacaattccaagacacgctctatctgcaaatgaacagcctgagagaccggtaagacacggaccgttatattacgtgtgtgaaaggcgtaggggacgtgggggggaaccttacgtcgggggtaccaggggaacccgtcgggtctaacccggtcctcccgttaccgaacggtccccgtacccgtaacccgaaacggggtaccccctaagttcccgggttaccccgttttacccccccgttcggggtacccctacccccgtttaccccttacccgaaacggtaccgaccgtaacccgtcccgttacgggggggaccaaccgaacgggtccgggtaccccgttaggggtcccgttaccggtcccgtttacggggtacccgtaaggggtaacccttaaccggtttaccctaacgtttacccgtaacctaacccgtttaaccgtacggtaaccggggtaccggggaccggtttacccggggaccgttaaacggggcccggtaaccgtaaacggttaaccggaagccgtaacgcgacgactacgtaaccggcacggttaacacgacgtacgtaacgtacgtaacgtacgaccgtaaccgtacgtacgtaccgtacgtaccgtaccgtacgtacgtacgacg

SEQ ID NO: 223311 - DNA, 177 bp, Homo sapiens
  misc_feature: GYAE6OF02FSNDC.37.25.C03.1.454.CMB.1.raw
  modified_base (175)..(177): a, c, t, g, unknown or other
  misc_feature (175)..(177): n is a, c, g, or t
tcagtagtgtagatcacgaccggtgctcgatttagtagtgtagatttgggtttggggggaagaggaagactgacggtccccccaggagttcaggtgctgggcacagcggccctgggctgcctggtcaaggactacttccatctacactactgagcgggctggcaaggcgcatagnnn

SEQ ID NO: 223312 - DNA, 414 bp, Homo sapiens
  misc_feature: GYAE6OF02JBV2K.37.25.C03.1.454.CMB.1.raw
  modified_base (384)..(384): a, c, t, g, unknown or other
  misc_feature (384)..(384): n is a, c, g, or t
  modified_base (389)..(414): a, c, t, g, unknown or other
  misc_feature (389)..(414): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccaagggcccatcggtccttcccctggccaccctcctccaacgagccacctgtcgggggcacaggccggccctgggcttcgccgttgggtcaaggtaccttaaccttccgacttctacacgtactgagcgggactggcaggcnatagnnnnnnnnnnnnnnnnnnnnnnnnnn

SEQ ID NO: 223313 - DNA, 731 bp, Homo sapiens
  misc_feature: GYAE6OF02JEK7H.37.25.C03.1.454.CMB.1.raw
  modified_base (727)..(727): a, c, t, g, unknown or other
  misc_feature (727)..(727): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagacctccgtgaagggcccggttcaccatcctccagagacaattccaagaacacgctctatctgcaaatgaacagcctgagagaccgaagacgacggccgtaatattactgtgtagaaaggtcgtaggggagtgggggactacgtggggccgagggaacccgtcggtcaccgtctcctcgacgtccctacccgacccgaacgggcccctacgtccggtaccctttccccccgtcgggaccctaccccgttcccgtacccgaaaccggtacggtaccctaaccccgttccgggttacggggggaccctaacccggaccgggtaccccggggtccccggttaccgggggtcccttccgggtaccccggttacgggggtacccgttaaaaccgggtaaccctttaaacccgtttcccgtaaccgtttcccttaaacccgtaacccgtttaaccgtacgggtaaccgggccgggggttccgtaacgggaccggtaaccgggccgacgaacgttacgntacg

SEQ ID NO: 223314 - DNA, 666 bp, Homo sapiens
  misc_feature: GYAE6OF02GY09V.37.25.C03.1.454.CMB.1.raw
  modified_base (655)..(655): a, c, t, g, unknown or other
  misc_feature (655)..(655): n is a, c, g, or t
  modified_base (664)..(664): a, c, t, g, unknown or other
  misc_feature (664)..(664): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgcaggctcaggcagtggggctgcagtggtctacaagtactagtgctccgtaggtaataggagcaagacctacgcagacctccggtaggaacgggtccgttacaccatcctaccaaggacgaactacttaccaagaacacgctactatcttacaatgaacacgctagaagcgaccgaagaccgaccggtaccgtatacttactggtacgtaggaaggcgtaggggaggtggggggaactacgggtcggggacgtaacgggaaccgttggaccgtaccgtcctaccgtacacgcctaccaaccgacggacccacgttccggtacccttccccgtacgtccctaccctcctaccgaacggacaccctaccgtcgggttacgggaccaacgaccggccggtccgacgggtctcggtccgtggtaaccgtaacggtacttaccgttaccattccctactaccgtaggtaaccggacgggtaccggtccgtcgggaacgaccggtacgtaccggtanaccgtgacncg

SEQ ID NO: 223315 - DNA, 467 bp, Homo sapiens
  misc_feature: GYAE6OF02H0GJW.37.25.C03.1.454.CMB.1.raw
  modified_base (447)..(467): a, c, t, g, unknown or other
  misc_feature (447)..(467): n is a, c, g, or t
tcagtagtgtagatcacgaccggtgctcgatttagtagtgtagatttgggtttgggattcacgttgcagatgtaggtctgggtgcccaagctgctgaagggccggttcaccatctccagagacaattccaagaacacgctctatctgcaaatgaacagcctgagagccgaagacacggccgtatattactgtgtagaaaggcgtggggagtgggggactacgtggggccgagggaccctggtcaccgtctcctcacgcctccaccgaacgggcccacgtccggttcccttccccccgtcggccctacccctccctacccgaacgacgccaccgtccggtcggggggaccacgacggccgggtcccggtcgggctcggccgtggtacgaacggtctactccactctacactactggacggcggcgtacggacgacggacgcgaatagnnnnnnnnnnnnnnnnnnnnn

SEQ ID NO: 223316 - DNA, 705 bp, Homo sapiens
  misc_feature: GYAE6OF02F6ZW3.37.25.C03.1.454.CMB.1.raw
  modified_base (701)..(701): a, c, t, g, unknown or other
  misc_feature (701)..(701): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtccgccaggctccaggcagtggggctgcaggtggtctcaagtactagtgctcctggtaatagagcagactacgcagctccgtgaagggccggttcaccatctccagagacaattaccaagaacacgctctatctgacaaatgaaccagcctaggacgacggaccgaaaggaaccgaccggaccgttattaagttacgtgtaggtagaaaggtcgtaggggtaggtagggggtacgtacggtcggggaccggaacgggacccgtcggtaccgaccggtccgtcccgtacgacgtaccctcccgaacccgaacgggtacccgacgttcccggttcccgttccccgtccggtaccctaccccgttaccgtacccgtaacgaccgtacccgaccggttccggacgggggacctaccgacggtcccgggtacccgtcggggtccgtacgccggttacgggtaaccgtaacgggtaccttaaccgttccctacgtacctaccgtaaccgttacgtacggtaccggtacgggacgtcgggaccgaacggtccggaaccgtaggagngtcg

SEQ ID NO: 223317 - DNA, 760 bp, Homo sapiens
  misc_feature: GYAE6OF02HROW3.37.25.C03.1.454.CMB.1.raw
  modified_base (307)..(307): a, c, t, g, unknown or other
  misc_feature (307)..(307): n is a, c, g, or t
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagcctggggggtccctgagactctcctgtgcagcctctggattaatgtttagcaactctggcatgaacgtgggtccgccgaggcctccgaggcagtggggctgacgaggtgggtctcaagtactagtgcctcgtaggtaaatagagcaagactacgcacgacctccggnggaacgggtcccggttaccacctacgtcctacccgagaacgacctaacttaccaaacgaaccgaccgtactactatcctagaacaaagtcgaacacgtccctaggacgacgaccgaaacggactaccggtaccttaattaacgtttacgtaggttaggtaacggaaagggtcgggtaggggtagggtacggggggtaactacgggtacggggaccgtaacggggtaacccgtcggtccgtacccgttcctacccgtacgaccggtacccctacccgaaacccggaccgggtaccctacccggttcccggttaccccgttaccccgtaccggtcccctaccccgttcccgtaaaccgtaaccggaccccggtaccgtacccggttccgggtaccggggacccgtacccggaccgggtccccgggtaccccgggttcgggtacccgttacccggg

SEQ ID NO: 223318 - DNA, 606 bp, Homo sapiens
  misc_feature: GYAE6OF02HQ4MJ.37.25.C03.1.454.CMB.1.raw
tcagtagtgtagatcacgaccggtgctcgatttagtagtgtagatttggggtttggggagcctggtgcagcctggggggtccctgagactctcctgtgcagcctctggattaatgtttagcaactctggcatgaactgggtccgccaggctccaggcatggggctgcagtgggtctcaagtctagtgctcctaggtaatagagcagactacgcagactccgtgaaggccgttcaccatctccagagacaattccaagaacacgctctatctgcaaatgaacagcctgagagccgaagacacggccgtatattactgtgtgaaaggcgtgggagtggggactacgtggggccagggaaccctggcaccgtctcctcagcctccaccgaggcccagtccggtcttcccccgtgcctaccctcctccaacgacgccacccgtcgtcggggaccaccgacgccggcccgtgggccttcgcccgttacgggttccaaacgggtaccttaacccgtttccaacgttcccttaacccgtaccgttaacccgttcggaacggttcccggggaccgtttcgggacccgaaacgggcccgacgaacgttaggcctg

SEQ ID NO: 223319 - DNA, 633 bp, Homo sapiens
  misc_feature: GYAE6OF02HBU3R.37.25.C03.1.454.CMB.1.raw
  modified_base (211)..(211): a, c, t, g, unknown or other
  misc_feature (211)..(211): n is a, c, g, or t
  modified_base (316)..(316): a, c, t, g, unknown or other
  misc_feature (316)..(316): n is a, c, g, or t
  modified_base (364)..(364): a, c, t, g, unknown or other
  misc_feature (364)..(364): n is a, c, g, or t
  modified_base (395)..(395): a, c, t, g, unknown or other
  misc_feature (395)..(395): n is a, c, g, or t
tcagtagtgtagatcacgaccggtgctcgatttagtagtgtagatttgggtttgggggaggcttggtacagcctggggggtccctgagactctcctgtgcagcctctggtttcatctttagcaactacgccatgagctgggtccgccaggctccgaggggaaggggctgggagtgggtctcgaggttattacgtggtagtggtaataccgnatactacgcagactcgtgacgggccgttcaccgtctccagagacaattccaagaatacggtctatctaggaaatgaacagcctgagagccgaggacacggccctntattactgtgcgagagatcagacggatatagcagcagctctgactcgngggccacggaccctgtaccaccgtctcctcncgcctccaaccgacggccctagtcccggtcccttccccgtcgggcccgtccccgtcgtccgtacccgacggaccgcccgaacccgtaccggacgacgccgaccgacgggtcccgggcccgtcgggtccgtcggtcccgtacggtacgaaccggttaccttaccgttccgtaacttccctaacctaaccgttacctgggaccggtccggggtctacgggtaaccggacgggccgtaacg

SEQ ID NO: 223320 - DNA, 585 bp, Homo sapiens
  misc_feature: GYAE6OF02F7QYE.37.25.C03.1.454.CMB.1.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (386)..(386): a, c, t, g, unknown or other
  misc_feature (386)..(386): n is a, c, g, or t
  modified_base (421)..(421): a, c, t, g, unknown or other
  misc_feature (421)..(421): n is a, c, g, or t
  modified_base (539)..(539): a, c, t, g, unknown or other
  misc_feature (539)..(539): n is a, c, g, or t
  modified_base (584)..(584): a, c, t, g, unknown or other
  misc_feature (584)..(584): n is a, c, g, or t
tcagtagtgtagatcacgaccggtgctcgatttagtagtgtagatttgggtttgggggaggcctggtgcagcctgggggtccctgagactctcctgtgcagcctctggattaatgtttagcaactctggcatgaactgggtccgccaggctccaggcatggggctgcagtgggtctcaagtactagtgctcctggtaatagagcaagactacgcagacctccgngaagggccgttcacatcncagagacatccaagaacngctctatctgacaaatgaacagcctagagagccgaagacacggaccgtatacttactgtgtagaaaggcgtggggagtgggggactacggtggggccaaggggtaccctggtccacgtcctcctcncgcctccacgaacggccagtccgtccgttccccgngcctacccgtcctaccgacgacgcaccttcggacgggcctacgacgggcccggtccgtacggtccgtcgtccgtcggtacgaaacgtacttaccttacgacttcctaactacgtacgnggacggtccggtcgtacggtaccggaacggccgtacgagttacgnc

SEQ ID NO: 223321 - DNA, 629 bp, Homo sapiens
  misc_feature: GYAE6OF02I8MOK.37.25.C03.1.454.CMB.1.raw
  modified_base (242)..(242): a, c, t, g, unknown or other
  misc_feature (242)..(242): n is a, c, g, or t
  modified_base (400)..(400): a, c, t, g, unknown or other
  misc_feature (400)..(400): n is a, c, g, or t
tcagtagtgtagatcacgaccggtgctcgatttagtagtgtagatttgggtttgggggaggcttggtacagcctggggggtccctgagactctcctgtgcagcctctgggtttcatctttagcaactacgccatgagctgggtccgccaggctccagggaaggggctggagtgggtctcaggtattactggtagtggtaataccgcatactacgcagactccgtgacgggcggttcaccgtnccagagacattccaagaatacggtctatctggaaatgaacagcctgagagcccgaggacacggccctatagttattgtgacgaaatgggtggggggagtgggggctactcgttgggtcgttttgactacgtggggccagggagcctggtcgacgttcncctcgacgccctccgacccgaacgggcccctagttccggttccctttccccccgtcgggccgcccgttcgccttccgacgggacgaccaccgtcccgaacgtacgccaacgacggccggcccgtgggcctggcccttgggtccgtaaaggtaccttacttaccgtatcctactacgttaacgtcggaacggccgggtcgacgggtcgaagggccgtacaacgtagctag

SEQ ID NO: 223322 - DNA, 189 bp, Homo sapiens
  misc_feature: GYAE6OF02I4WJO.37.25.C03.1.454.CMB.1.raw
  modified_base (176)..(189): a, c, t, g, unknown or other
  misc_feature (176)..(189): n is a, c, g, or t
tcagtagtgtagatcacgaccggtgctcgatttagtagtgtagatttgggtttgggggggaagaggaagactgacggtccccccaggagttcaggtgctgggcacagcggccctgggctgcctggtcaaggactacttccatctacactactgagcgggctggcaaggcgcatagnnnnnnnnnnnnnn

SEQ ID NO: 223323 - DNA, 633 bp, Homo sapiens
  misc_feature: GYAE6OF02GMELD.37.25.C03.1.454.CMB.1.raw
  modified_base (203)..(203): a, c, t, g, unknown or other
  misc_feature (203)..(203): n is a, c, g, or t
  modified_base (630)..(630): a, c, t, g, unknown or other
  misc_feature (630)..(630): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctctggtaatagngcagactacgcagactccgtgaacgggccgtcacatctcagagacaataccaagaacacgctactatctagacaaaatgaacagctagagacgaccgaaagacacggacctatattactgtagtagaaaggcgtggggagtggggacttacgtcggggacaacgggtaaccctggtacaccgtctccctcacgtccctaccgaaccgaacgggccctaacgtccggtaccttcccccgtgtaccaccccttccaaccgaacgaacgtcctacccgtcggtacggggaccacgaccggccgggtccctcggggctacggtccgtacggtacgtaaacgtacctaccgttaccacgttactaacctaccttaaccgtacggacggtcccgggtagtacgggacgtaacgggccgtaacgtacttacggnacg

SEQ ID NO: 223324 - DNA, 754 bp, Homo sapiens
  misc_feature: GYAE6OF02HT3YC.37.25.C03.1.454.CMB.1.raw
  modified_base (145)..(145): a, c, t, g, unknown or other
  misc_feature (145)..(145): n is a, c, g, or t
  modified_base (750)..(750): a, c, t, g, unknown or other
  misc_feature (750)..(750): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccnccaggctccaggcagtggggctgcagtgggtctcaagtactagtgctcctaggtaatagagcagactacgcagactccgtaggaacgggtccgttcacccattccaccgagacgaacaattaccaaagaacaccgtctctaatctagacaaatcgaacagcctagagacgaccgaagacgacggtcgtatacttactgtagtagaaaggcgtaggggaggtaggggtactacggtcggggaccgtaacgggaacccgttcggtaccgtaccggttccctaccgtaccgaccgtacccgtacccgaaacccggtaaccgggtccctaacgggttccccggttaccccttcccccggtacgggtaccccaaccccgttcccgtaaccgaacaccggtaccgtacccgtcggggtaccggggaccaacggtccgggacccgggtcccgggttacgggtcccgtaccggtacccggtacggggttaacccgtaaacgggtacctttaacccttaccgtaaccttaccgtaacccgtaaccggtttaacggacgggacgggtccccgggtaggtaccggaaccggtacgggcccgtaacggtacgtacgnaacg

SEQ ID NO: 223325 - DNA, 249 bp, Homo sapiens
  misc_feature: GYAE6OF02HK92E.37.25.C03.1.454.CMB.1.raw
  modified_base (233)..(249): a, c, t, g, unknown or other
  misc_feature (233)..(249): n is a, c, g, or t
tcagtagtgtagatcacgaccggtgctcgatttagtagtgtagatttggggttggggggactactggggccagggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcagtagnnnnnnnnnnnnnnnnn

SEQ ID NO: 223326 - DNA, 672 bp, Homo sapiens
  misc_feature: GYAE6OF02IA3IA.37.25.C03.1.454.CMB.1.raw
  modified_base (575)..(575): a, c, t, g, unknown or other
  misc_feature (575)..(575): n is a, c, g, or t
  modified_base (627)..(627): a, c, t, g, unknown or other
  misc_feature (627)..(627): n is a, c, g, or t
  modified_base (652)..(656): a, c, t, g, unknown or other
  misc_feature (652)..(656): n is a, c, g, or t
  modified_base (658)..(659): a, c, t, g, unknown or other
  misc_feature (658)..(659): n is a, c, g, or t
  modified_base (661)..(669): a, c, t, g, unknown or other
  misc_feature (661)..(669): n is a, c, g, or t
  modified_base (671)..(672): a, c, t, g, unknown or other
  misc_feature (671)..(672): n is a, c, g, or t
tcagtagtgtagatcacgaccggtgctcgatttagtagtgtagatttgggtttgggctcaactctcttgtccgccaggctccaggcatggggctgcagtggtctcaagtactagtgctcctggtaatagagcagactacgcagactccgtgaagggccggttcaccatctccagacgactaattccgaaggaaccacgctactatcctgacaaagtcaaacagcctgaacgacgccgtaaagaccgaaccggccgttaatacttacgtggtacggtaggtaaacggtcggtagggggacggtacggggggaaccttacgggtccgggggacggtaaaccggggtaacccgttcgggtacctaccggttccctcccgtacgacgttccccacccgtaaccggaacgggcccctagttccgggttccccttccccgtcggacctaccccgtacctaccgtaaacgccgactaccggtcggtacggggaccacgacgggtcccggtcccgtacgggtctcggacgttcggtacgaaacggtaccttaccttacgtacgtacccttacgaacgttaccngggaccgggtccggtacggttacggcggaaacgggtccgacgaacgttaggntagacgtgcgactagccagtcgacnnnnngnntnnnnnnnnncnn

SEQ ID NO: 223327 - DNA, 625 bp, Homo sapiens
  misc_feature: GYAE6OF02GSRES.37.25.C03.1.454.CMB.1.raw
  modified_base (531)..(531): a, c, t, g, unknown or other
  misc_feature (531)..(531): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (601)..(601): a, c, t, g, unknown or other
  misc_feature (601)..(601): n is a, c, g, or t
  modified_base (617)..(617): a, c, t, g, unknown or other
  misc_feature (617)..(617): n is a, c, g, or t
  modified_base (622)..(622): a, c, t, g, unknown or other
  misc_feature (622)..(622): n is a, c, g, or t
tcagtagtgtagatcacgaccggtgctcgatttagtagtgtagatttgggtttgggcgtcaactctcttgtccgccaggctccaggcactgggggcttgcagtgggtctcaagtactagtgctcctggtaatagagcagactacgcagactccgtgaagggtccggttcacgattctccgagagacaattccgaaagaacacgctctagtctgcaaaagtgaaacacgtcctgacgagccgaagacacggtaccgtatattaactgtcgtagaaacggtcgtaggggtagtggggggtaactaacgtcggggaccaggggtaaccctcggtacaccgttccgtcctcgacgaccctacccgaaccgaacggcccgtaacgtcggttccccttaccccgtgggaccctacccgttcctacccgaaagaccgtactaccgtcgtcggggacacgcggaccggccgtcgggtcctggccgttacggtacgaacggtacttaccttcgactactacacctacgtgacgcgggacnggacgtacgcgagactagctgacncgngancgatcgtacgcagcggtactagagacgacagtaccgtagngccgtacgtgaacggntacgngac

SEQ ID NO: 223328 - DNA, 718 bp, Homo sapiens
  misc_feature: GYAE6OF02HT9GI.37.25.C03.1.454.CMB.1.raw
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (338)..(338): a, c, t, g, unknown or other
  misc_feature (338)..(338): n is a, c, g, or t
  modified_base (349)..(349): a, c, t, g, unknown or other
  misc_feature (349)..(349): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtccgccaggctccaggcatggggctgcagtgggtctcaagtctagtgctcctggtaatagagcagactacgcagactccgnggacgggtccggttcaaccatcctccagagacaattccaaanacacgctactanctgacaaatcgaacngcctagacggaacgaccgaagaccgaccggtacgtatattactggngtagaaacggngtaggggtggtacggggaccttacggtggggacccgtaggggtaacccctgggtaccacccggtccgtaccctcgtaccgcccttacccgaacccgtaaccgggaccctacggttcccggttacccccttcccccgtaggccccttacccccgtacccctacccaacggtaccgtaccccgtaccggttccggacgggggtaccaaccggaccggggcccggtaccccgggtgggcccgttacgcccggtagggttaccgaacggtacccttacctacccgttactaccgttaaccgaccgtaccgtaacgggacggtacccgggtacctacgggacggaaccggtcccggtaacttagacggtcacgg

SEQ ID NO: 223329 - DNA, 193 bp, Homo sapiens
  misc_feature: GYAE6OF02GM078.37.25.C03.1.454.CMB.1.raw
  modified_base (176)..(193): a, c, t, g, unknown or other
  misc_feature (176)..(193): n is a, c, g, or t
tcagtagtgtagatcacgaccggtgctcgatttagtagtgtagatttgggtttgggggggaagaggaagactgacggtccccccaggagttcaggtgctgggcacagcggccctgggctgcctggtcaaggactacttccatctacactactgagcgggctggcaaggcgcatagnnnnnnnnnnnnnnnnnn

SEQ ID NO: 223330 - DNA, 197 bp, Homo sapiens
  misc_feature: GYAE6OF02F3XXA.37.25.C03.1.454.CMB.1.raw
  modified_base (178)..(197): a, c, t, g, unknown or other
  misc_feature (178)..(197): n is a, c, g, or t
tcagtagtgtagatcacgaccggtgctcgatttagtagtgtagatttgggtttggggggggaagaggaagactgacggtccccccaggagttcaggtgctgggcacagcggccctgggctgcctggtcaaggactacttccatctacactactgagcgggctggcaaggtcgcatagnnnnnnnnnnnnnnnnnnnn

SEQ ID NO: 223331 - DNA, 481 bp, Homo sapiens
  misc_feature: GYAE6OF02INZ12.37.25.C03.1.454.CMB.1.raw
  modified_base (407)..(407): a, c, t, g, unknown or other
  misc_feature (407)..(407): n is a, c, g, or t
  modified_base (427)..(481): a, c, t, g, unknown or other
  misc_feature (427)..(481): n is a, c, g, or t
tcagtagtgtagatcacgaccggtgctcgatttagtagtgtagattttgggtttgggattcacgttgcagactccgtgaagggccggttcaccatctccagagacaattccaagaaacacgctctatctgcaaaatgaacagcctgagagccgaagacacggccgtatattactgtgtgaaaggctggggagtggggggactagtggggccagggaaccctggtcaccgtctcctcacgcctccaaccaaacgggcccaatccggtccttcccccgtggccacccctccctccgaaagacgcaacctcgtcggggggcaacacggcggaccctgggcgtcgcccgtggtacgaaaggaccttaccgttccaagtctaaccgacctaccgtggacgcggggtctcggnaacggacggacgaatagtannnnnnnnnnnnnnnnnnnnnnnnnnnnnnnnnnnnnnnnnnnnnnnnnnnnnnn

SEQ ID NO: 223332 - DNA, 747 bp, Homo sapiens
  misc_feature: GYAE6OF02IROT6.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgcaggctccgggcagtgggggctgcagtgggtctcaagtactagtgctctggtaatagagcgagactacgcacgactccgtggaagggccggttcacatctcagagaacattccaagaacacgctctatctacgacaaatgaaactacgccgttacggaggaacgaccggaaaggaccaccgggacgttagtaacttacgttacggtgtagaaacgggtgtcgggggtaggtacggggggtactaacgggtcggggaaccgacggggtaacccgttgggtcctaccggtctacccgtcaccggaccctacccgaaccggaacgggtcccctacggtacccggttccccgtttcccccgtacgggtccccggtcccgtcgtcccggtaacccgcgggtaaccgccgtaacccggttccggacgtaacggcccgaaccgggacggtccccgggtacccgggttcgggtccgttaccgggttaccggtccgggtttaaccggaaacgggtaacccttacccggttaccgtaccgttaccgtaccgtaaccgtaacgttcggtaaccgggcgggtacggtcgggaccgtacggcgacgtatacggcg

SEQ ID NO: 223333 - DNA, 243 bp, Homo sapiens
  misc_feature: GYAE6OF02I8WK1.37.25.C03.1.454.CMB.1.raw
  modified_base (234)..(243): a, c, t, g, unknown or other
  misc_feature (234)..(243): n is a, c, g, or t
tcagtagtgtagatcacgaccggtgctcgatttagtagtgtagatttgggtttggggtgactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaagggcgcatagnnnnnnnnnn

SEQ ID NO: 223334 - DNA, 629 bp, Homo sapiens
  misc_feature: GYAE6OF02GJBGB.37.25.C03.1.454.CMB.1.raw
  modified_base (196)..(196): a, c, t, g, unknown or other
  misc_feature (196)..(196): n is a, c, g, or t
  modified_base (585)..(586): a, c, t, g, unknown or other
  misc_feature (585)..(586): n is a, c, g, or t
  modified_base (588)..(589): a, c, t, g, unknown or other
  misc_feature (588)..(589): n is a, c, g, or t
  modified_base (591)..(629): a, c, t, g, unknown or other
  misc_feature (591)..(629): n is a, c, g, or t
tcagtagtgtagatcacgaccggtgctcgatttagtagtgtagatttgggtttggggattcacgttgcagactccgtgaagggccggttcaccatctccagagacaattccaagaacaccctgtctctgcaaatgaacaacctgagagccgaggacacggccctatattactgtaacgaaaatggcctacggatangatactagttgggactggtacttcgatctcgtggggccgtggccacccgtggtcacgttcgtcctcctcacgtccctacccaaccgaacggggcccccaagttccgggttcccctttaccccccgtgggtcccgtcccccgttcgccccttaccgaacgggcgaccctaacccccgtccggaggaccgaccgtacgaaccggggtccccgggcccccggtagggggtccttacgggtcccggttacggggtaaccgaaacgggttaaccccttaacccgtttacctaaccttaaccgtaacccgttaacccttaacggtacgggaacggggtccggggtacgtacgggaaccgtaaacgggcgtaccgaaagttggcagacgtgacgtnngnnannnnnnnnnnnnnnnnnnnnnnnnnnnnnnnnnnnnnnn

SEQ ID NO: 223335 - DNA, 832 bp, Homo sapiens
  misc_feature: GYAE6OF02I310B.37.25.C03.1.454.CMB.1.raw
  modified_base (832)..(832): a, c, t, g, unknown or other
  misc_feature (832)..(832): n is a, c, g, or t
tcagtagtgtagatcacgaccggtgctcgatttagtagtgtagatttgggtttggggggggggcctggtgcagcctgggggggtccctgagactctcctgtgcagcctctggattaatgtttagcaactctggcatgaacgtcggggtccgccagggctccaggcagtggggctgcaggtgggttctcaagtactaggtgcctcgtaggtaatgagcagactacgcaacgtacctccggaggaacggggtccgttaccactactcctaccgagacgaccaattacccaaagaaccacgccttaccttactacttcgaactaaatcgaacgacggtacctagaacggacgaccggaacggtaccgaaccggtcgtaattaacgttacgttggtcggtaggaaagggtcggtagggggacgggtacggggggtacgttcgggtacgggggacccggtaacggggtaacccgttcgggtacctaacccggttccgtaccgtccggtacccgtcccgtaccccggaacccgtaaccggggccccttaacgggttccccgggtttacccccttccccccggtacccgggtaccccctacccccgttaccgttaacccgaaacggtacccggacccgttaccgggttcccggggacccgggggtaccaacccgggtaacccggggcccgggttaccccgggttcggggtccctccgggtacccggttaccggtacgggtaaaccgtacccgtttacccctttacgaacctttactaccctacgttaccggtggaccggtccgggtctaccggaaggtcgaccgtaggaacgtgtcgan

SEQ ID NO: 223336 - DNA, 551 bp, Homo sapiens
  misc_feature: GYAE6OF02I8NUS.37.25.C03.1.454.CMB.1.raw
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (529)..(529): a, c, t, g, unknown or other
  misc_feature (529)..(529): n is a, c, g, or t
  modified_base (531)..(551): a, c, t, g, unknown or other
  misc_feature (531)..(551): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgacaaatgaacagcctgagagccgaaagaccacggccgtatattactgtgtagaaaggcgtggggagtgggggactacgtcgggccgacgggaaccgtggcctaccgtctccgtcacgcctaccaccgaacggcccacgtcgtcccttcccctcgccaccctcctaccgaacgacgccaccgtcgtcggggcacgacggccggcccgtcgggcgtcgccgtcggtaccgaaggtaccttaccttcctactacctaaccgtacctacgtcggtacggccggtcgtacgggacgaacgggtccgacgtaacgtcgacncgangngnncncnnnnnnnnnnnnnnnnnnnnn

SEQ ID NO: 223337 - DNA, 633 bp, Homo sapiens
  misc_feature: GYAE6OF02F2V2U.37.25.C03.1.454.CMB.1.raw
  modified_base (205)..(205): a, c, t, g, unknown or other
  misc_feature (205)..(205): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactattgctcctggtaatagancaagactacgcagactcgtggaacgggccgttcaccatcctcagagacaattccaaagaacacgctctatctagacaaatgaacagcctgagacgccgaagaccgacggccgtaatacttactgtggtagaaaggcgtaggggagtacgggggaactacggtcggggaccgaacgggtaacccctgggtaccgaccgttccgtccttacgcgtccctacccgaaccggaaccgggcctacgttcccggttcccttccccgtcggaccctacccgtccaccgaacggacgcctaccgtcggtacggggcacgacgccgggacccgtgggcctcgtaccgtcggtacgaacgtaccttaccgacctactacctacaccgtacgacggacgggtcggtaccggtggaccgacggaccgtacgagtacgcta

SEQ ID NO: 223338 - DNA, 614 bp, Homo sapiens
  misc_feature: GYAE6OF02HDJSO.37.25.C03.1.454.CMB.1.raw
  modified_base (567)..(567): a, c, t, g, unknown or other
  misc_feature (567)..(567): n is a, c, g, or t
  modified_base (606)..(606): a, c, t, g, unknown or other
  misc_feature (606)..(606): n is a, c, g, or t
  modified_base (612)..(612): a, c, t, g, unknown or other
  misc_feature (612)..(612): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcaggtggtctcaagtactagtgctccgtggtaatagagcagactacgcagactccggtagaacgggtccgttacaccatcctcagagactaattccgaagaacacgctactatctgactaaagtgaacacgcctagagagaccgaagacgacggcgtatattacgtgtgtaggaaaggtcgtaggggaggtacgggggaacgtacggtacggggaccgaacggggtaaccgtcggtaccacccgttactcccgtacgacgtccctaccgaaccgacggtacccacgttccggttacccttccccgtgaccctacccctccgtaccgaacgacgcctacgtcggacggggccacgacggtaccgccgtacggcgtcgcgttgaccgacgtactacttccnctactacgacgtacgcgacggcggacgtagcggacgcgngtatgntc

SEQ ID NO: 223339 - DNA, 829 bp, Homo sapiens
  misc_feature: GYAE6OF02HPRXL.37.25.C03.1.454.CMB.1.raw
  modified_base (826)..(826): a, c, t, g, unknown or other
  misc_feature (826)..(826): n is a, c, g, or t
tcagtagtgtagatcacgaccggtgctcgatttagtagtgtagatttgggtttggggaggcctggtgcagcctggggggtccctgagactctcctgtgcagcctctggattaatgtttagcaactctggcatgaactgggtccgccaggctccaggcagtggggctacgagtggtctcaagtacagtgctccgtagtaatagagcgagactaacgcgtaagccttaccggtaggaagggtcccgtttacgaacctacttccgtaccaggaaccgtaactaaactttacccgaaagtaaccgaccgtaccgtacttaacgtcgttacgaactaaaacgtcgaaaccgtaggaccctaggacgaacggaccggaaaacggtaccgtaaccggggtacctttaacgttaacgttaccgtttaggttagtaacggggtaaagggtccgggttaaggggacgggttacggggggtacctacgggtcggggtacccgaaccggggtaacccgtcgggttacctacccggtccttacccgtacgaccgtaccccgtacccaacccgggacccgggtccttaaccggttcccggtttccccgttccccccgtacggtaccccgtacccgtaccccgtaaccgaacggaccgtaccgtaccgtacgggtacgggacctaccggacggccggtccggtacggtccgtcgtacccggtggtaccgtaaaccggtacctttaacgtacccgtacggttaccttacgaccggttaccggaggacccggtacgggacgttaccgggaccgttaacgggaccgtacgacggttagaccgtnacg

SEQ ID NO: 223340 - DNA, 828 bp, Homo sapiens
  misc_feature: GYAE6OF02IY4FA.37.25.C03.1.454.CMB.1.raw
  modified_base (189)..(189): a, c, t, g, unknown or other
  misc_feature (189)..(189): n is a, c, g, or t
  modified_base (254)..(254): a, c, t, g, unknown or other
  misc_feature (254)..(254): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgcaggctccaggcagtggggctgcagtgggtctcaagtactagtnctcctaggtaatagagcagacacgcagactccgtaggaacgggtccgttcaccatcctacgaganaactaacttccaaacgaacacgactactatcctgactaaagtagaaccaggtccgtagaggaaccggaccggaaacgaaccgaaccgggtccgttaactttaactttaaccgtgttaacgggtaaggaaaacgggtccggttaggggggacgggttacggggggtaaccgttaaccgggtacggggggaacccgaaccgggggtaaccccgttcgggtacccgtaaccccggttccctttcccgtaccgacccggtccctacccgaacccggtaaccgggacccctaaccgggttccccggtttaccccgtttccccccggtcggaccccgttaccccctacccgtaacccgtaaaacggccgtacccgtaccccgggttcccgggagggggtacccaaccggacccgggcccgggtaccccgtcgggggtaccctccggggtacccgttaccggtaacgtaaccggtaacccgttaccgttacccacggttaccctaccgtaccgttaacgttaccgggacggttacccgggaccggtacggaccggaacgggtccgaacgtacgtacgcacg

SEQ ID NO: 223341 - DNA, 935 bp, Homo sapiens
  misc_feature: GYAE6OF02GQFFX.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgacgtggccgcaggctcgagcaggtgggctgacgtaggtcggtactacgaagtacgtagtcgccttcgtagtaatagacgacgagaccacgacgagtaccgttccggaggaaccgggttccgttaccaacgtactcctaccgaggtaacgaactaacttaaccgaaagaaaccgaccgtactactaactcgtacgtaacctaaagtaacgaaccgtacgtacccgtaaggaacggaaccggaaccggaaacggaacccggtaacccgggtaaaccggtttaaacttaaccgtttaaacggttagggttaacggttaacgggtaaacgggtacggggttaacgggggtaacgggttaacggggggtaaaccgttaacgggggtacccgggggaacccggttaaaaccggggtaaccccggttaacgggttaacccgtacccgggttacctaacccgttaccggtaacccggtaccccgtaaacccggtaaacccgggtaacccggtaaccccggttaaacggttccccccgggtttaaccccgtttaccccccggtaaccgtacccccgtaacccgttaccccggtaaacccgtaaaccggtaacccgggttaacccgtacccgggttacggggtaaccgggtaaccgtaaacccgggtaccggtacccgggtcccggtacgggttacccgtaccggttccggtacggtaaccgtaaccggtaccttaaccgtaccgtaacgttaccgtaactacggtacgtacgacggtcggtacgacggtacgtagacgacgtgagctacg

SEQ ID NO: 223342 - DNA, 678 bp, Homo sapiens
  misc_feature: GYAE6OF02F1Y0F.37.25.C03.1.454.CMB.1.raw
  modified_base (629)..(629): a, c, t, g, unknown or other
  misc_feature (629)..(629): n is a, c, g, or t
  modified_base (637)..(637): a, c, t, g, unknown or other
  misc_feature (637)..(637): n is a, c, g, or t
  modified_base (639)..(640): a, c, t, g, unknown or other
  misc_feature (639)..(640): n is a, c, g, or t
  modified_base (642)..(642): a, c, t, g, unknown or other
  misc_feature (642)..(642): n is a, c, g, or t
  modified_base (649)..(649): a, c, t, g, unknown or other
  misc_feature (649)..(649): n is a, c, g, or t
  modified_base (654)..(654): a, c, t, g, unknown or other
  misc_feature (654)..(654): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
tcagtagtgtagatcacgaccggtgctcgatttagtagtgtagattttgggtttgggctcaactctcttgtccgccaggctccaggcatggggctgcagtgggtctcaagtactagtgctctggtaatagagcagactagcagactcgtgaagggccgttcaccatctccagagacaattccaaagaacacgctctatctgacaaatgaaacagcctgagacgaccgaaagaccacggtacctatactttactggtgtagaaacggcgtaggggagtagggggaactacgtggggccgaacgggaacccgtggtaccaccgtctcctcgacgcctacccgaaccgaacgggcccacgtccggtcctttcccccgtcggccctaaccctccgtaccaaacgaccgcctaacccggtccggtcgggggacctaacggaacggcccgggtacccggtcggggtaccgttccggtcccgtacgggtaccgtaaacggtaccttaacccgttaccgtacttacccgttaaaccgaaaccgtttacgtacgggtaaccgggccggggtacggtacgggaaccggtaacgggtacccggaaacgtaacgttaacggcgtgacgcgacgtcaagccncgtcgagngnngngacgtcncacgnctacgctcgntnacgtcgtagtcg

SEQ ID NO: 223343 - DNA, 740 bp, Homo sapiens
  misc_feature: GYAE6OF02IJGMO.37.25.C03.1.454.CMB.1.raw
  modified_base (148)..(148): a, c, t, g, unknown or other
  misc_feature (148)..(148): n is a, c, g, or t
  modified_base (720)..(720): a, c, t, g, unknown or other
  misc_feature (720)..(720): n is a, c, g, or t
tcagtagtgtagatcacgaccggtgctcgatttagtagtgtagattttgggtttgggggaggcctggtgcagcctggggggtccctgagactctcctgtgcagcctctggattaatgtttagcaactctggcatggaacgtgggtccnccaggcctccaggacagtggggctagcaggttgggtctaccaaaggtactaaggttcgcctaccgtaggttaaataggaagcaggacttaacgcaagtactccggtaggaacgggtccgttacaaccgatccgtcaaggacaacttaacttaccaaacgaaactacgacttacgtactaccgtagaactaaagtagaaccagtacccgtgaacgacgacgaagaccacgtaccgtaatatacgtgagtaggaaaggtcgtagggaggtacggggtacttacggacggggacgaacgggaacctcggtaccaaccggttcttccacaccgtacctaccgaaccgaaaccggcccgtacgtacccggttaccccgttccccgtacggtacccgttacccttcccgtaaccggtaacgaaccgacccgtaacccgtcgggtacggggaccaaaccggccggacggtttaccccggcggggtactacggtcccggacggtaaacgaaccggtaccttaaccgttacccaggttaccaaccgtaacgtcggtacgaccggtcggcgtacggaaccgngaccgtacgacgtagcgtag

SEQ ID NO: 223344 - DNA, 455 bp, Homo sapiens
  misc_feature: GYAE6OF02H2XK6.37.25.C03.1.454.CMB.1.raw
  modified_base (235)..(235): a, c, t, g, unknown or other
  misc_feature (235)..(235): n is a, c, g, or t
  modified_base (305)..(305): a, c, t, g, unknown or other
  misc_feature (305)..(305): n is a, c, g, or t
  modified_base (423)..(455): a, c, t, g, unknown or other
  misc_feature (423)..(455): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggcgtatattactgtgtgaaaggctggggagtggggggactacgtggggccacgggaaccctggtcaccgtcctcctnacgccctccaccgaacgggccctacgtccggtccttccccccgtcggcccacccctccctaccaaggacncctacctcggtcgggggcaccgagccggcccgtgggcctcggcctggtaccaaggtaccttaacttccactaccgttaacactacgtggacggcgggcgtcggacgaagccgcatagnnnnnnnnnnnnnnnnnnnnnnnnnnnnnnnnn

SEQ ID NO: 223345 - DNA, 192 bp, Homo sapiens
  misc_feature: GYAE6OF02IA2NN.37.25.C03.1.454.CMB.1.raw
  modified_base (177)..(192): a, c, t, g, unknown or other
  misc_feature (177)..(192): n is a, c, g, or t
tcagtagtgtagatcacgaccggtgctcgatttagtagtgtagatttggggtttggggggggaagaggaagactgacggtccccccaggagttcaggtgctggcacagcggccctgggctgcctggtcaaggactacttccatctacactactgagcgggctggcaaggcgcatagnnnnnnnnnnnnnnnn

SEQ ID NO: 223346 - DNA, 896 bp, Homo sapiens
  misc_feature: GYAE6OF02GSTHY.37.25.C03.1.454.CMB.1.raw
tcagtagtgtagatcacgaccggtgctcgatttagtagtgtagatttgggtttgggcgtgagctggctttttcttgtggctattttaaaaggttccagtgtgagtgcagttgttggagtctggggaggcctggtgcagccgtggggggtccctgagactctcctgtcgcagcctctggaattatgtttagcaactctggacagtagaacgtgggtacccaccgaggcctccgaggcagtcggggctgctaggtcggtcctagaagtacgtgtcgccttcgtaggtaataggacgtacagactacgacagtaacccgttccggtaggaaccggggtcccgttaccaacctaccgttccaccgaagtaaccgtaaccgtaaacgttacccgaaaaggtaacccaccggtacttaccttaacgttccgtaagaaccgaaaacgtcgaaacctaaccggtcccgtaggaacgaacggaacccgtaaagaaccccggtagggtaccctttaacgttagttaaccgttaggttacggttaaacgggaaacgggtcgggttaaacggggggtaacggggtttaccgggggggtaaccttaaccggggtaccgggggtaacccccgggttaaaccggggttaaacccccggtcgggtttaacccgtacccgttacccggttacccgttaaccggtaccgtccccccgttaacccggaaaccccggtaccgggtaccccgttacgggttccccggttaccccgttaccccgggttccgtaccccgtaacccccgttcccgtaaacccgggaaccgtacccggtaccccgtaacccggttcccgggtaccggggtaccctaaccgggaccggtccccggtaacccgggtcggtccgttaccccggg

SEQ ID NO: 223347 - DNA, 579 bp, Homo sapiens
  misc_feature: GYAE6OF02FQI32.37.25.C03.1.454.CMB.1.raw
  modified_base (578)..(578): a, c, t, g, unknown or other
  misc_feature (578)..(578): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactggggtccgccaggctccaggcatggggctgcagtgggtctcaagtactagtgctctggtaatagagcagactacgcagactccgtgaagggtccgttcacatctcagagacattccaagaacacgctctatctgcaaatgaacagcctgagagccgaagacacggccgtatacttactgtgtagaaaggcgtggggagtgggggactacgtggggccaggggtaaccctggtaccaccgtctcctcgacgtcctccaccgaacggcccagtccggtccttccccctggcctaccctcctcccaagtcgcctacccgtcgtcggggacacgacggccggcccgtgggctcgccgtcggtacgaacgtacctacttccgaacttcctacctaccgtactacggcggtaccgggtctacgggacgacgggccacgacgtacgnc

SEQ ID NO: 223348 - DNA, 569 bp, Homo sapiens
  misc_feature: GYAE6OF02FOZ1G.37.25.C03.1.454.CMB.1.raw
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
  modified_base (562)..(562): a, c, t, g, unknown or other
  misc_feature (562)..(562): n is a, c, g, or t
  modified_base (566)..(566): a, c, t, g, unknown or other
  misc_feature (566)..(566): n is a, c, g, or t
tcagtagtgtagatcacgaccggtgctcgatttagtagtgtagatttgggtttgggctcaactctcttgtccgccaggctccaggcatgggggctgcagtgggtctcaagtactagtgctcctggtaatagagcagactacgcagactccggtgaagggccggttcaccatctccagagacaattccaaagaatacggtctatctggaaatgaacagcctgagacgccgaggacaccggccctgtattactgtgcgagagatcagacggagtatagcagcagctctgactacgtcgggccgtacggaacccgtcggtcaccgtctcctcacgcctccaccgaaggccactcggtccttccccgtcgccaccctccgtaccacgaacgccaccgcgtttacggggcacgagccggccgtcgggcgtcgccgtcgtacgaacgtactacttaccacttctaacctaccgtactacgacggtcgggtacgtacggacgaacggtaccggtaacgtagtaagtcagcgtagacagcgtatcgntacgngagtacncctagctaccngtanacg

SEQ ID NO: 223349 - DNA, 770 bp, Homo sapiens
  misc_feature: GYAE6OF02JEVHQ.37.25.C03.1.454.CMB.1.raw
  modified_base (213)..(213): a, c, t, g, unknown or other
  misc_feature (213)..(213): n is a, c, g, or t
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagcctgggggtccctgagactctcctgtgcagcctctggattaatgtttagcaactctggcatgaactgggtccnccaggctccgagcagtggggctgcagtggtctcaagttactagtgcctaccgtaggtaataggagtcagacctacgcagtacctccggtagaacggggtcccggttcaccgtactccgtacgaagacgtaacctaacttaccgaaaacgaaccacgtactcctatccgttacgaacgtaaaatcggaaacaccggtaccttacggaacgaccggtaacccggaaaggtaacccgacccgggaaccgtttaagttacttaccgttggtacggtaacggaaacgggtaccgggtagggggtacgggttacgggggtacctaacgggtcggggaccggtaccgggaacccgttcgggtacctaccggtcccttaccgacgtaccggtaccctacccgaaccgtaaccgggtcccgtacgttccccggttaccccgtttaccccgacggtaccccctaccccgttacccgtaaccgtaacggacccgtccgtaaccccggtccggttacgggggtacccaccgggtacccggcccggtacccggtcggggcccttaccggg

SEQ ID NO: 223350 - DNA, 683 bp, Homo sapiens
  misc_feature: GYAE6OF02HCAE1.37.25.C03.1.454.CMB.1.raw
  modified_base (122)..(122): a, c, t, g, unknown or other
  misc_feature (122)..(122): n is a, c, g, or t
  modified_base (128)..(128): a, c, t, g, unknown or other
  misc_feature (128)..(128): n is a, c, g, or t
  modified_base (190)..(190): a, c, t, g, unknown or other
  misc_feature (190)..(190): n is a, c, g, or t
  modified_base (229)..(229): a, c, t, g, unknown or other
  misc_feature (229)..(229): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (468)..(468): a, c, t, g, unknown or other
  misc_feature (468)..(468): n is a, c, g, or t
  modified_base (639)..(639): a, c, t, g, unknown or other
  misc_feature (639)..(639): n is a, c, g, or t
  modified_base (659)..(659): a, c, t, g, unknown or other
  misc_feature (659)..(659): n is a, c, g, or t
  modified_base (680)..(680): a, c, t, g, unknown or other
  misc_feature (680)..(680): n is a, c, g, or t
tcagtagtgtagatcacgaccggtgctcgatttagtagtgtagatttgggtttgggggaggcctggtgcagcctggggggtccctgacgactctcctgtgcagcctctggattaatgttagnaactcngcatcgaacgtgggtccacgaggctacgagcagtgggctgcgagtgggtctcaagtactagngtccttacgtagaagtagacgacgtagactacgcagacnccggtagaacgggccttcaacctcttcgaccaggaactaactaaccttacaaagaacgccgtactcttactacgagaanaaacggtanaaaccgtagtaccgaggacggtacgaaccggaacaacggaccggtacctagttactagttgaggtaacggaaggcggtcgggtaggacggggttacctagggcgggtaacgaaccggtaacgttcggacttaccgtcgtaccctacgaccncccgttaacccggaagtaaccgtccgtaacgttcccgtaaccccgttcccgtcggacctaccccgttcgaaccaccgtggaaacccgtccgacgggtacgggccaacgggttccgccggttccggagctccgttacgacgtacgacgtacctactcaacgttactaaccgnggccgtggacggtccgtaancggaacgccgtgacgagcganacg

SEQ ID NO: 223351 - DNA, 808 bp, Homo sapiens
  misc_feature: GYAE6OF02JGY6B.37.25.C03.1.454.CMB.1.raw
  modified_base (121)..(121): a, c, t, g, unknown or other
  misc_feature (121)..(121): n is a, c, g, or t
  modified_base (238)..(238): a, c, t, g, unknown or other
  misc_feature (238)..(238): n is a, c, g, or t
  modified_base (668)..(668): a, c, t, g, unknown or other
  misc_feature (668)..(668): n is a, c, g, or t
tcagtagtgtagatcacgaccggtgctcgatttagtagtgtagatttgggtttgggggaggcctggtgcagcctggggggtccctgagactctcctgtgcagcctctggattaatgtttancaactctggcatgaactggtccgcgagctcaggcagtggggctggcaggtgggttcctcaaggtactagtgtccttccgtggtaaatagacgcaggactaccgcagtaccgttccgngggaaacgggcccggttacaccatccgtaccaggtacaacaattaccaaacgaacacggccttacttactctacgaaacctaaagtacggaaccacggtacccgtaggaacgacgacccggaaagtacccgtacggtaccgttaataacgtttacgtacggttacgtaaacgggaacggtcgggttagggggacggggttacgggggtaaccttacggggtaccggggtaaccgggaacgggtttaccccggttacgggtaccgtaaccgttccccgttaccgtacggaccccgttacccgttaacccgaaacccgggtacccggaccgttacccggttacccgggtttaccccgttcccccggtacggtaccctaccccgtttacccgaccgaaaccgtccggaacttacccgggtgggtaccgggacncggtacgccgggacgtcggaccgtcgtaccgttcggtacgtaaccgtacttaacgtcccaaccgttctaacggtctaccggtaggacggggtacccggagggttaccggaccgacggtaccgacttaacggtctaggtcc

SEQ ID NO: 223352 - DNA, 846 bp, Homo sapiens
  misc_feature: GYAE6OF02G3SG4.37.25.C03.1.454.CMB.1.raw
  modified_base (170)..(170): a, c, t, g, unknown or other
  misc_feature (170)..(170): n is a, c, g, or t
  modified_base (175)..(175): a, c, t, g, unknown or other
  misc_feature (175)..(175): n is a, c, g, or t
tcagtagtgtagatcacgaccggtgctcgatttagtagtgtagatttgggtttgggctgagctggctttttcttgtggctattttaaaaggtttccagtgtgaggtgcagttgttggagtcgtgggggaggcctggtgcagccgtgggggtcctgagactctcctgtgcngcctntggtattaagtgtttagacaactcgtggcatgacgtcgggtaccacgacggctccgaggcaggtggggctgcgtaggtcggtctagaagtacgtaggtcgccttcgttaggtaagtaggagccgaagtaccgtacgacaacgtaccgtccggtagggtaacggggtccccgttaacaccgtactaccgaccgaggaacgtaacctaactaaccgaaaacgaccgtacgaccttagttacttccgaacgtaactaaaacgtgaaaccgcgtaccgagggaaacgaccgaccggtaaaacgccgggtaaccggtaccgtttaattacgttttacggtaggttacgggtaaacgggtaacggggtacgggtaggggggtacggggacggggggttaccgtaacggggtcgggggtaacccggaaccggggttaaccgttccggttacccgtacccgttaccgttccgacccgtaccgacccccgtcccggaaacccgtacccggggtaccctaccgtttccccggtacccccgtttcccccgacccggttaccccctaccccccgttaccgaacccgtaaccggtaaccccggtacccgtacccgggttaccgggcccggggtacctaccccggggccggtaccccgggtcccggttcgggtccgtaccccggg

SEQ ID NO: 223353 - DNA, 653 bp, Homo sapiens
  misc_feature: GYAE6OF02JRVYI.37.25.C03.1.454.CMB.1.raw
  modified_base (276)..(276): a, c, t, g, unknown or other
  misc_feature (276)..(276): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
  modified_base (512)..(512): a, c, t, g, unknown or other
  misc_feature (512)..(512): n is a, c, g, or t
  modified_base (543)..(543): a, c, t, g, unknown or other
  misc_feature (543)..(543): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggcgtggggagtgggggactacgtggggccacggtaacctggtcaccgtctcctcgacgcctccaccgaacggccctagtccggttcccttccccgnggacctaccccgtcctaccaacgacgcctaccgtcgtcggggacctacgacggccggtcccgtgggtcctcgtcccgttaggtaccgtaaacgggaccttaccgttccgaacttccgtaacctaccgtaacgttacggaacgggtccggggtacgttacgggaaccggtaacgggaccgtacgtaacgtaacggtccgaatcggcaacgttnacgctagtacncgacgacgcgacncgacgacgtacgacgtcgcgtgtctcgcgtnacgtgacgctcgtcgtatcgcgacgtacgtctacgagtgtcgacgtcgcgtacgacggtactcgtacgtacgtacgtcgacgtacgtaccgtacgtacgtcgtacgtacg

SEQ ID NO: 223354 - DNA, 527 bp, Homo sapiens
  misc_feature: GYAE6OF02GSWMT.37.25.C03.1.454.CMB.1.raw
  modified_base (481)..(527): a, c, t, g, unknown or other
  misc_feature (481)..(527): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggcgtatattactgtgtgaaaggctggggagtggggggactacgtggggccagggaaccctggtcaccgtctcctcacgcctcccaaccaacgggccccagttccggtcccttccccccgtggccacccccttccctacccaaaggacgcccacccgttacggtccgggggggctaaccgacgggcccgggccccgttaggggtcctcggtccccgtcgggtaccgaaaacggggtaccctaccgtttacccagttacctaacctaaccttaaccgtggacgggaccggggtcctacgggacaaacgggccgaccaagtacggnnnnnnnnnnnnnnnnnnnnnnnnnnnnnnnnnnnnnnnnnnnnnnn

SEQ ID NO: 223355 - DNA, 406 bp, Homo sapiens
  misc_feature: GYAE6OF02HYLQC.37.25.C03.1.454.CMB.1.raw
  modified_base (390)..(406): a, c, t, g, unknown or other
  misc_feature (390)..(406): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggagtggggggactacgtggggccagggaaccctggtcaccgtctcctcagcctccaccgaagggcccatcggtccttcccccgtggccacccctcctccaagacgccacctcgtgggggcacgagcggcccgtgggctgcctggtacgaacggtactacttccagtctacacttactgagcgggctgggcgaaggcgacatagnnnnnnnnnnnnnnnnn

SEQ ID NO: 223356 - DNA, 651 bp, Homo sapiens
  misc_feature: GYAE6OF02IF24P.37.25.C03.1.454.CMB.1.raw
  modified_base (208)..(208): a, c, t, g, unknown or other
  misc_feature (208)..(208): n is a, c, g, or t
  modified_base (310)..(310): a, c, t, g, unknown or other
  misc_feature (310)..(310): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (502)..(502): a, c, t, g, unknown or other
  misc_feature (502)..(502): n is a, c, g, or t
  modified_base (542)..(542): a, c, t, g, unknown or other
  misc_feature (542)..(542): n is a, c, g, or t
tcagtagtgtagatcacgaccggtgctcgatttagtagtgtagatttgggtttgggggaggcctggtgcagcctggggggtccctgagactctcctgtgcagccgtctgggattaatgttttagcaactctggcatgaactgggtccgccaggctcgaggctagtggggctgcagtggtctcaagtactagtgctctaggtaatagancagactacgcagacctccgtggaacgggtcccggttacacctactctccgaagacgaactaacttacaaaggaacacgctcctatcctgactaaatgaaacncgtacctaggaacggacgaccgaagaccgtacggccgttaattacttacgtggtaggtaaggaacggggtcggtagggggtaggtacgggggacttacgggacggggaccgacgggtaacccgtcggtaccnccggtactccgtnaccgcctccgaacgacggccctacgtcccgttcctccccgtcgaccnccctcctaccgaacgaccgtacgccgtacggcgggtaccngtacgccggtccggtggactcgcgtcgtacgaacgtactaccgttccgatactaccgtacttacggcgttacggcggtcggtcgacggtacggtccgaagtctagcgta

SEQ ID NO: 223357 - DNA, 685 bp, Homo sapiens
  misc_feature: GYAE6OF02G930P.37.25.C03.1.454.CMB.1.raw
  modified_base (122)..(122): a, c, t, g, unknown or other
  misc_feature (122)..(122): n is a, c, g, or t
  modified_base (145)..(145): a, c, t, g, unknown or other
  misc_feature (145)..(145): n is a, c, g, or t
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (297)..(297): a, c, t, g, unknown or other
  misc_feature (297)..(297): n is a, c, g, or t
  modified_base (446)..(446): a, c, t, g, unknown or other
  misc_feature (446)..(446): n is a, c, g, or t
  modified_base (490)..(490): a, c, t, g, unknown or other
  misc_feature (490)..(490): n is a, c, g, or t
  modified_base (683)..(683): a, c, t, g, unknown or other
  misc_feature (683)..(683): n is a, c, g, or t
tcagtagtgtagatcacgaccggtgctcgatttagtagtgtagatttgggtttggggggaggcctggtgcagcctggggggtccctgagactctcctgtgcagcctctggattaatgtttancaactctgcatgacgtgggtccnccaggcctccgagggctagtcgggggctgcgtaggtggtctacaaagttctagtcgcttcgtaggtaaatgagacagaacctacgcaagacctcgnggaacggtccgtacacntcncagacaactaactacaagacaccgctactattctanaacgaatacgaacacgcgtagacgacgaccggaacgaccgacggtacttaatactttacgtggtagtaacgggaaacgggtcggtaggggggaacgggtcgggggtaccgtagggtccggggaaccggtacgggttaccgtccggtacnccttccgtaccgactacggtccctacgaaccggtaccggtcccnccggttcccgtcccctcccggaccgccctaccctcgtacccgacgtccgaccgtacggtccgggacggaccgtacggaccggccggtcggtacgggtcctcgtccggtacgtacggtaccgttccttacctactcttacgtacttaccggtaacggtccggagtccggtgtacggacgacgtccaggtatgcngg

SEQ ID NO: 223358 - DNA, 765 bp, Homo sapiens
  misc_feature: GYAE6OF02HHHT0.37.25.C03.1.454.CMB.1.raw
  modified_base (286)..(286): a, c, t, g, unknown or other
  misc_feature (286)..(286): n is a, c, g, or t
  modified_base (760)..(760): a, c, t, g, unknown or other
  misc_feature (760)..(760): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtggtctcaagtctagtgctctggtaatagagcagactacgcagactccgtgaacgggcgtcaccatctccagacgtacaagttccaagaacacgctactatctgacaagtgaacngcctaggacgacgaccgaagacgacggtccgtaagtacttacgtaggtcgtaggaaacggtcggtaggggaggtcgggggaacctacgggtcggggaccgaacggggtacccgttagggtaccgtaacccgtcgtacccgtacgtaccgtacccgtacccgaaaccggtaaccgggtaccccgtaacggtttccccgggtttacccctttaccccccggtacggtacccttacccccgtaacccgttacccgaaacgggaccgttaccccggtaacccggttacgggttaccggggggaacccttaaccgggccgggtacccggggtaccccggtcgggtcccgtaccggtaccggtaccgtaaacgtaccgggtacccttaacctaccgttaccgtaccgtaaccgttaccgtacggtaccgggttacggtacggtccggaacggtacgaaccgggtacctacgtaagtcggntacgg

SEQ ID NO: 223359 - DNA, 669 bp, Homo sapiens
  misc_feature: GYAE6OF02FFSVZ.37.25.C03.1.454.CMB.1.raw
  modified_base (216)..(216): a, c, t, g, unknown or other
  misc_feature (216)..(216): n is a, c, g, or t
  modified_base (584)..(584): a, c, t, g, unknown or other
  misc_feature (584)..(584): n is a, c, g, or t
  modified_base (603)..(603): a, c, t, g, unknown or other
  misc_feature (603)..(603): n is a, c, g, or t
tcagtagtgtagatcacgaccggtgctcgatttagtagtgtagatttgggtttgggctcaactctcttgtccgccaggctccaggcatggggctgcagtgggtctcaagtactagtgcctctggtaatagagcagactacgcagactccgtgaagggccggttcaaccatctccagagacaattccaagaaccagctctatctgacaaatcgaacngtcctggacgaggccgaaaggacacgggtccgttaatagttactggtagtagaaggcgtggggagtgggggactacgtgggacctaacgggaccgtggtacacccgtactcctctacgaccctcaccgaaggcctagtccggtccttacccccgtggaccctacccgtcctacgtaacgacgccaccgttcggtcgggggacaacgtacggaccggtcccgtcgggacctcggtccgacgggttaccgtaaacggtaacccgtaccgtttcccaacgttactaacccgttaccgtaccgttacgaacgggttccgggtaccgttacgggtacccgaagggtccgtaccgaaacgtttaccggataccngacgtcactacgtataccngagacgagtatacgtacgacacgacgtacgtacgagacgtacgtacgtacgtacgtacgtacgtcg

SEQ ID NO: 223360 - DNA, 208 bp, Homo sapiens
  misc_feature: GYAE6OF02FNBAL.37.25.C03.1.454.CMB.1.raw
  modified_base (161)..(161): a, c, t, g, unknown or other
  misc_feature (161)..(161): n is a, c, g, or t
  modified_base (179)..(208): a, c, t, g, unknown or other
  misc_feature (179)..(208): n is a, c, g, or t
tcagtagtgtagatcacgaccggtgctcgatttagtagtgtagatttgggtttggggggaagaggaagacgtgacggtccccccaggagttcaggtgctgggcacagcggccctgggctgcctgggtcaaggactacttccatctacactactgagtcggntggcaagggcgcgatagnnnnnnnnnnnnnnnnnnnnnnnnnnnnnn

SEQ ID NO: 223361 - DNA, 783 bp, Homo sapiens
  misc_feature: GYAE6OF02G78X1.37.25.C03.1.454.CMB.1.raw
  modified_base (225)..(225): a, c, t, g, unknown or other
  misc_feature (225)..(225): n is a, c, g, or t
  modified_base (779)..(779): a, c, t, g, unknown or other
  misc_feature (779)..(779): n is a, c, g, or t
tcagtagtgtagatcacgaccggtgctcgatttagtagtgtagatttggggtttgggggaggcccggtgcagcctggggggtccctgagactctcctgtgcagcctctggaattaattgtttagcaacttcgtggcatagaacgttgggccgccgaggcctacgaggtcaggtggggctagcgtaggttggtctacgaagtacgtagtgtaccttcgtaggtaanagacgactaagactacgcaagtacctacggaggacgggtcctacactactacaccagagtaacaacttacgaaacgtaacacgctctaagcgtagaacaaatacgaacgacgtcctaagaggaccgaaacgaacgtacgaccggtactaaagttcctagttgacgttaaggaacggtggtaggggtagggacggtaaccgtacgggtacgggaccggtaaacggtaccggtgaacccgtaccgtctaccgtacaccggtacctacccgaacggaccgcctacgtaccgttcccgttacccgccggtacctacccgtaaccgtaccgtaacggaccgtaccgtaggttaccgggacgggaacctaacgggaccgtaccccgggttacgccgggtccgtacgggtcccgttaaacgggtaccgtaaaccggttaacctaccgttaaaccgtaccttaaaccgactttaacgggtaaccgtaacggggtaccgggtaccggtaaccgggtaccggtaaccggtaaccggtaaccgtcggtaaggttacacgggttanacgg

SEQ ID NO: 223362 - DNA, 256 bp, Homo sapiens
  misc_feature: GYAE6OF01DLYO8.40.36.D03.1.454.CMB.1.raw
  modified_base (252)..(256): a, c, t, g, unknown or other
  misc_feature (252)..(256): n is a, c, g, or t
tcagtctagcgactcacgaccggtgctcgatttagctgcgtcacgatctctctgggacagattttactctcaccatcagtagcctgcaggctgaagatgtggcagtttattactgtcaacaatattattatactccgccgacgttcggccggggaccaacgtggaaatcaaacgaactgtggctgcaccatctgtcttcatcttcccgccatctgaagtcgctagactgagcgggctggcaaggcgcatagnnnnn

SEQ ID NO: 223363 - DNA, 549 bp, Homo sapiens
  misc_feature: GYAE6OF01DKHXE.40.36.D03.1.454.CMB.1.raw
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (394)..(394): a, c, t, g, unknown or other
  misc_feature (394)..(394): n is a, c, g, or t
  modified_base (426)..(426): a, c, t, g, unknown or other
  misc_feature (426)..(426): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagacctccctggctgtgtctctgggcgagacggccaccatcaactgcaagtccagccagagttgttttcacacctccatagaacaaggagtacttggcttggttccagcaagaaaccagggcagcctccaagctgctnatttacncggcactccaacccggaaatccggagttccctgacccgtattccggtggcgaggtcgggtcgtgggactagtattttacnctccacatcagtacgcctgcaggctagaagtntgtgactagtttatactgtactaactaattattattactacgtccgaccgtacggttcgggacccgggggtaacctaacgggtaggaaactacgaaacgtacgtgtacgctcgctaccgtacg

SEQ ID NO: 223364 - DNA, 522 bp, Homo sapiens
  misc_feature: GYAE6OF01DBTFY.40.36.D03.1.454.CMB.1.raw
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
  modified_base (378)..(378): a, c, t, g, unknown or other
  misc_feature (378)..(378): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggagtacttggcttggtccagcagaaaccngggcagcctcctaagctgctcattacncggcatccacccggaaatccggagttcctgaccgattccgtggcagcgggtctgggacagtatttacnctcaccatcagtacgcctgcaggctagaagatgtggctagtttatacgtgtacaactaattattattatactccgtccgacgttcggaccggggtacaacggtaggaaactccgaaacgtactggtacggctacgctaccgtac

SEQ ID NO: 223365 - DNA, 509 bp, Homo sapiens
  misc_feature: GYAE6OF01BW9BO.40.36.D03.1.454.CMB.1.raw
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
  modified_base (408)..(408): a, c, t, g, unknown or other
  misc_feature (408)..(408): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcagacgccaccatcaactgcaagtccagccagagtgtttttcacacctccatgaacaaggagtacttggcttggttccagcagaaccagggcagcctctaagctgctcatttacncggcactccacccggaaatcccggagttccctgaccgattccgtggcagcgggtctgggacagattttacnctcaccatcagtagcctgcaggctgaagntgtggctagtttattactgtacaactaatattattatactccgccgtacgttcgggccgggaccaaggtggaaactcaaacgaacgtgaggctgcacctac

SEQ ID NO: 223366 - DNA, 518 bp, Homo sapiens
  misc_feature: GYAE6OF01BF5IY.40.36.D03.1.454.CMB.1.raw
  modified_base (381)..(381): a, c, t, g, unknown or other
  misc_feature (381)..(381): n is a, c, g, or t
  modified_base (512)..(512): a, c, t, g, unknown or other
  misc_feature (512)..(512): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagtattttacnctcaccatcagtacgcctgcaggctgaagatgtgctagtttatactgtacaactaattattattatactccgccgtacgttcgggacccggggtaccaacggtaggaaatccgaaaacgactgtagctgcncctacg

SEQ ID NO: 223367 - DNA, 776 bp, Homo sapiens
  misc_feature: GYAE6OF01C8IL6.40.36.D03.1.454.CMB.1.raw
  modified_base (310)..(310): a, c, t, g, unknown or other
  misc_feature (310)..(310): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctggcggggacatcgtgatcgacccagtctccagacctcccgtggctgtgtctcgtgggcgagaccggccacatcaactgacaacgtccagccagtagtttcgttttaccacctaccctccatacgaaacgaaggtagtacgttggtcttcggtccagacaacgaaaccgngggaccacgcctacctaagctcgctactactttacgcgacacgtacccgaaaccggtaacgtcccgggtacttccgtacgaccgtacgtttccggcggaccgacgggtcgggtacgtacgggactaagttacttttaccgactaccgaaccctagttaccgtaaggttaccgccgtacggaccgtacggtaccgtaaggaaacgtacggttaggttacggttaacgtttaacggttttaccgttaaaccttacggtaaccttaaaacgttaaattttaacttttaaacgttaacccgttaacccggtacccgggtacccgggttaaacccggggggttacccgggggaaaccccgggggggttaaacccgtaaaacggggttaaacgggtaaaaccgttaaaccgggtaaaaacccggtacggttacgggtacccggtacttaccggaaccccttaacggttaccg

SEQ ID NO: 223368 - DNA, 827 bp, Homo sapiens
  misc_feature: GYAE6OF01DNMW5.40.36.D03.1.454.CMB.1.raw
  modified_base (322)..(322): a, c, t, g, unknown or other
  misc_feature (322)..(322): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctggcggggacagtcgtgatcgaccctagtcctccagacctccctggctgtcgtctcgtgggcgagaccggccacatcaactgacaagtccagaccagtagtttcgttttaccacctacctccagtacgaaacgtaaggtacgtacgttggtcgtttcggtaccaggtaccaacggaaaccgngggacctaccgacccttaccgtaaagccttacgtaccttacgttaacgtttacccgaccggtaacctaaccgtaacccccgtaaacccggtaaaccgttcccgggtacgttacccgtaccggtaacccgttaccggttccggagggaccgtacggggtccgggttacggtacgggtaaccgttaacgtttaccgttttaccaccgtaaccctacgtaacgttaccgtaacgtacccggtccgtaggaccgtaacgggtcgtaaacgggtaagttacggttacggggttacgttaccgttttaaacgttttcgtttaaccgtacgttaaaccgtaaaactttaagtttaacgttttaacttaacccggttaaccccggtcccgtacccggggttaaccgggtacccggggtaacccgggtaaaccggttaaccggtaaacggtaaacctaccggtaaaacggttaccggtacgggtacgtaccctccggaaacttacccgttacgg

SEQ ID NO: 223369 - DNA, 748 bp, Homo sapiens
  misc_feature: GYAE6OF01COO6O.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctggcggggacatcgtgatgacccagtctccagactccctggctgtgtctctgggcgagacggccaaccatcaactgcaagtccagccagagttgtttttcacacctcatgaacaaggagtacttggcttggttccagcagaaaccagggcacgcctctaagctgctctatttactcggcactccaaccggtaaatccggtaagttccgtgaccgtacttccggtggcctaggcggggttctaggggacctaggtaacgtttttaacctccttaccgtaaccagtttccaaacggttaacggtccccttggaccgtaacggggtcccgttaagggaaaggtaagtttcgggttacgggtaacgtttaacggttttttaaactttaaccggtttaggttaaaccctaaaaccgttaaatttaaattttaacgttttaactaacccggtttaccccggtaacccgggttaacccggggtttacccgggggtaaccccggggggggtaaacccctaaaaccggggttacgggaaaaaaccgtttaacccgaaaaaaccggtaaaccggttcgggttaacggtccggttaacgtacccgtaacccgttaaacg

SEQ ID NO: 223370 - DNA, 553 bp, Homo sapiens
  misc_feature: GYAE6OF01AONX8.40.36.D03.1.454.CMB.1.raw
  modified_base (546)..(546): a, c, t, g, unknown or other
  misc_feature (546)..(546): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgtttttcacacctccatgaacaaggatacttggcttggttccagcagaaaccagggcagcctctaagctgctcatttactcggcactccaacccggaaatccggaacgttccctagacccgtattccggtggcgaggccgggtcgtcgggacagtattttacctctaccacatcagtacgcctgacaggctagagtatggtgactagtttatactgtaactaacgtaattaattattactaccgtccgtacggtaccggtttacggggacccggggtaccaacggtaggaaactacgaaacgacgtgtacgactnccagtac

SEQ ID NO: 223371 - DNA, 552 bp, Homo sapiens
  misc_feature: GYAE6OF01DDJ18.40.36.D03.1.454.CMB.1.raw
  modified_base (439)..(439): a, c, t, g, unknown or other
  misc_feature (439)..(439): n is a, c, g, or t
  modified_base (543)..(543): a, c, t, g, unknown or other
  misc_feature (543)..(543): n is a, c, g, or t
tcagtctagcgactcacgaccggtgctcgatttagctgcgtcacgatctctcttgggggctacaacaggcaggcagggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccaaccagagtgttttcacacctccatgaacaaggatacttggcttggttccagcagaaaccgaggcacgcctcctaagctgctctatttactcgactactcccaaccggtaactccggagttccctagaccgtacttccggtggacacggtcgggtcgtagggactacggttatttacctctacacctatacgatacgcctgcagctagagagtgtgntagtttatactgtacaatatattattactacgtccgtacgtacgggtccggaccggggacctaacggtaggaaactacgaaaccgattcggtacgtctagaccncgtattccg

SEQ ID NO: 223372 - DNA, 671 bp, Homo sapiens
  misc_feature: GYAE6OF01BHMO1.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcgggacatcgtgatgacccagtctccagacctccctggctgtgtctcgtgggcgagaccggccaccatcaactgacaagtccagccaggtagttcgtttttcactaccctccatcgaaacaaggtatacttggcttggtccagcagaaaccagggcacgcctccaagctgctctattctcggcactccgaacccggaactccggtagttccctgacccgtacgttccgtggcacggtcggtcgtagggactagttactttacgtcctaccgtaacctactaccgtaggtacgtccgtagaccgtaggtctacggtaagtacgtacggttcggtacgttaagttttaactaaccgtagttacctaaaacttaactttaatttaacgttaactaacccgttcccggtacccggttaaccggggttacccggggtaccccggggtaaaccgtaaaccgggtaacggtaaaccgttaacccgtaaaacgtaccgttacggtaccggtaccgtaccggaccaacccgttaaccg

SEQ ID NO: 223373 - DNA, 718 bp, Homo sapiens
  misc_feature: GYAE6OF01EW61D.40.36.D03.1.454.CMB.1.raw
  modified_base (296)..(296): a, c, t, g, unknown or other
  misc_feature (296)..(296): n is a, c, g, or t
tcagtctagcgactcacgaccggtgctcgatttagctgcgtcacgatctctcttgggggctacaacaggcaggcagggggcagcaagatggtgttgcagacccaggtcttcatttctctgttgctctggatctctggtgcctgcggggacatcgtgatgacccagtctccagactccctggctgtgtctcgtgggcgagccggccaccatcaactgacaacgtccagccagtagttgttttccacacctccatagaacaaggtatacgttggtcgttggtccagacaacgaaacgnggcacgcctaccaagctagctactatttacgcggcaacgtccgaaacccggtaaacgtccggtacgttccgtacgtaccggtacgttcccggtggcgaggtccgggtacgtacgggactaggttacttttaccgcctaccgaactacgttctaaggtcgtaccgtcgacgaaggtccgtaggaaacggtgttggttacgtacgtttaacgttttagtttaccggttacggtaactaaaacgttaaacgtttaatttaaccttaacgtttacccgtaccccgggtaccgggttaaacccggggttcccgggggtaacccccgggggaaaccgttaaccggggtaaaccggtaaaacgttaacccggtaaaaacggtaccgggttacggtcgggtaaccccgttcgggaacccacccgttaacg

SEQ ID NO: 223374 - DNA, 708 bp, Homo sapiens
  misc_feature: GYAE6OF01CNWGY.40.36.D03.1.454.CMB.1.raw
  modified_base (197)..(197): a, c, t, g, unknown or other
  misc_feature (197)..(197): n is a, c, g, or t
tcagtctagcgactcacgaccggtgctcgatttagctgcgtcacgatctctcttgggggctacaacaggcaggcagggggcagcaagatggtgtgcagacccaggtcttcatttctctgttgctctggatctctggtgcctggcggggatagtcgtagatcgacccagtcctccagcctcccgtggctgtgtctcgngggcgagacgccacatacaactgacaagtccagccaggtacgttctttacactacctacatagaacgaggtacgtacgttcggtcgtacggttttccgagacaacggaaaccgacggacgacgaccctaccgtaacgtcgtcgtacctacttaacgtttaccgtaccggtacctaccgtaaccccgtaaacccggtaaaccgtacccgggttaccgttacccggtaacggtacccggtaaccgttccggtacggtacgtacgggtacgggtacggtaccgggtaacgtaacgttacctttaccgtcctaccacctaacgtacgtacgtacgtaccgtagcgtacgtcgtaacgaagtagtacggtacgtacgttagtttactacgtagtaacctaacttaattaagttaacttacgtaccgtacgtacccgtacgggtaccgggtaccgggtaaccgtaacggaacgtaacgaacgtaaacgtacgtacgtacgtacacgtccgagtaccg

SEQ ID NO: 223375 - DNA, 692 bp, Homo sapiens
  misc_feature: GYAE6OF01CVFMT.40.36.D03.1.454.CMB.1.raw
  modified_base (138)..(138): a, c, t, g, unknown or other
  misc_feature (138)..(138): n is a, c, g, or t
  modified_base (150)..(150): a, c, t, g, unknown or other
  misc_feature (150)..(150): n is a, c, g, or t
  modified_base (680)..(680): a, c, t, g, unknown or other
  misc_feature (680)..(680): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtncctggcgggacngtcgtgatcgacccagtctccagacctcccgtggctgtctctgtgggacgacgacggcccaccatcaaactgacaacgtccagccagtacgttgttttaccactacctaccatacgaaacgaaggtacgtacgtcgtcttcggtacagacgaacgaaacgacgggacacgcccgtaccaaggtcctatccttactacgttttaccgcggaccctacgtaccccgtaaacccggtaaacgttccggtaacgttcccgtaacgaccgtacgttccggtagacgacgggtcggtacgaggtacgtacgttaactttctacctaccgactacgttacgaagtaccgtcgtagaccgtaggtacgaaggtaataacggttggtaacgtacgtttaactttacgtaacttcgaaactaaacgttaatttaatttaactaccgtaccggtaccggttacccggtaaccggggttcggaaccccgggggtaacttaaggaacggtaaacaacgtaaaccgtaaggttcacgggttacncgttccaactac

SEQ ID NO: 223376 - DNA, 907 bp, Homo sapiens
  misc_feature: GYAE6OF01CVUP7.40.36.D03.1.454.CMB.1.raw
  modified_base (319)..(319): a, c, t, g, unknown or other
  misc_feature (319)..(319): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactcctggctgtgtctctgggcgagacggccaccatcaactgacaacgtccaaccagagtgttttcacacctccatgaacaaggagtacttggtcttggttaccagcaagaaaccgagggcacgcctaccaagctgctctactttacncggacactaccgaacccggtaactccggtaacgttcccgtacggtaacccggtactttacccgggtgggaccgtacgggtccggggttaccggttacggggaacctaacgggtttaccttttttaaccggtacccttaacccggaaccctaacgttaccgaacgggttaccgtaccgtacggtacccgacggggttaccgtaaacggtaaacggtacgttacgggggtttaacgttaaccgttttaaacggttttttacgttttaaacccggttaacggttaaaccgtaaaaaccctttaaaggttttaaacctttttaaacgtttaaacccgttaccccgggttttaccccggggaaccccgggtttaacccgggggttttacccccgggggggaaacccccggggggttaaaacccgtttaaaacccggggggttaaaccgggggttaaaaaacccttaaaaaccccccgggtaaaaaacccgggggtttaaaccggtttacccgggggttaaacccggggttacccgttaaacccgggtaacccccgttaaaaacccccggtttccggtttttaaaacccccggg

SEQ ID NO: 223377 - DNA, 937 bp, Homo sapiens
  misc_feature: GYAE6OF01DFDPQ.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctcgtggtgcctgcggggacagtcgtagatcgacctagtcctccgacgtaccttcccgtggtccgtggttcgttccgtcggtacgggggaccgaacggacccggacccaaccaacttccaaacgttcgaccgtaacgttccgacgtaccgaggttagttttccgttttaccaacctaccctcaacgttacggaaaaccgtaagggttacgttacgttcggtacctttcgggttaccaacggaaccaaaccgggaaaaaccgcggggacctaaccggtaacccttccgtaaagtccgttaggtaccctttacggttaacgttttaccggccgtaacctaaccgttaccccgtaaaacccggtaacgtacccgggtttactaccggttaccgtaacccggtttacggttaccggtcgacgtacggggttccgggttacgtacggggaacctttaaggttccttttaaccgtccgtacctaaccgttagttacccgtacgggttaccgtcgtacggtaccgtcggttacgtaacgggtacgttaacggttcggtacgttacgtttaaggttttaaccttacgttacggtaaccttaaacggttaaactttacgttttaaccttaccggtaacccgttaccccgggttaccggttacccggggtttaccccggggtaaacccgggggtaacccgttaaacgggttaaccgggtaaaaccggttacccgggttaaaaaaacccggtcccggttttaaagggttaccccggttaaccggttccgttaaaccccgtaccgtttttaacccgggg

SEQ ID NO: 223378 - DNA, 594 bp, Homo sapiens
  misc_feature: GYAE6OF01AO0XF.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccaccatcaactgcaagtccagccagtagttgtttttccacaccctcatgaacaaggagtacttggcttggttccagcagaaaccaggcagcctctaagctgctcatttactcggacactccgaacccggaaatcccgggtattcccgtcgacccggtacttcccggtggtccgaggccggggttcgtggggacctaagtacttttacctctaccaacctatctaaggtacgccgtggcagggtctagaagtgtggtggcttaggtttacttacgttgtactaaactaattaattattagtaccgtccgccggtaccgttcgggacccggggacctaacgggtaggtaaactaccgtaaaacgtacgtcggtacgtactcgccacgttaccg

SEQ ID NO: 223379 - DNA, 508 bp, Homo sapiens
  misc_feature: GYAE6OF01A6TEF.40.36.D03.1.454.CMB.1.raw
  modified_base (313)..(313): a, c, t, g, unknown or other
  misc_feature (313)..(313): n is a, c, g, or t
  modified_base (341)..(341): a, c, t, g, unknown or other
  misc_feature (341)..(341): n is a, c, g, or t
  modified_base (395)..(395): a, c, t, g, unknown or other
  misc_feature (395)..(395): n is a, c, g, or t
  modified_base (503)..(503): a, c, t, g, unknown or other
  misc_feature (503)..(503): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctcgtgggcagaccggccaccatcaactgcaagtccagccagtagttgtttttcacacctccatgaacaaggagtactggcttggttccagcagaaaccagggcagcctctaagctgctcatttacncgcactccacccggaatccggagttccngaccgtattccgtgcaggcggtctgggacagtactttactctcaccatcagtancctgcaggctagaagatgtgctagtttactatgtactaagtaattattatatactccgcgacgtccggacggggacacggtagaaactacaaacgaactgtagactcnaccta

SEQ ID NO: 223380 - DNA, 774 bp, Homo sapiens
  misc_feature: GYAE6OF01E1JGT.40.36.D03.1.454.CMB.1.raw
  modified_base (555)..(555): a, c, t, g, unknown or other
  misc_feature (555)..(555): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagacctccctggctgtgtctcgtggggcaggaccggccaccatcaactgacaacgtccagccagtacgttcgtttttacaccacccttccatacggaaaccaagggacgttacttgggtcctttcgggttcccgagacgaacggaaaacccgagggtacacggccctaccgtaaaggcctacgtcttaccgtacttttaaccgtccgggtactaaccgtaccccgaaaccccgggtaaacgttccccggggaaggttttccccgaccggaaccccggttacgtttcccggtcgggacccgtacgggtccgggggttcgtacggggggtaacctaacgtttaaccgtttaaccttccctacctaccctaacgttccaaagggttacnccggttacgaccgtacggtccggttaagaaggtacgttcggttacggtacttaaggttttacgtattaccggttaaactaacttaattactttaacttacgtccgttcccggtacccgggttaccggttaccggggggacccggggtacctaaacgggtaacggaaaccggttaacaaaccggtaacggttcggtcggactaccggtcccaagttaccg

SEQ ID NO: 223381 - DNA, 938 bp, Homo sapiens
  misc_feature: GYAE6OF01DZOY9.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagacctccctggctgtcgtctcgtgggcgagaccggccaccatcaacgtgacaagtccagccagtgttgttttaccactaccctccgatagaaacgaaggtacgttacgtttggccgtttcgggttacccaaggtccgaaaacggtaaaacccgagggggtaccaccggtaccccttacccggtaaagccgtacgtaccttaccgtaacgttttaacccgtccgggtacctaaccgttacccccgaaaaccccgggtaaaaccgtttaccccggggtaacggtttaccccgtacggtaaccccggttaacgtttccccgggtaggggtacccgtaacggggtcccgggggtttaccgtaacgggggtaaacccgttaacgggtttaacttttttacccgtacccgttaacctaaccccgtaacgtttaacccgaacggttaaccgtacccggttacggacccgggtaacggtaaccgttaagggtaaaacggttacggtttacgggtacgggttaacgtttaaacggttttttacgtttaaccgttaacggttaaccttaaaaccgttaaatttaacgtttttaactttaaccggtttaaacccgtccccgggttaaacccgggttacccggggttttacccgggggggaacccccgggggggttaaaacctaaacccgggggttaacggtaaaaaccgttaaaccgaaaacccggtaaaccggtttcgggtaaccggtacccgtaacgtaccccgtaacccgttaacg

SEQ ID NO: 223382 - DNA, 668 bp, Homo sapiens
  misc_feature: GYAE6OF01EPSGP.40.36.D03.1.454.CMB.1.raw
  modified_base (386)..(386): a, c, t, g, unknown or other
  misc_feature (386)..(386): n is a, c, g, or t
tcagtctagcgactcacgaccggtgctcgatttagctgcgtcacgatctctcttgggggctacaacaggcaggcagggggcagcaagatggtgttgcagacccaggtcttcatttctctgttgctctggatctctggtgcctgcgggacatcgtgatgacccagtctccagacctccctggctgtgtctcgtgggcgagacggccaccatcaactgacaagtccagccagtattgttttccacacctccatgaacaggagtacttggtcttggtaccagcaagaaccgaggacacgcctaccgtaagctgcctactatttacgtcggctactacccgaacccggtaaagtcccggagttaccacggtaacccgtacgtttcccggnggtccgagggtccgggtactggggaactagttacgtttactcctacaacctacgtacacgtagccgtagacgtaggacctaggaagtgtggtacggatttaacgtttaattaccgtagtaacctaaacgttaattaactttaacttaaccgtaccgttcccggtaacccggttacgggttacccgggggaccccggggtaaaccgttaaacgggaacggttaaaacgtaaacccgaaaacggtaacgttcgggtaccggtcgtaacacccgtacgttaaccg

SEQ ID NO: 223383 - DNA, 882 bp, Homo sapiens
  misc_feature: GYAE6OF01DONHG.40.36.D03.1.454.CMB.1.raw
  modified_base (349)..(349): a, c, t, g, unknown or other
  misc_feature (349)..(349): n is a, c, g, or t
tcagtctagcgactcacgaccggtgctcgatttagctgcgtcacgatctctcttgggggctacaacaggcaggcaggggcagcaaagatggtgttgcagacccaggtcttcatttctctgttgctctggatctctggtgctgcgggacatcgtgatgacccagtctccagactccctggctgtgtctcgtgggcgagacggccaccatcaactgacaacgtccaaccagtagttcgtttttcacctacctccaattagaaaccaaggacgttacgttaggtctttacggttaccagacgaaacgaaaaccgtagggacgacggtccctccgtaagctgctactattacncgcactaccgaaccgaacgtcggacgtttccacgaccgtacgttcccggtcggaccgagggtccgggttaccgtaggggaaccgtaaggtttacctttttaccgttacccttacccgtaaaccctacgttaaccgtaacgggttacgtaccccgttaggacccggtaacggggtcgtttaaagggtaaaccggttaggtttacgggttacgggtaaccggtttaaaggtttttttaaaccgttttaccgtttaaaccgggttaaacccttaaaaaccggttttaaacttttaaaacgtttttaaacgttttaaacccgttttaaccccgggtttacccccgggtaacccccggggttttaacccgggggtttccccccggggggtaaacccggggggtaaaacccccggttaaaaccggggttaaacggggtaaaacccgttaaaacccggttaaaaaccgggtaaaccggtttacgggttaaccggggtaccgtttaccggtaacccctaaacccgtagttttaaccccggg

SEQ ID NO: 223384 - DNA, 978 bp, Homo sapiens
  misc_feature: GYAE6OF01BEMFA.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctcgtggtgcctggcggggacagtcgtgatcgacccagtctccagacctcccgtggctgtcgtctcgtgggcgacgaccgccacctatacaactgactaacgtaccaaccgtagtagtttcgttttaccaacctacctaccaagttacgaaaaccgtaaagggtacgttaacgttcgggtaccgttttaccggttaccaacgaccgaaacggaaaaccggtacggggaccaacggtcccgttaacctaacggtccgtacgtaccttacgttaacgttttacccgccggtacctaaccgttaacccccggaaccggtaaacgttcccgggtaacgttcccgtaacggacccgtacgttccgggcggtacgtacgggtccgggttagacgggtaacctaagtttactttaccgtaccttaccgaactaactaccgggttaacgtaccggtaccctagggtaccggtaaccgggtcttaaacgggtaaacgttacgggtaaccgggttacggttaaccgttttaaacgtttttaacccgttaaccggtttaacgttaaacccccgtaaaaagttttaaacccgttttaaagtttaaacccggttttaaccgtttaaacccccggttaacccccgggttaaaccccggggtttaaaccccccgggggtttaacccggggggaaacccccggggggtttaaaacccgtaaaaacccggggggtttaaacggttaaaaaacccccgttaaaccccggggtaaaaaccgggtttaaacccggttaccggggtttaaccggttaaccccggtttaaccggaaaccccgtttaaccgttaaccgggttttaaccccg

SEQ ID NO: 223385 - DNA, 846 bp, Homo sapiens
  misc_feature: GYAE6OF01EMC2N.40.36.D03.1.454.CMB.1.raw
  modified_base (87)..(87): a, c, t, g, unknown or other
  misc_feature (87)..(87): n is a, c, g, or t
  modified_base (509)..(509): a, c, t, g, unknown or other
  misc_feature (509)..(509): n is a, c, g, or t
tcagtctagcgactcacgaccggtgctcgatttagctgcgtcacgatctctcttgggggctacaacaggcaggcaggggcagcaagntggtgttgcagacccaggttcttcatttctctgttgctcgtggattctcgtggtcgccgtggaccggggactatcggtagatccggacccctagttcctccaacgtccttcccgtgggccttggtcgtcgtcgtggggaccgacggaccggaccacctataccaacgtgaccaacgtcccgagccgtaagtcgtttcttttaccacctaccctcctagtaacgaaacggtaaggtacggttacgttcggtcgtttacggttaccaagtaccgaaacggtaaacccggagggacctaccggcccttaccgtaaggtccgtacggtcctacgttaacgtttacccgacggtacctacccgtaccccggtaaacccggtaacgtcccggggtacttaccccgaggtaacccgttcgttacccggnggtaccgtacggggtcggtaccggtagggtaaccttaggtttaccttttacccgtacctaccgtaacccgtagtaccgtaaacggttccgtaccgtggaccgtaacgggtacgttaacgggacgttacggttacgggttcgttaaccgtttaagttttaccgtttaacgtacggttaacctaaagtttaacgttttacttaaccgttaccttaccggtacccgggtaccggttacccggggttacccgggggacccgggtaaacgtaaccggggttaactaaaccggtaaccgtaacggttaaacgtcggttacggtacgtcgtaccctaacgttcg

SEQ ID NO: 223386 - DNA, 666 bp, Homo sapiens
  misc_feature: GYAE6OF01BZYQO.40.36.D03.1.454.CMB.1.raw
  modified_base (407)..(407): a, c, t, g, unknown or other
  misc_feature (407)..(407): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagacctccctggctgtgtctcgtgggcgagaccggccaccatcaactgacaagtccagccagtagttgtttttaccactaccctccaattagaacaagggtacgttacgttggctttgggttcccaaggcaacgaaaccgagggccagccctaccgtaaagcctggctactatttacgtcggaccactcccgaacccggtaaatcccggtacgttcccgtagaacccgtattcccggngccgaacgtcgggtcgtaggggtacagttacttttacctacctacgacctatcgaagtacgtccgtagcgacggtcgtagaaggtattcggacggtactaacgttttactaacgttacgtacctaaagtaactttaagtttacttataacccgttccggaccgttaccgggttaccgggacccgggggtaacctaacgggttacgtaaacgtaccgaaaacgtaccgttacggacggtactacggtaccaccgttaacg

SEQ ID NO: 223387 - DNA, 764 bp, Homo sapiens
  misc_feature: GYAE6OF01B6SHB.40.36.D03.1.454.CMB.1.raw
  modified_base (116)..(116): a, c, t, g, unknown or other
  misc_feature (116)..(116): n is a, c, g, or t
  modified_base (169)..(169): a, c, t, g, unknown or other
  misc_feature (169)..(169): n is a, c, g, or t
  modified_base (175)..(175): a, c, t, g, unknown or other
  misc_feature (175)..(175): n is a, c, g, or t
  modified_base (201)..(201): a, c, t, g, unknown or other
  misc_feature (201)..(201): n is a, c, g, or t
tcagtctagcgactcacgaccggtgctcgatttagctgcgtcacgatctctcgttggggctacaacaggcaggcaggggcagcaagatggtgttgcagacccaggtcttcatttcnctgttgctctggactctctggtcgccgtggcgggacagtcgtgactcgacccnggtccnccagcctccgtggctgttgtcgtcgngggaccagccgccaacatacaactcgaccaacgtccacgaccgtaggttacgtttcgttttaccacctacctaccgataacggaaacgaaaggtacttacgttggtacctttgggtaccagacgaaacggaaccgcggacaccggtacctacgacgtcacgtacttacgttacgttacgacggacctacctaacccgaacggtaccgtaccggtacgttccgacgtacgttccgtccggacggtacgtacggggtacggttcggtaccggaacgttaacgtttaacctttacccgtaccttaacccgattaacccgttcgaaacgggttccgtaccgtccgaaccggtaaggtaacccgttaggaacgttggttacggtagttaaccgtttaagttttaccgtaccgttagtaaaccttaaaacgtttattaactttaaccgtttaccgtaaccggtccccgggtaaacggttcccggggtaaccggggtaacccggtacggtaaacggtaacgtaaacgtaaccgtaacgtacggtcgttaacgacgtactacgtacttacg

SEQ ID NO: 223388 - DNA, 641 bp, Homo sapiens
  misc_feature: GYAE6OF01C851B.40.36.D03.1.454.CMB.1.raw
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
  modified_base (536)..(536): a, c, t, g, unknown or other
  misc_feature (536)..(536): n is a, c, g, or t
  modified_base (618)..(618): a, c, t, g, unknown or other
  misc_feature (618)..(618): n is a, c, g, or t
  modified_base (626)..(626): a, c, t, g, unknown or other
  misc_feature (626)..(626): n is a, c, g, or t
  modified_base (636)..(636): a, c, t, g, unknown or other
  misc_feature (636)..(636): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctggacgggacagtcgtgatcgacccagtcctaccgagaccttcccgtggccgtgtacgtctcgtgggacgaggaccgccaacatacaactcgacagtccagacagtagttcgtttacaccactacataagaaacgagtagttactgtcttacgtacagacgaacgaaaccgnggacacgtaccacgtaacgcgtanactatactttacgcggtacacctaccggaaccgtaacgccggtaactccgtcgaacgtacgtccgaaggcgacggtcggtacgtacggaacttaggttacctttacacgtaccactagtctaacgactcctggaccgtagtacctaggaactgttcggtacgtattaagttaacgttactaacgtaactaattaacgttntttaactacgtaccggtccggtaccgaacgggttccggaaccgggtaaacgtaacgtaggtaaaacctaacgaaagtaccgnggtaccgngtacaccgtntaacg

SEQ ID NO: 223389 - DNA, 854 bp, Homo sapiens
  misc_feature: GYAE6OF01A90TM.40.36.D03.1.454.CMB.1.raw
  modified_base (136)..(136): a, c, t, g, unknown or other
  misc_feature (136)..(136): n is a, c, g, or t
  modified_base (809)..(809): a, c, t, g, unknown or other
  misc_feature (809)..(809): n is a, c, g, or t
tcagtctagcgactcacgaccggtgctcgatttagctgcgtcacgatctctctgggggctacaacaggcaggcaggggcagcaagatggtgttgcagacccaggtcttcatttctctgttgctctggatctctggngccgtggcgggacagtcgtagatcgaccctagtctccagacctccgtggcttgtcgttcgtccgtggggcgacggaccggaccaacctactactaaacgtcggactaaccgtccgaacgccgtaaggttacggttttacttttacccaacctacccttaccgaagttaaccggaaacggtaaggtacgtttaacgttcgggtcctttacgggtttacccgaagaaccgtaaacggtaaaaccggcggggtacctaccggtccctaacggtaacggtcctacggtacctactaaaccgttttccgacggtaccaccgttaaccccgaaacggtaaaccgtcccgggttaacgttccgtaccggtaacccgttacggttcccggtagaccgggtaacgtcgggtacgtacggggtaaccttacgttaacgtttacctcccggttaacacccgtttacgttaaccgggtacgttaccggtaccggtacgtaccggaacggttacgaaggtaaaccgtggtaggtacgggttaactttacgttttacaacgttacgtaaactaacgttaaacttttacttaagttaccgtaacccggccggttaccggttaacccggggtcccggggtaaaaccgggtaccgtaaaggtacggtaaaaccggttaaccggaaaaccnggttacccggggaacgtattacccgggaccctaaccgggtttacg

SEQ ID NO: 223390 - DNA, 741 bp, Homo sapiens
  misc_feature: GYAE6OF01AEM1U.40.36.D03.1.454.CMB.1.raw
  modified_base (719)..(719): a, c, t, g, unknown or other
  misc_feature (719)..(719): n is a, c, g, or t
  modified_base (727)..(727): a, c, t, g, unknown or other
  misc_feature (727)..(727): n is a, c, g, or t
  modified_base (734)..(734): a, c, t, g, unknown or other
  misc_feature (734)..(734): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgccgtggcggggacagtcgtgatcgacccagtcctccagacctcccgtggctgtgtctcgtgggcgacggaccggcccaaccactccaactcgacaacgtccgacgccgtaggtacgttttcgttttaccaacctaccctacctaatacggaaaacgtaagggtacgttacgttcggttcgtttcgggttaccaaggtaccaaacgggtaaaacccggaggggccaaccgtcccgtacccgtaacgtcctcgtccttacgtacctttaccgccggacctaaccgtacccgaacccggtaaacgtcccgggtactcccgtacggacccgtacgttccgggtcggacgtcgggtccgggtcgacgggtacttaggttaccttttaccgctacctacctacgtacgtaccgtacgtccgtagaccgtacgggtcctaaggacgttaggtcggtaggtctttaagtttctacgttagtaacctaattaatttacttaacgttaccgtacggtacccgtccggttaccgggtacccggggaccgggtaaccgtacggtaagtaaaccgtacgtaaacgtcggtacgngggtaccncgtaccngttaccg

SEQ ID NO: 223391 - DNA, 844 bp, Homo sapiens
  misc_feature: GYAE6OF01DL2V3.40.36.D03.1.454.CMB.1.raw
tcagtctagcgactcacgaccggtgctcgatttagctgcgtcacgatctctcgttgggggctacaacaggcaggcaggggcagcaagatggtgttgcagacccaggtcttctatttctctgttgctcgtggtactctcgtggtgccgtggcggggactacgtcgtagactgacccccccccccgtagtcctaccgacgtaccctcccgtggtccgttggttcgttccgtcgtcggggacgacggaccggacccaacctactaacctaacgtcgaccgaaccgtaccgaacgtaccgtaaggttcgttttaccgtttaccaacctaccctacctagtaacgaaaccgtaaggtacgtttacgttcggtcgttacggtccgagaccgaaacggaaaccggacgggacgtaccgtacctaaccgtaacgtcgtcgtaccgttacttaacgttacccgtccggaaccctaaccgtaacccgtaaacccggtaaccgttacccggttaaccgttaccggtacgttaccggttcggttaccggtcggtacccggtacgggtaccgggtacggtacgggtacgttaacgttacgttttaccccacgtaccctaaccgtaccgtcgtaaccggtacgtcgtcggacgtaacggtcggtaacgaacgtggttacggtcgttaacgtttacggtttaacttacgttacgtaacttaacgtaagtttacttaacgttcgttaacccgtacccggtaccgtaccgggttacccgggaaccgggttaccgtaaacggttaaccggtaaactaaaccggtaaacgtcgttaacggacggtccacgtacctcgttaacg

SEQ ID NO: 223392 - DNA, 791 bp, Homo sapiens
  misc_feature: GYAE6OF01DT2Q2.40.36.D03.1.454.CMB.1.raw
tcagtctagcgactcacgaccggtgctcgatttagctgcgtcacgatctctcttggggctacaacaggcaggcaggggcagcaagatggtgttgcagacccaggtcttcatttctctgttgctctggatctctggtgcctggcgggacatcgtgatgaccctagtcctccagacctcccgtggcctgtgtctcgtgggcgacgaccggcccaccagtcaactgaccaagtccagccagtagttcgttttacactacctcgatagaaacgaaggtacgttacgttggtcctttacgggttccaacggcaaacggaaaacccgtgggaccgtaacgtccccttacctaaggcctaacggtccttacgtaacgtttttacccgaccgggtacctaaccgttacccccggaaacccgggtaacgttacccccggggttaacgtttccccggaacgtacccccggtttaaggtttccccgggtagggtaccccgtacggggttcccgggtaccggttacgggtaaacccttaggtttaactttttacccgtccgttaacccgtaaccgtacgtaccgtacggtacccgtcgtaccggacgtacggtaccgtagaaagtgttagggtacgtacgtttaacgtttacgttacgttacgttaacctaaagttaatttactttaacgttaccgtacccgttcccggtaccggtacccgggttaccgggacccgggtaacctaacgggtaacgtaaaccgtaaccgtaacgtaacgtccggtagtccgtacaccgtctacg

SEQ ID NO: 223393 - DNA, 255 bp, Homo sapiens
  misc_feature: GYAE6OF02I94EJ.40.36.D03.1.454.CMB.1.raw
  modified_base (253)..(255): a, c, t, g, unknown or other
  misc_feature (253)..(255): n is a, c, g, or t
tcagtctagcgactcacgaccggtgctcgatttagctgcgtcacgatctctctgggacagattttactctcaccatcagtagcctgcaggctgaagatgtggcagtttattactgtcaacaatattattatactccgccgacgttcggccgggggaccaacgtggaaatcaaacgaactgtggctgcaccatctgtcttcatcttcccgccatctgaagtcgctagactgagcgggctggcaaggcgcatagnnn

SEQ ID NO: 223394 - DNA, 521 bp, Homo sapiens
  misc_feature: GYAE6OF02IXHOW.40.36.D03.1.454.CMB.1.raw
  modified_base (411)..(411): a, c, t, g, unknown or other
  misc_feature (411)..(411): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaagctgctcatttactcggcatcccacccggaaatcccggagttcctgaccgattccgtggcagcgggtctgggacagattttactctcaccatcagtacgcctgcaggctgaagntgtggctagtttattactgtacaactaatatttaattactaactccgccgtacgttcgggcccggggtaaccaacggtggaaatcgaaacgactggtggctcgcacctac

SEQ ID NO: 223395 - DNA, 508 bp, Homo sapiens
  misc_feature: GYAE6OF02I7175.40.36.D03.1.454.CMB.1.raw
  modified_base (380)..(380): a, c, t, g, unknown or other
  misc_feature (380)..(380): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaagctgctcatttactcggcatccacccggaaatccggagttcctgaccgattccgtggcagcgggtctgggacagtattttacnctcaccatcagtagcctgcaggctgaagatgtgctagtttatactgtacaactaattattattatacctccgaccgtacgttcggccggggtaccaacgtggaaatcaaagactgtaggctgcactac

SEQ ID NO: 223396 - DNA, 520 bp, Homo sapiens
  misc_feature: GYAE6OF02GR3PS.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtgctagtttattactgtacaactaattattattactactccgaccgtacgttcggaccgggggtaccaacggtaggaaactcgaaacgtactggtaggctgaccactacg

SEQ ID NO: 223397 - DNA, 513 bp, Homo sapiens
  misc_feature: GYAE6OF02F5C10.40.36.D03.1.454.CMB.1.raw
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcagacggccaccatcaactgcaagtccagccagagtgtttttcacacctccatgaacaaggagtacttggcttggttccagcagaaccagggcagcctctaagctgctcatttacncggcatccaccggaaatccggagttcctgaccgattccgtggcagcgggtctgggacagtattttacnctcaccatcagtacgcctgcaggctagaagatgtggctagtttatactgtacaactattattatatactccgcgtacgttcggaccggggaaccaacggtaggaaactcgaaacgacgtgtcggctgaccactacg

SEQ ID NO: 223398 - DNA, 1111 bp, Homo sapiens
  misc_feature: GYAE6OF02IKN3W.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctcgtgggcgaggaccgccaaccatacaactcgacaacgtccagccaggtagtttcgtttttaccaacctacccttaccagttacgaaaaccgaaagggtaacgttaccggttagggtcgttttacgggtttacccaacggtaccgaaacggaaaaacccggacggggggtaccaaccgggtaccccctttaacccggttaaaacggccgtttacggtcccttaaccgttaaacgttttttaacccgttaccgggggtacccttaaaccgttacccccggtaaaaacccccggggtaaaaaccgttaccccgggggttaaaccggttttaccccgttaacccggggtaaacccccgggtttaacgttttaaccccggggtttcggggaacccggtaacggggtacccggggggtttaccccgggttacgggggggtaaacccttaaacggggttttaaacttttttttaaaccccgttaccccgtttaaccccgtaaacccccgttaaagtttaaccccggtaaacggggtttaacccgtaccccggttttacgggacccgtaaaccgggggttacccgttaaacggggtaaaacgggttaacggtttacgggggtttacgggtaacccggtttttaaagggttttttaaaccttttaaacccgggtttcgtttaaaaccccgtaaaaacggtttaaactttttaaaaacttttttaaacgttttaaacccggtttaaacccgtttacccccgggtaaccccggggtttaacccgggggtttttaccccggggggaacccccggggggggttaaaaccccgtaaaccggggttaacgggtaaaaacccgttacccggtaaaaaaacccgggtacggtttacgggttacgggtacccggttaacggtacccctaacgttaacccgg

SEQ ID NO: 223399 - DNA, 528 bp, Homo sapiens
  misc_feature: GYAE6OF02GL7M4.40.36.D03.1.454.CMB.1.raw
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
  modified_base (384)..(384): a, c, t, g, unknown or other
  misc_feature (384)..(384): n is a, c, g, or t
  modified_base (440)..(440): a, c, t, g, unknown or other
  misc_feature (440)..(440): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggagtacttggcttggttccagcagaaaccagggcagcctcctaagctgctcatttacncggcactccacccggaaatccggagttccngaccgattccgtggcaggcgggtctgggacaggtattttacnctcaccatcagtacgcctgcaggcctagaagatgtggctagtttatactgtacaanaattattatatactccgccgtacgttccgggccggggtaaccaacggtagaaactacgaacgacgttggtcgacgtcgacctctaacg

SEQ ID NO: 223400 - DNA, 728 bp, Homo sapiens
  misc_feature: GYAE6OF02F29H4.40.36.D03.1.454.CMB.1.raw
  modified_base (462)..(462): a, c, t, g, unknown or other
  misc_feature (462)..(462): n is a, c, g, or t
tcagtctagcgactcacgaccggtgctcgatttagctgcgtcacgatctctcgttgggggctacaacaggcaggcaggggcagcaagatggtgttgcagacccaggtcttcatttctctgttgctctggatctctggtgcctggcggggacatcgtgatgacccagtctccagacctccctggctggtgtctcgtgggcgaggaccggccaccatccaactgacaagtccagccagtagttcgttttcacacctccagtacgaacgaaggtagttacgttggctttcggttcccagcaaggaaaccgaggggccacggccctaccgtaagtctagcctactatttaccgcggactacgtaccccgaaccggtaaatcccgggtacgttcccgtacggtaaccgtacgtttccggaggacgtacgggtccgggtacgtacggggaactaggttacttttaccnctaccaacctacgttacgaagttaccgccttcggaccgtaggtcgtaggaacgtagttcggtaggtacttaaggttttactaacgtcgtaaccaaacttaatttaacgttttaattaacgttacccgttacccggtaacccggttaccggggttacccggggaacccggggggtaaaccctaaaccgggttaacgggtaaaaccttaaccggtaaaaccggtacggttacggtaccgggtcccgtacgtacccgtaccttaaccgg

SEQ ID NO: 223401 - DNA, 535 bp, Homo sapiens
  misc_feature: GYAE6OF02IG227.40.36.D03.1.454.CMB.1.raw
  modified_base (311)..(311): a, c, t, g, unknown or other
  misc_feature (311)..(311): n is a, c, g, or t
  modified_base (382)..(382): a, c, t, g, unknown or other
  misc_feature (382)..(382): n is a, c, g, or t
  modified_base (413)..(413): a, c, t, g, unknown or other
  misc_feature (413)..(413): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagctagagtgttttcacacctccatgaacaaggagtacttggcttggttccagcagaaaccagggcagcctcctaagctgctcatttacncggcactccaaccggaaatccggagttcctgaccgattccgtggcaggcgggtctgggacagtattttacnctcaccatcagtacgcctgcaggctagaagntgtgctagtttatacgtgtacaataatatttatactactccgccgtacgttcggaccggggtaaccaacggtacggtaaactaccgtaaaacgacgttcggtacggctacggaccacctacg

SEQ ID NO: 223402 - DNA, 545 bp, Homo sapiens
  misc_feature: GYAE6OF02F9NOS.40.36.D03.1.454.CMB.1.raw
  modified_base (382)..(382): a, c, t, g, unknown or other
  misc_feature (382)..(382): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccaccatcaactgcaagtccagccagagtgttttcacacctccatgaacaaggagtacttggcttggttccagcagaaaccagggcagcctcctaagctgctcattactcggcatccacccggaaatccggattcctgaccgattccggtgcaggccgggtctgggacagtattttaccncgtccacatcagtacgcctgcgaggctgaagagtgtcggtctagttttactacgtgtaccaataattattaacttattacctccgaccgtacggttccgggacccggggtaaccaaacggttcggaaactcgaaacggacttggtaggctacggccacgtacg

SEQ ID NO: 223403 - DNA, 511 bp, Homo sapiens
  misc_feature: GYAE6OF02JEESX.40.36.D03.1.454.CMB.1.raw
  modified_base (378)..(378): a, c, t, g, unknown or other
  misc_feature (378)..(378): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggattcctgaccgattccgtgcagcgggtctgggacagtatttacnctcaccatcagtagcctgcaggctagaagatgtgctagtttatactgtacaactaatattatatactcgccgtagttccggccgggtaaccgaacgtaggaactacgaaacgtactggtcgactgccactacg

SEQ ID NO: 223404 - DNA, 630 bp, Homo sapiens
  misc_feature: GYAE6OF02GT6YI.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcgggacatcgtgatgacccagtctccagactccctggctgtgtctcgtgggcgagacggccaccatcaactgacaagtccagccagagttgttttcacacctcatgaacaaggatactggtcgttgttccagcaagaaaccgaggcacgcctactaagctgctctatttctcggcacgtaccaacccggtaatccggacgttcctacgacccgtagttccggaggtcgtacggtcgggtcgtacgggaactaggtacttttacctctacctaaccgtattacgaagtacgtaccgtcgaccgtaggtaccttaaggaagtacgttgtacggtaccttaagttttaacttacgttcgtaactaaacgtaattaactttaacttactaccgtacccgtccgtacggttccgggaacccggggtaacctaacggtaacggaacttaaccgaaacgtacgttacggttacgcgttacggtaccaccgttacg

SEQ ID NO: 223405 - DNA, 563 bp, Homo sapiens
  misc_feature: GYAE6OF02G7XK1.40.36.D03.1.454.CMB.1.raw
  modified_base (323)..(323): a, c, t, g, unknown or other
  misc_feature (323)..(323): n is a, c, g, or t
  modified_base (398)..(398): a, c, t, g, unknown or other
  misc_feature (398)..(398): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctggcggggacatcgtgatgacccagtctccagacctccctggctgtgtctcgtgggcgagacggccaccatcaactgacaacgcccagccagtagttcgttttacacacctccatgaacaaggatacttggcttggttccagcagaaaccagggcacgcctcctaagcctgcctctatttacncggcactccaacccggaaatccggacttccgtagacccgtagttccgtgcaggcggtctgggacagtactttacnctacacctatcagtcgcctgcaggtctagaagtgagtcggatagtttacttagtcgtacaactaattatttattactaccgtccgaccggtacggttccgggacccggggtacctaacgggtagaaacgtaccgaaacgtacgtggacgtcgtcgacaccgtacg

SEQ ID NO: 223406 - DNA, 556 bp, Homo sapiens
  misc_feature: GYAE6OF02I759U.40.36.D03.1.454.CMB.1.raw
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccaccatcaactgacaacgtccagccagtagttgttttcacacctccatgaacaaggagtacttggcttggtccagcagaaccnggcagcctctaagctgctcatttcncgtcactccaaccggaactccggtagttcctgaccgtagttccgtgcaggcgggtcngggactagtactttactctcaccntacagtcnccgtagcgagcgtagagtgtgtgtacttagtttactacgtcgtaactaataattacgtttaattacgtacctacgtacccgtacgggttaccggacccggggtaactaacggtaggaaactacgaaacgtagtcggtacgcgtacgactacgtacg

SEQ ID NO: 223407 - DNA, 537 bp, Homo sapiens
  misc_feature: GYAE6OF02IEBYI.40.36.D03.1.454.CMB.1.raw
  modified_base (311)..(311): a, c, t, g, unknown or other
  misc_feature (311)..(311): n is a, c, g, or t
  modified_base (424)..(424): a, c, t, g, unknown or other
  misc_feature (424)..(424): n is a, c, g, or t
  modified_base (467)..(467): a, c, t, g, unknown or other
  misc_feature (467)..(467): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcagaccggccaccatcaactgcaagtccagccagagttgttttcacacctccatgaacaaggagtacttggcttggttccagcagaaaccagggcagcctctaagctgctcatttacncggcactccaacccggaatccggattcctgaccgtattccggtggcacggtcgggtctaggggactagtattttacgtcctacacctatcagtacgcctgcaggctagaagtntgtggactagttttacttactgtacaacgtaattattaattanacctccgaccgtacgttccggaccggggacaacggtaggaaactacgaacgtactggtgctgccactacg

SEQ ID NO: 223408 - DNA, 524 bp, Homo sapiens
  misc_feature: GYAE6OF02GYYD5.40.36.D03.1.454.CMB.1.raw
  modified_base (399)..(399): a, c, t, g, unknown or other
  misc_feature (399)..(399): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaccagggcagcctacctaagctgctcattactcggcatccacccggtaaatccggagttcctgacccgattccgtggcaggcgggtctgggacagtattttactctcacctatcagtacncctgcaggctagaagatgtgactagtttattactgtacaataattattattatactccgaccgtacgtcgggccggggtaacaacggtagaatacgtaacgacgttgtacggctacggcactacg

SEQ ID NO: 223409 - DNA, 729 bp, Homo sapiens
  misc_feature: GYAE6OF02JJ6GO.40.36.D03.1.454.CMB.1.raw
  modified_base (457)..(457): a, c, t, g, unknown or other
  misc_feature (457)..(457): n is a, c, g, or t
tcagtctagcgactcacgaccggtgctcgatttagctgcgtcacgatctctcttggggctacaacaggcaggcagggcagcaagatggtgttgcagacccaggtcttcatttctctgttgctctggatctctggtgcctggcggggacatcgtgatgacccagtctccagacctccctggctgtctctgtgggacagaccgccaccgtatccaactggacctaagtcccagccaggtactttacgttttccactacctccatagaaccaaggacgttaacttggtacttcggttccagtacaacgtaaaccgaggacctaaccgccgttacctaacgaccgtcgactactaacgttttaccgtacggcaactcccgaacccgaaacgtccggttagtcccgtagacccgtattccggtacgcgtacgcgggtactcgggactacgtacttttaaccncgttaccctactacgttacgtaagtaccgtcgtacgtcgaacgggttcttaacggaagtacgttcggttacggacttaaggtttctttaacgtccggtaactaaacgttactttaagttaactttaacgtacccgtaccggtaccggtaccggtttacggggaaccccgggggtaacctaaaggttaaccgggtaaaccttaacggtaaaacccggttaacggttcgggttaaccggaggttttaaccccggacgtaaccccgttaaccggg

SEQ ID NO: 223410 - DNA, 844 bp, Homo sapiens
  misc_feature: GYAE6OF02IREAF.40.36.D03.1.454.CMB.1.raw
  modified_base (432)..(432): a, c, t, g, unknown or other
  misc_feature (432)..(432): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtcgtctcgtcgggcgacggacggccaaccatccaacctgaccaacgtccaagccaaggtcgttagtttttaccactacctaccatacgaaccgaaaggagtacttgggtctttacgggttccacgaccaacggaaaaccgacggggacacggtccctaccgtaacggctcgcctacgtacttttaccgcggcactacccgaacccggaaactccgggacgttccgtacggtacccgtacgtttcccggnggacgtacggtccggggttctacgggggtactaagggttaccttttttaacgtccgtacctacccgtaacttacgtaaacggtaacccggtcccgttaggacccggttaagggaccgttaaacggtaaacgggtaattaccggggtttggaaccgttttaaagtttttaaccgtttaaccgttacgggttaaaccttaaaaccttaaaatttaaccgttttaaacgttttaaactttaacccggtccccgggttaaccgggtttaacccgggggtttacccggggggaacccccggggggtaaaccccgttaaacggggttaacgggtaaaaccggtttaaacccgaaaaaacggggttaccttacggggttacggacccggtttaacggaccccggttaaccttaacccgg

SEQ ID NO: 223411 - DNA, 649 bp, Homo sapiens
  misc_feature: GYAE6OF02GEVTM.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgaccagtctccagactccctggctgtgtctctgggcgagacggccaccatacaactgcaagtccaaccagagtgttttcacacctccatgaacaaggagtacttggcttggttccagcaagaaaccgacgggcacgcctcctaaagcctagcctctactttaccgtccggactactccgaaccccggtaaattcccgggaacgtttaccctaggacccggtaactttccggtaggcgtaggtccggggttcgtaggggactaacggtactttttaccgtcttaccgacctagttccgaaggttacgcctcggtccgaacgggtcttacggaagtacgttgtcggtacttagttttattacgtagttcaaacttaagttatttaattaactaccgttaccggacccgtacggttccgggacccggggtacctaacgggtaggtaaactacgaaaccgtacgtacggtacggtacctgactaccgtagttaccg

SEQ ID NO: 223412 - DNA, 592 bp, Homo sapiens
  misc_feature: GYAE6OF02GBWKC.40.36.D03.1.454.CMB.1.raw
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccaccatcaactgcaagtccagccagagttgttttcacacctccatgaacaaggatacgttggcttggttccagcaagaaaccagggcagcctactaagctgctctatttactcgacactccaaccggaatccggattccngaccgtattccgngcagcgggtcgtgggactagtacttttactctacaccatcgagtacgcctgcaggctaggaagagtggtggtaccgttagtttaacttacgtacgttacaaataactttaatttaacttaacgttaccgtcccggtaccggttaccgggttcccgggacccggggtaacctaacgggtacggtaaacttaccgaaaccggttaacgtgggtacggtaccgtcggtaccaccgtacg

SEQ ID NO: 223413 - DNA, 714 bp, Homo sapiens
  misc_feature: GYAE6OF02JJ8CK.40.36.D03.1.454.CMB.1.raw
  modified_base (344)..(344): a, c, t, g, unknown or other
  misc_feature (344)..(344): n is a, c, g, or t
tcagtctagcgactcacgaccggtgctcgatttagctgcgtcacgagttcgtcttcttggggctacaacaggcaggcagggcagcaagatggtgttgcagacccaggtcttcatttctctgttgctctggatctctggtgtcctgcggggacatcgtgatgacccagtccgtccaaggacctccctggctgtcgtcttctgggcagacgcacatcaactcgacaagtccagtccagagttgttttacactaccttccatagaacaaggacgttacttcggcttggttacccagtcaacgaaaccgtagggcacgccgttctaacgctacgctactactttaccncggtctacttacccgaacccgaaagtcccggtaagttcccgtaagtacccgtactttccgtaggacctacgggtccgggtacgtcggggtaacctacgttaacgtttttaccgacccgtacgtaaccctacgttaccggaaaggtttacccggaccttacggccgtaacggggcctttaacgggaaacgttacgttcgggttaccggaacgttaacggtttttacgttaaccgtacgttaacctaaagttaacgtttatttaacttacgttacccgtaccgtaccggttacgtttaccgggaccgggggtaacctaacggtaacggtaactacgaaacgtaccgtggtacggactcggacctacgtaacg

SEQ ID NO: 223414 - DNA, 819 bp, Homo sapiens
  misc_feature: GYAE6OF02IT49X.40.36.D03.1.454.CMB.1.raw
tcagtctagcgactcacgaccggtgctcgatttagctgcgtcacgatctctcgttgggggctacaacaggcaggcaggggcagcaagatggtgttgcagacccaggtcttcatttctctgttgctctggatctctggtgcctggcggggacatcgtgatcgacccagtctccagacctcctggctgtgtctcgtgggcgagaccgccacatcaactgacaacgtccacgaccagtagtttcgttttaccacctaccctaccagtagaaaaccgtaaggtaacgttacgttcgggtcgttttcggttaccaaggtaccgaaaacggtaaacccgaggggacaccgtcccgtaccgtaaggtcctgtaccttacgtaactttacgccggacaccgtaccccgaaaccggtaaacgtccggtacgttaccgtacggaacccgtcttccgggtaggcgtaacggtcgggtacgtacgggtaactagttaacttttacctactacgtaaaccctagtacgtaagtaccggtacctacggacgtagggtacctaaggtacggtaacggttacgggttacgttaaccggttaattttttaaacgttaccgtttagtaaaccccgttaaaagtttaaacgttttaacttttaaaactttaaacgtttaaccccgggttccccgggttaaacccgggtttacccgggggttaccgggggttaaaccccggggggtaaccttaaaccggggtaaacggtaaaaaccgttacgggtaaacccggaacggtttcgggtaccggttaccgtacgtaaccgaacccgtttacc

SEQ ID NO: 223415 - DNA, 879 bp, Homo sapiens
  misc_feature: GYAE6OF02G73LR.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctggcggggacagtcgtgatcgacccagtctccagacctccgtggctgtgtctcgtgggcgagaccgccaccatacaactgacaacgtccagccaagtagtttcgttttaccacctaccttccaagtacgaaacgaacggtacgttacgttgggtcgtttacggttaccaaggtccaaacggaaacccggaggggaccaccggtaccccttaaccgtaacggccgttacgtaccttaccttaacgttttaccgtccggtacctaaccgttaccccgaaacccgggtaaacgttaccccgggtacggtttaccccgttacggtaaccccggttacgtttcccgggtacgggtaccgtaccggggtaccggggttaccggtacgggggtaaacctttaacgggttttaacctttttacccgtcccgttaacccgtaacccttaacggttaaccgtaaccggttaccgggtacccttacggggaccgttaccggggttaccgtaagggtaaacggttacggttcgggttaaccggtacgttttaaacggttttacgttaaccgttacgttaaactaaaacgtttaatttagtttaaacgtttaccgttaacccggttacccgtacccggggtttaccgggtacccggggtaacccgggggtaaccttaacgggtaacggtaaacctaccggtaaaaccgtacgggttacggttaccgggacctacggaccgtacccttaccgg

SEQ ID NO: 223416 - DNA, 660 bp, Homo sapiens
  misc_feature: GYAE6OF02GE5TF.40.36.D03.1.454.CMB.1.raw
  modified_base (369)..(369): a, c, t, g, unknown or other
  misc_feature (369)..(369): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctcgtgggcgagaccggccaccatcaactgcaacgtccagccagtagttgtttttcacacctccatcgaacaaggagtacttggcttggttccagcaagaaaccgagggcagcctaccgtaagctgctctatttacctcggcactcccaacccggaaatccggattcctagaccgtattccgnggcaggcgggtctgggacagtattttactctcaccatcagtacgcctgcacgggtcaggtaaacgtgtggttacggacgtttaagtttttaacttacgttacgttaaccgtaaaactaaatttaacttttaaacttaacttaaccgttaccccggtacccggtaacccgggtttccgggggaaccccggggggtaaaccctaaaccgggttaacgggtaaaaccttacccggaaaaaccggtaaccggtttacgggttaccgggtacgttcggaccctaacccgttaaccg

SEQ ID NO: 223417 - DNA, 294 bp, Homo sapiens
  misc_feature: GYAE6OF02JD00D.40.36.D03.1.454.CMB.1.raw
  modified_base (226)..(226): a, c, t, g, unknown or other
  misc_feature (226)..(226): n is a, c, g, or t
  modified_base (264)..(294): a, c, t, g, unknown or other
  misc_feature (264)..(294): n is a, c, g, or t
tcagtctagcgactcacgaccggtgctcgatttagctgcgtcacgatctctctgggacagattttactctcaccatcagtagcctgcaggctgaagatgtggctagtttattactgtcaactaatattattatactccgccgacgttcggccggggaccaacggtggaaatcaaacgactgtggctgcaccatctgtcttcatccttccgccatcctagaagtccnctagactggagcgggctggcaaggcgactaagtagagnnnnnnnnnnnnnnnnnnnnnnnnnnnnnnn

SEQ ID NO: 223418 - DNA, 588 bp, Homo sapiens
  misc_feature: GYAE6OF02GMMH9.40.36.D03.1.454.CMB.1.raw
  modified_base (320)..(320): a, c, t, g, unknown or other
  misc_feature (320)..(320): n is a, c, g, or t
  modified_base (408)..(408): a, c, t, g, unknown or other
  misc_feature (408)..(408): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctggggcgagaccggccaccatcaactgacaagtccagccagagttgtttttcacacctccatgaacaaggagtacttggcttggttccagcaagaaaccgagggcacgcctcctaagctgctacatttacncggcactacccaacccggaaactccggtacgttcctacgacccgtattcccggtggctacggcgggtcgtgggactagtacttttacnctacacctatcagtacgcctgcaggctagaagtcgtgtggcttaagtttattacttgtactaactaattaactttaattacttaccgtaccgtaccgtaccgggttccgggacccggggaacgtaacggttacggaaactaccgaaacggttactaggtacggtcgacgtcgtacctacg

SEQ ID NO: 223419 - DNA, 882 bp, Homo sapiens
  misc_feature: GYAE6OF02IMZQN.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctggcgggacatcgtgatgacccagtctccagacctcccgtggctgtgtctcgtgggcagaccggccacatacaactgactaagtccagccagtagttgttttacacctacctcattacgaacgtaaggacgttacgttggtactttcgggttcccaaggtaccaacggtaaacccgaggggtaccacggtaccccgttaccgtaaggtcctacggtaccttactaacgttttaccgcggtacctaaccgttacccggtaaaccccggtaaacgttccccggggtacgtttacccgtacgggtaaccccggtaacgtttcccgggtcgggtaaccgtacggggtcggggttaccgtacgggggtaccttaacggtttaacgtttttacccgtaccgttaccgtaacccgtaacgtttaccggtaacggtaaccggtcccgttagggtaccggtaccgggttacgtttaagggaaacgtttaggttaccgggtacgggttaccttttaaacgggtttttaaccgttaaccgttaccgggtttaaaccctaaaacgttaagtttaaaccgttttaaccgttaaaccgttaccccgttacccgggttaacccgggtttacccggggtttacccggggggaacccccgggggtttaacaaaccggggtttacggtaaaccgttaaccggtaaaccggttaaccggtttccggtacggtacccgtacggtacccgtacgttaacccgg

SEQ ID NO: 223420 - DNA, 534 bp, Homo sapiens
  misc_feature: GYAE6OF02JHHLX.40.36.D03.1.454.CMB.1.raw
  modified_base (179)..(179): a, c, t, g, unknown or other
  misc_feature (179)..(179): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
  modified_base (522)..(522): a, c, t, g, unknown or other
  misc_feature (522)..(522): n is a, c, g, or t
tcagtctagcgactcacgaccggtgctcgatttagctgcgtcacgatctctcttgggggctacaacaggcaggcaggggcagcaagatggtgttgcagacccaggtcttcattttctctgttgctctggatctctggtgcctgcggggacatcgtgatgacccagtctccagactcccnggctgtgtctctgggcagacggccaccatcaactgcaagtccagccagagtgtttttacacacctccatgaacaaggactacttggcttggtccagcagaaaccngggcagcctacctaagctgctcattacncggcatccaccgtaatccgattccngaccattccgtgcagcggtcngggacagtactttactctcacatcagtacgcctgcaggctagaagtgtgtaggacttagttacttatacgtacaattaatatttaattactacgtcgtaccgtacgttacgggaccggggtaaccctaagtacggaaactacgaaacggcttaggtcggtacgngtaccataaccg

SEQ ID NO: 223421 - DNA, 662 bp, Homo sapiens
  misc_feature: GYAE6OF02H362X.40.36.D03.1.454.CMB.1.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (306)..(306): a, c, t, g, unknown or other
  misc_feature (306)..(306): n is a, c, g, or t
  modified_base (390)..(390): a, c, t, g, unknown or other
  misc_feature (390)..(390): n is a, c, g, or t
tcagtctagcgactcacgaccggtgctcgatttagctgcgtcacgatctctcttgggggctacaacaggcaggcagggggcagcaagatggtgttgcagacccaggtcttcatttctctgttgctctggatctctggtgcctggcggggacagtcgtgatcgacccagtcctccagacctcccgtggctgtgtctcgngggcgagccggccacatcaatgacaacgtccagccagtagttntttaccaccacctccatagaaacgaaggacgtacgttggtcgttcgttaccagacaacgaaccgnggcacgctactaagctgctactatttccgcgctactacccgaaaccggtaacgtccggagttccgacgaccgtacgttaccggnggacacgggtcgggtacgagggtacctaaggtttactttccgtacctaccgtacctaactaccggtaaggtaccgtccgtagtaccggacggtacgtaacggaaaggtcgttaggtcggtaaccgttagttttaaccgtcgtacgtaactaaagtaacttaagttactactaacccgtccggtccggtaccggttccggggtacccgggaacgtaacgtaaggtaacccgtaacgtaaggtacgtcggtagtacccgagtacccgacttacg

SEQ ID NO: 223422 - DNA, 703 bp, Homo sapiens
  misc_feature: GYAE6OF02HR8T4.40.36.D03.1.454.CMB.1.raw
  modified_base (162)..(162): a, c, t, g, unknown or other
  misc_feature (162)..(162): n is a, c, g, or t
  modified_base (229)..(229): a, c, t, g, unknown or other
  misc_feature (229)..(229): n is a, c, g, or t
tcagtctagcgactcacgaccggtgctcgatttagctgcgtcacgatctctcttgggggctacaacaggcaggcagggcagcaagatggtgttgcagacccaggtcttcatttctctgttgctctggatctctggtgcctggcgggacatcgtgatgacccngtctccagtacctccctggctgtgtctcgtgggcgagaccggccacatcaactgcaacgtccaaccngtagtgttttcacctcctaccatagaacaaggatacgtgtcttcggtcacgacgaagaaacccgagggcacgtaccctacgtaaacgtcgtactccgttactattttaaccgccgtacgacgtaaccctaaccccggaaaagttaccgggtaaccgttccgttaacggtacccggtaactttcccgggtacgggacgtacgggtccggttacgttacgggggacttaacgggtaacttttaccggttactaccgttaccctaacttaccgagttaaccgccggtacgttaccggacggtaccgtaggtaaagtgtaacggttcgtaacggtttaagtttagttaccgtaacggtactaaacgtaacttaactagtttaactacgtaccgtacgtcgtacggtaccgggtaaccggaacggttacgaaagtaccgttaaaccacgtacggttagccgttaggacacgtactccgg

SEQ ID NO: 223423 - DNA, 798 bp, Homo sapiens
  misc_feature: GYAE6OF02HMPMD.40.36.D03.1.454.CMB.1.raw
  modified_base (177)..(177): a, c, t, g, unknown or other
  misc_feature (177)..(177): n is a, c, g, or t
  modified_base (191)..(191): a, c, t, g, unknown or other
  misc_feature (191)..(191): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatgtgatgacccagtctccagactcccnggctgtcgtctcgnggggacgacggcggccacatccaactgaccgaacgtccagccaagtggtttacttttcacctacctcagtacgaaacgaggtagttacttggtcttcggttccagacgtaacgaaaccgaggacctacgtacctacctaagcgttacgtaccttacgtactttaccgccggacctaccgtacccgaaccggtaactccggtacgttacccgacgtaacccgttacgttccgggtacgaccggtacgggtaccgggtcgtacgggtaaccgttaacggtttaccttttaccctaccttaccgtaaaccccgtagttaccggaacgggtttactacccgtagggtaaccgtacgggtaacttaacgggaacgtacgggtttcggtaccgggtttaaggtttaaccgtttttaacttaaccggttagttaaaccgtaaactttaacgtttaacgtttaaacttttacccggaccgttaccccgggtacccggtttaccggggttacccggggaacccggggtaaaccggtaacggttaacggtaaaaccgttaacccggaaacggttacggtaccggttcgggacccttaccgggtaccctaccgttacg

SEQ ID NO: 223424 - DNA, 673 bp, Homo sapiens
  misc_feature: GYAE6OF02FLPOH.40.36.D03.1.454.CMB.1.raw
  modified_base (327)..(327): a, c, t, g, unknown or other
  misc_feature (327)..(327): n is a, c, g, or t
  modified_base (361)..(361): a, c, t, g, unknown or other
  misc_feature (361)..(361): n is a, c, g, or t
  modified_base (660)..(660): a, c, t, g, unknown or other
  misc_feature (660)..(660): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctcgtggtgcctggcgggacagtcgtgatcgacccagtcctccagacctcccgtggcttgtcgtctcggtgggcgacggccgacccgaccataccacgtgacaacgtccagccaggttgttttcgtttaccacctacctctagtacgaaacgtaagtacgttcgttcggtcgtttcgtcaagtccgaaacgaaccgnggctacgtccctagtagctgctactacgtttacncgtacactaccccggaaccgtaagtcccggtattccgacgaccggttctcggtacgcgttacgggtcggtacgtacggacttacgtttacgtttacgccttaccacgttaccgtacgtaacgtccgtccgtagaccggtggactaggtaaggtcgttagggtacgttaccttaagtttacgtacgttacgtaacttaaattacgtttaattaaccgtttacccaccggtaccgttaccgggtcgggaaccgggtacccggtaacggtaagtacgtaaacaccgtagtacggtgtaccgngacgtacctgtac

SEQ ID NO: 223425 - DNA, 691 bp, Homo sapiens
  misc_feature: GYAE6OF02JTTS0.40.36.D03.1.454.CMB.1.raw
  modified_base (514)..(514): a, c, t, g, unknown or other
  misc_feature (514)..(514): n is a, c, g, or t
tcagtctagcgactcacgaccggtgctcgatttagctgcgtcacgatctctcttgggggctacaacaggcaggcgaggggcagcaagatggtgttgcagacccgaggtcttcatttctcgttgttgctcgtggatctctggtgtccgtggcgggactagtcgtagatcgaccctagtcctccgacgtcctcccgtggtcgttgtcgttcgttcgcgggcgacggaccgaccaactagtaccacgtagaccaacgtccaacgccgtagtacgttttcgtttacacctccgtaacagtaacgaacgtacggtagttaccgttggttccgttacggccagtaacgaacgtaaaccggcgtacgaccgcctaacgtagtcctacgtccttagttaccttcgacgacctaccgtaacccgcggtaaacgtcgggtaactccgtacgacggttaccttcggcgacgtacgggtcggtcgtagggaacttagtctacgtcacctatactgtgtactccggngactacgagtacgtagagtgtcgtaagttacgttaagtcctacgtaacgtattaagttacttggtaacaacccggtccgtaacgggtcggttaaccgggtaccggtaacgaacggttaacgaaccggttaacgtacccggaggtttacccgacggttacgaccttacgtacgttacg

SEQ ID NO: 223426 - DNA, 663 bp, Homo sapiens
  misc_feature: GYAE6OF02H5OHI.40.36.D03.1.454.CMB.1.raw
  modified_base (195)..(195): a, c, t, g, unknown or other
  misc_feature (195)..(195): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctggcggggacatcgtgatcgacccagtctccagtacctccctggctgtgtctcgngggcgaggaccgccacatacaactgacaacgtccagcctagagttcgttttacaccacctcatacgaaacgaaggactacgttggtcgttcggttacagcaacggaaaccagggcacgaccctcctaagctcgctactatttaccgcggactaccgtaccgaacccggaaacgtccggtacgttcccgtacgaccgttacgtccggtcgacgtacggtccgggtagtcgggacgtaagttacttttacgtctacctaactacgttacaaaggtccgtacgttcgacgaggactacggagtacggtgtacgggtacttaagtttacgttacctaggtaacaaacttaacgttatttaaacgtactaaccgtcccggtaccggtaccggtccggggtacccgggtaaccgaaacggttacggaaactaaccggaaacgtaacgtaggtcggtacgtacgaccgacttacg

SEQ ID NO: 223427 - DNA, 741 bp, Homo sapiens
  misc_feature: GYAE6OF02HG106.40.36.D03.1.454.CMB.1.raw
  modified_base (116)..(116): a, c, t, g, unknown or other
  misc_feature (116)..(116): n is a, c, g, or t
  modified_base (729)..(729): a, c, t, g, unknown or other
  misc_feature (729)..(729): n is a, c, g, or t
tcagtctagcgactcacgaccggtgctcgatttagctgcgtcacgatctctcttgggggctacaacaggcaggcaggggcagcaagatggtgttgcagacccaggtcttcatttcnctgttgctctggatctctggtcgcctggcgggactatcgtgatcgaccagtctccagacctcctggctgtcgtctcgtagggcgacgaccggccaaccattaccaaacgtcgaccgtaaacgtccgacgtacccgtaaggtacggtttcgtttttaccacctaccctaccatacgaacgaaggtacgttacgttggtccgtttacggttaccacggactaaacggaaaccgacgggaccgaccgtacccgtaccgtaacgccgttacgcttactaacgttttaccgtaccggtacctaaccgtacccggaacccggtaacgttaccggttacgttaccgtaccgaaccggttacgttccggtacggtcggtacgggtccgggtacggtacgggtacgtaacgtttaacttttaccgtacctacgtacctagttaccaggtaccgtccgtagtacgacgtacgtacgtaagtcgtagtcggtacttacgtttattacgtacgtacgtaaacttaacgttatttaacgttactacgttccggtacgtaccgggtcgggtacccgggtaaccgtaacggtacggtaaagttaccgaacggttactaggtcgtaccncgtaccactacg

SEQ ID NO: 223428 - DNA, 745 bp, Homo sapiens
  misc_feature: GYAE6OF02IXELI.40.36.D03.1.454.CMB.1.raw
  modified_base (326)..(326): a, c, t, g, unknown or other
  misc_feature (326)..(326): n is a, c, g, or t
  modified_base (485)..(485): a, c, t, g, unknown or other
  misc_feature (485)..(485): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtcgcctggcgggacatcgtgatcgaccctagtcctccagtacctcccgtggcttgtcgtctcgtggggcgacgaccggccaccactcaactcgacacgtccacgccagtagttcgttttaccaccacctcagtacgaaacgaagggtacttacgttcggtctttacggtccagtacgaacggaaaccggngggacaccgtccttacgacgtcctgtacctacttagtttaccgacggcctacgtaccccgtaaccggtaacgtccggtacgttaccgtacggtaacccgttagttcccggtacggcgtacggcggggtacgtacgggtaactaggtttacttttacccnccgtacaccgtagtaccgtaagtaccgtccgtacggacgtacgggtactaggtaacgtgttacgggtcgtacgttagttttaactcgtttactaacgtaaacttaagtttactttaaagtttccctaaacccgggtcccggtaccgggttaccggggtaccggggtaacccggggtaaccggtaacggttaacgggtaaacccttaacggaaaccggttacgttaggtaccggtaccggtaccgacccgttacttaccgg

SEQ ID NO: 223429 - DNA, 720 bp, Homo sapiens
  misc_feature: GYAE6OF02G94AH.40.36.D03.1.454.CMB.1.raw
tcagtctagcgactcacgaccggtgctcgatttagctgcgtcacgatctctcttgggggctacaacaggcaggcagggggcagcaagatggtgttgcagacccaggtcttcatttctctgttgctctggatctctggtgcctggcggggacagtcgtgatgacccagtcctccagacctcccgtggctgtgtctcgtgggcgagaccggccaccatacaacgtgacaacgtccgacgcaggtagtttcgttttcaccacctccatacgaacaagggtatacgttggtccttcgggttaccagcaagaaccggcggacacgcctacgacgcgtcgacctacgtagtttaccgcggtactaccgtcccgaaacccggtaacgtccggtacgttccgtacggtacccgtacgttccggacggtaccgtacgggtccggggtcgtacgggactacgtttaatttccgtacctacgtacctagtaccgtagtaccgtccgtgacggtacggtcgagtaacggtagtcggtaggttacttaggttttaattaccttacggtaaactaaacgttaactttaactttaacgtttaaacgacccgttacccggtacccgggtacgggttacccggggaacccggggtaacgttaaccgggttaacggtaaacctaaccggtaaacggttaacgttcgggtaacgtcgttaaccgacccgtaacttaccg

SEQ ID NO: 223430 - DNA, 850 bp, Homo sapiens
  misc_feature: GYAE6OF02IOK6K.40.36.D03.1.454.CMB.1.raw
  modified_base (142)..(142): a, c, t, g, unknown or other
  misc_feature (142)..(142): n is a, c, g, or t
tcagtctagcgactcacgaccggtgctcgatttagctgcgtcacgatctctcttgggggctacaacaggcaggcagggggcagcaagatggtgttgcagacccgaggtcttcatttctctgttgctcgtggatctcgtggtnccgtgcgggacacgtcgtagactcgacccagtctccgacgtaccgtcccgtggtcttggtcgtccgtcggtgggacggacggaccggaccaccgtactacaactcgacgtacgtccacgacgtaagtcgtttcgttttaccaacctacccgtactaacgtaacgaaaacggtaagggtaacgttaccgttcggtaccgtttacggtaaccaacgacgtaaaccggaaaccggtcgggaccaacggtccctaacgtaacgcctacgtcttaactacgtttacgaccgtactaacccgaccgtaaaccggtaaccgttccgggtacgtttacccgtacggtaaccgttaccgttccggtacgtacggacgggttcgggtcggtacgggtaacgttacggtttaacttttaccgtaccctaccgtaacgtacgtaacggtacggtaccgtacgtacggacggtaaccggtactaacgggtaagttacggttcggtagtaacgtttagtttaacgttacgttaacgtaacgtaaaacttaacgtttaagttaaacgtttaccgtaacccgttacccggttaccggggttaaccgggtacccggggggtaaaccgggtaacccggttaaacgggttaaaccgttaaaaccggttaaacgtaaaaccggtcggttacggtaccggtacgtaaccgtacccgtaaacgtttccgg

SEQ ID NO: 223431 - DNA, 636 bp, Homo sapiens
  misc_feature: GYAE6OF02FI2Q0.40.36.D03.1.454.CMB.1.raw
  modified_base (407)..(407): a, c, t, g, unknown or other
  misc_feature (407)..(407): n is a, c, g, or t
  modified_base (451)..(451): a, c, t, g, unknown or other
  misc_feature (451)..(451): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagacctccctggctgtgtctcgtgggcgagaccggccaccatcaactgacaagtccagccagtagttcgtttttccacacctccatgaaacaaggagtacttggcttggttccagcaagaaaccaggcacgcctcctaagctgcctctatttactcggctacgtacccacccggaaatcccggagttccctagaccgtacgtccgtgctaggcggtcgtcgggactaggtattttacncgtaccaaccatacgagtacgcctagcgtaaggtctagtaaagngtgtggtacttaaggtttacttaacgtcgtaacgtaaataagtttaatttaaacttacgttaaccgtcccggtacccggttacgggtcccggggtaacccgggggtaaccctaacgggtaacgggtaaactaaccgaaaaccgtaaggttacggtacggtaccgtaccgtaccgtacccgttccg

SEQ ID NO: 223432 - DNA, 746 bp, Homo sapiens
  misc_feature: GYAE6OF02I8PQ6.40.36.D03.1.454.CMB.1.raw
  modified_base (559)..(559): a, c, t, g, unknown or other
  misc_feature (559)..(559): n is a, c, g, or t
  modified_base (568)..(568): a, c, t, g, unknown or other
  misc_feature (568)..(568): n is a, c, g, or t
  modified_base (603)..(603): a, c, t, g, unknown or other
  misc_feature (603)..(603): n is a, c, g, or t
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgcctggcgggacatcggtgatcgacctagtctccagtacctccgtggcttgtgtcctgtgggcgacgacgccacatcaagtcacacgtccagccgaagtgtttcgtttacacctacctacctatacgaaaccgtaaggtacgtacgtttcggtaccgttttcggttacccaaggtaccgtaaacggaaaaccggtacggggaccgtaacgtcccccgttaaccgtaaacgtcctacggcctttaactaacgttttaccgccggacctaacgtaccccgtaaccggtaaacggtccgggtacgttcccgtaacggtacccgttcgttcccgggtggaccgtacgggtccgggttcgtaccgggtaactaacggtttccttttacccacgttaccacctacgtactacgggtactctaccgganaccgggttntaacgtataggtcgtaggtattactttaatcgtanaacgtaattactagtttacctaacgtcctacggttaccgtacgggtccggggtaacccggggtaactaaaccgggtaacgtaaacgtaacccggtaaacgggttacgttacgggtaccgacggtccgtaactacccgttaacg

SEQ ID NO: 223433 - DNA, 925 bp, Homo sapiens
  misc_feature: GYAE6OF02FQSFG.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctctggatctctggtgccgtggcggggacatcgtgatcgacccagtcctccagactcccgtggctgtgtctcgtgggcgagaccggcccaccatacaactgacaacgtccacgaccaggtagttcgttttccacctacctccatacgaactaaaggtagttacgttcggtactttcggttccagtacgtaacggaaacccggagggtacaccggtccctaccgtaaggtccgtacgcttacgtaacttttacgtccggactacgtaccccgtaaacccggaaacgttccgggtaacgtttccccgtaacggtaacccgttacgtttacccggtcgggacccgtacggggttccggggttaccggttacgggggtaaacgttacgtttaacgttttttacccgtccccgttaactaaccccgtaagttaccgttaaaccgggtttaccgacccgttacgggtaacccgtaagggttacctaacggtaaaggttacggttaccgggtacgggttacgttttaacggttttttaacgtacccgtttaccgtaaaccgtttaaaacttaacgttttaaaacttttaacgtttaacccgtttaaccgttacccccggttaacccgggggtttaacccgggttaccccggggggggttaacccccgggggtaaacccgggttaaaccgggttaaaacccgggttaaaacccggtttaaaacccggtaaaaacccggttttaaaccggggttaccggtttaccgggggtaccccgttaccgggttaaacccctaccccggtttaaaccgg

SEQ ID NO: 223434 - DNA, 920 bp, Homo sapiens
  misc_feature: GYAE6OF02HFT0S.40.36.D03.1.454.CMB.1.raw
tcagtctagcgactcacgaccggtgctcgatttagctgcgtcacgatctctcttgggggctacaacaggcaggcaggggcagcaagatggtgttgcagacccaggtcttcatttctctgttgctcgtggatctcgtggtgcctggcgggacatcgtgatcgacccagtctaccagacctcccgtggctgtcgttcgtacgtgggacgacggaccggaccacctataccaacgtcgactaacgtccacgccgtaaggtacgtttcgttttacacctacctccgaatacgaacgaaggtacgttacgttggtccgtttacggttaccacggtacgaaaccggtaaaccggacggtaccgaaccgttccccgttaaccgtaacggtccttacgtaccttaccgttaacgtttaaccgtaccggacctaaccgtaacccggaaacccggttaaacgtacccggttaacgttccgtaaccgtaaccggttacgttccggtaggaccgtacgggtccgggttacggtacgggtaactaacgtttacctttaacctccgtaactaacccgtaaggttaccgtaacggtacgtaccggtacgacggtacggtaaccgttaaggtaacgtacggttacgggttacgttaaccgttttaacgtttaacgttaccgttaacgtaaacgttaaaactttaacgttttaactttaaacccgtttaaacccgtaaccggttaaccccgggtttaaccggggttaccccgggggttaaccccgggggtaaaaccccgggggttaaaccgttaaaaccggggtttaaaacggttaaaacccggttaaacccggaaaaacggggttttacccgtttaacgggggtaacccggttacccgttaaaccccgggttaccctaaaacccggttttacccgg

SEQ ID NO: 223435 - DNA, 950 bp, Homo sapiens
  misc_feature: GYAE6OF02F0Y09.40.36.D03.1.454.CMB.1.raw
  modified_base (116)..(116): a, c, t, g, unknown or other
  misc_feature (116)..(116): n is a, c, g, or t
  modified_base (137)..(137): a, c, t, g, unknown or other
  misc_feature (137)..(137): n is a, c, g, or t
tcagtctagcgactcacgaccggtgctcgatttagctgcgtcacgatctctcttgggggctacaacaggcaggcaggggcagcaagatggtgttgcagacccaggtcttcatttcnctgttgctctggatctctggncctgcggggacatcgtgatcgacccagtctccagacctccctggctagtcgtctcgtgggacacgtaccggccacctagtaccaacgtcgacctaaacgtccaagcccgaaggtacgttttcggtttttaccaacctacccgttaccctaagttacgaaaaccggtaaacgggtaacgtttacgtttacggggtaccttttacggggtttacccccaagggtacccgaaaaccgggtaaaaccccggtaacggggggtacctaaccgggttaccccgttaacccggtaaaacggtccgttacgttaccgtttaaccgttaaacgtttttcccggtaaccggggtacccgtaacccgttaacccccggaaaaccccgggttaaacggttaccccggggtaacgttttacccccgtacgggtaaccccggttaccggtttcccgggtaacggggaccctaacgggggttacccggggggttaccttaaccggggggaaacccgtttaacggggttttaaacctttttttaacccgggcccttaaaccccgtaaaccttacggttaacccgttaaccggttaaccggtccccgttaaggacccggttacgggtaacccttaagggtaaaacgtccggttagggttccggttaaacgtttaacgtttttaacggtccttaagttacctaaaacgttatttaacgttaacttacgttacccgtaccgttaccgggttacgggttccgggaaccgggttaccaagggtaacgtaaactaccgtaaacgtacggtcgtacgtcgtaccgacaacgtttcg

SEQ ID NO: 223436 - DNA, 232 bp, Homo sapiens
  misc_feature: GYAE6OF01ACJL6.15.12.B01.1.454.CMB.1.raw
  modified_base (228)..(232): a, c, t, g, unknown or other
  misc_feature (228)..(232): n is a, c, g, or t
tcagtctacgtagccacgaccggtgctcgatttagtagtgtagattccgcggggactattggggcccgggagccctggtcaccgtctcctcagcttccaccaagggcccatcggtcttccccctggcgccctgctccaggagcacctctgggggcacagcggccctgggctgcctggtcaaggactacttccgctacgtagactgagcgggctggcaaggcgcatagnnnnn

SEQ ID NO: 223437 - DNA, 798 bp, Homo sapiens
  misc_feature: GYAE6OF01BDC4J.15.12.B01.1.454.CMB.1.raw
  modified_base (221)..(221): a, c, t, g, unknown or other
  misc_feature (221)..(221): n is a, c, g, or t
tcagtctacgtagccacgaccggtgctcgatttagtagtgtagattcggcgggggggggtctcaggaggcagcgctctcaggacatctccaccatggcctgggctctgctgctcctcaccctcctcactcgagggcacgagggtcctgggcccagtctcgccctgactcagcctgcctcggtgtcgtcgggtctccgtggacagtcgatcatctattcttntcgactacgtggactccgagctaggtggtacggttaggtaagttaattaagtttactgttcctaccgttaaggtaacctaaactacgtaccgaggaaccaaaccgacccctaaaatctaagttacgtaattttacgaggtacggtactaacggtaacgtcccggtaccgttacgggttaacgggtttctaaaacgtcggttacctttcggtccgtaccggtccttaaccgtaacggttcgtacggaaccctaaccggtaccccgtaccccgttacccgtaagtaccccctaattcccggtaccggtttccggacccgttaccgggtacgggtacgtaacggggtaacggtaaccgggttaggttacgtttaactttaacgttcggtacgacgtaccgtcgttaactaataacggttaaaggacgggtacggaacttacggctttaccgttacgttacgttcgggttaccgggacgggtaccggaacgtacggttacccggtaccgtaccggttaccggaacgttacccgtaacccgggacccgttaacggcccggttcccccggtcccggttaccgg

SEQ ID NO: 223438 - DNA, 797 bp, Homo sapiens
  misc_feature: GYAE6OF01BISIK.15.12.B01.1.454.CMB.1.raw
  modified_base (577)..(577): a, c, t, g, unknown or other
  misc_feature (577)..(577): n is a, c, g, or t
tcagtctacgtagccacgaccggtgctcgatttagtagtgtagattcggcggggggggtctcaggaggcagcgctctcaggacatctccaccatggcctgggctctgctgctcctccaccctcctcactcagggcacgacgggtccgtcgggcccagtctcgccctgactcacgcctcgtcctccgtgtcgtgggtctcgtggcagtcgatcatctatcttctagctacgtaggctccgacgcgtacggttggtacggtttggttaagtttagttaattacgttacgtccttccgtaacggtaacccaaacgtacgtaaccccgaacggacccaaaaccccgacccccaaaacttcgtaacgttagtacgtttagtaggtaccggtacgaacggttaaccgtccggtacccgttacggttacggggttttaacctaacgttcgttccgtttccgtccgttcggtacctaaccggttacgtccggtcgaaccctaccgaccggtacccctacctccgaccgttactccgtcgtaccgggcctaccggtacgcggtagggacgggtaggtaacgggttnttacgttaacgtcgtacggtctacgtctagtaacgtgtaacggacgttaggtccgaacggttcccttaccgggttacttaccggggtcgggtttcccgggtacgggttaaccgggaacccggtcgtttacccgggacccgggttccccgtaccggttacgaccccggggtaccgtaccccgggcgtttacccgggacccccggtttcccggtaccccggg

SEQ ID NO: 223439 - DNA, 234 bp, Homo sapiens
  misc_feature: GYAE6OF02FMAXH.15.12.B01.1.454.CMB.1.raw
  modified_base (228)..(234): a, c, t, g, unknown or other
  misc_feature (228)..(234): n is a, c, g, or t
tcagtctacgtagccacgaccggtgctcgatttagtagtgtagattccgcggggactattggggcccgggagccctggtcaccgtctcctcagcttccaccaagggcccatcggtcttccccctggcgccctgctccaggagcacctctgggggcacagcggccctgggctgcctggtcaaggactacttccgctacgtagactgagcgggctggcaaggcgcatagnnnnnnn

SEQ ID NO: 223440 - DNA, 583 bp, Homo sapiens
  misc_feature: GYAE6OF02FXHY5.15.12.B01.1.454.CMB.1.raw
  modified_base (146)..(146): a, c, t, g, unknown or other
  misc_feature (146)..(146): n is a, c, g, or t
  modified_base (229)..(229): a, c, t, g, unknown or other
  misc_feature (229)..(229): n is a, c, g, or t
  modified_base (232)..(239): a, c, t, g, unknown or other
  misc_feature (232)..(239): n is a, c, g, or t
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (249)..(250): a, c, t, g, unknown or other
  misc_feature (249)..(250): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (274)..(276): a, c, t, g, unknown or other
  misc_feature (274)..(276): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
tcagtctacgtagccacgaccggtgctcgatttagtagtgtagattccgcggggactagttggggcccgggaagccctgggtcaccgtctcctcagcttccaccaagggcccatcggtcttccccctggccgccctgctccagganccacctctggggcacagcggccctgggctgcctggtcaaggactacgttccgctacgtagactgagcgggctggcaggcgcanagnnnnnnnnancnacncannacgtnatcgantcgntcngcgtannnancncgcgcncncntcncacactacacatcgctcgacgtcgtacnctnatgacgctgtactagcgacgtacgagtacgcgtacgtactacacgtcgtaacctaccgtagtacgtacgtcggtaacgcggtacttaaccggcgaacgttgtacttacgtacttaggaacttccgtaacgtactagacgtaccgtacgtcggtaacccgtgtacggtaacggtccggttacggtaacggttaacggctaccgggtaacgttccgtaggttaccgaacgtttacgggcctaaccggtgtaacccgaccgg

SEQ ID NO: 223441 - DNA, 638 bp, Homo sapiens
  misc_feature: GYAE6OF01CYGGX.41.16.B05.1.454.CMB.1.raw
  modified_base (198)..(198): a, c, t, g, unknown or other
  misc_feature (198)..(198): n is a, c, g, or t
  modified_base (343)..(343): a, c, t, g, unknown or other
  misc_feature (343)..(343): n is a, c, g, or t
  modified_base (377)..(377): a, c, t, g, unknown or other
  misc_feature (377)..(377): n is a, c, g, or t
  modified_base (418)..(418): a, c, t, g, unknown or other
  misc_feature (418)..(418): n is a, c, g, or t
tcagtctatactatcacgaccggtgctcgatttagagctcacgtaagggggagggaactgctcagttaggacccagaccggaaccagtggaagcccagcgcagcttctcttcctcctgctactctggctcccagataccactggacgacatagtgatgacgcagtctccagccaccctgtctgtgtctccgagggganaccacgccaccctctcctgccacgggccagtcagagtgttaagtaacaacttagcatcggtaccagacaagaaacctggccacgggcctcccgaggtcctcctacactctactcgtcgccgtcccacgacgggcaacgtggtacncccgagcctaggttcaggttggtcgttggggtcnggggacaggtacgttcgaacctcgtacacctatcccaaccngcctagctagtactaggtaagttagtttcgtacgttagtttacttacgtcgtactaactaattaactaaacttaacgttaggttaacttaacgttttacggaaccggtacgggtacctaacgtacgtacggtaacgtaacgtaacgaaaaccggtacgtaggtacggtacttacgacctaccgtatcgttacgtacttcctaacttcccgttcccgtacc

SEQ ID NO: 223442 - DNA, 516 bp, Homo sapiens
  misc_feature: GYAE6OF01E32L2.41.16.B05.1.454.CMB.1.raw
  modified_base (501)..(501): a, c, t, g, unknown or other
  misc_feature (501)..(501): n is a, c, g, or t
tcagtctatactatcacgaccggtgctcgatttagagctcacgtaagggggaggaactgctcagttaggacccagacggaaccatggaagccccagcgcagcttctcttcctcctgctaatctggctcccagataccactggagacatagtgatgacgcagtctccagccaccctgtctgtgtctccgaggggagacagcccaccctctcctgcagggccagtcagagtgttagtaacacttagcatggtaccagcagaaacctggccaggctcccagtctcctcatctatcgtgcgtccaccagggcaactggtactcccagccaggttcagtggcgttgggtctgggacagagttcactctcaccatccaccagcctgcagtctgaagtatttgctagtttattactgtcacctaatataatactgtactacgtttggaccgtagggaccaagctacgagatacaaacgatggtcgctgccaccattcctgtccttacncttccgttcccgacc

SEQ ID NO: 223443 - DNA, 576 bp, Homo sapiens
  misc_feature: GYAE6OF01A2IMR.41.16.B05.1.454.CMB.1.raw
  modified_base (195)..(195): a, c, t, g, unknown or other
  misc_feature (195)..(195): n is a, c, g, or t
  modified_base (359)..(359): a, c, t, g, unknown or other
  misc_feature (359)..(359): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggganacagccaccctctcctgcagggccagtcagagtgttagaacaacttgcatcggtaccagcaagaaacctggccaggcctcccaggctcctcatctatcgtgccgtccacgagggcaacgtggtactcccagcctaggttcaggtggcgttgggtctgggacagngttcactctcaccatccaccagcctgcagtctagtaagtagtttgactagtttattacttgtacctactaattaattaattaacgttcggttaacttacgttttacggaccgtaacggggtaacctaacgtctacggaacgtactaaccgaaacgtaacgtaggtcggtactacgccacctacttcttcgttaccttactacttccgttcccgtacc

SEQ ID NO: 223444 - DNA, 593 bp, Homo sapiens
  misc_feature: GYAE6OF01D6G7D.41.16.B05.1.454.CMB.1.raw
  modified_base (196)..(196): a, c, t, g, unknown or other
  misc_feature (196)..(196): n is a, c, g, or t
  modified_base (387)..(387): a, c, t, g, unknown or other
  misc_feature (387)..(387): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagcccaccctgtctgtgtctccgagggganacagcccaccctctcctgcagggccagtcagagttgttagtaacaacttagcatggtaccagcagaacctggccaggctcccaggctcctcatctatcgtcgccgtcccaccgagggacaactggtactcccagcctaggttcaggtggcgttgggtctgggacagtacgtcactctcaccagtccaaccngtcctgcagtctagtaagttatttagcttagttttacgttacttcgtacctaacctaattaattaacttaacgttacgttaacttacgttttacggaccgtaacggggaccaacgtccgtacgagtacgtaacgaaacgtaacgtggtacggtcttacgaccgtacctagttacttcgttacttactaccttccgttccccgtacc

SEQ ID NO: 223445 - DNA, 606 bp, Homo sapiens
  misc_feature: GYAE6OF01BX3IX.41.16.B05.1.454.CMB.1.raw
  modified_base (196)..(196): a, c, t, g, unknown or other
  misc_feature (196)..(196): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagcccaccctgtctgtgtctccgagggganacagcccaccctctcctgcagggccagtcagagtgttagtaacacttagcagtggtaccagacaagaaacctggaccaggcctcccgaggcctcctcatctagtcgtgccgtcccacgaggcaacgtggtactcccagcctaggttcaggtcggtcgttgggctgggacaggtacgttcactctacaacctatcccaaccgagcctgcacgtctagtaagtatttcgacttagtttattactcgtacctaactaattaataacttaacgttacggttaacttaacgtttacggaccgtaacggggaacctaacggtctacgaacgacgttaacgaaacgtaacgttggtacggtactacggtaccaaccgtacttcgttcgttacttacctacttccccgttcccgtacc

SEQ ID NO: 223446 - DNA, 644 bp, Homo sapiens
  misc_feature: GYAE6OF01AY83L.41.16.B05.1.454.CMB.1.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctcagggganacacgccaccctctcctgcagggccagtcagagtgttagaacacttagcatcggtaccngacagaaccnggccaggcctccgaggcctcctcactctagtcgtcgccgtccacgagggccaacgtggtactccccgagccgtagtcaggtcggtcgttggggtctgggactagtagttccactcctactacctctaccaccacgtccgtgctacgtgtaacgtagttatttcgacgttacgtttacttacttacgtactaactaagtaacttaacgtacgttacggttacttacggtttacggaccggtaacgggtaacctaacggtaccgttacggtaacgtacgtaaaccgaaaaccgttaacggttacgggtacggtacggtacgtacccgaacccttagttaccctttcggttacctttaccgttaccttcccgttccccggtaacc

SEQ ID NO: 223447 - DNA, 655 bp, Homo sapiens
  misc_feature: GYAE6OF01DG0TH.41.16.B05.1.454.CMB.1.raw
  modified_base (232)..(232): a, c, t, g, unknown or other
  misc_feature (232)..(232): n is a, c, g, or t
  modified_base (287)..(287): a, c, t, g, unknown or other
  misc_feature (287)..(287): n is a, c, g, or t
tcagtctatactatcacgaccggtgctcgatttagagctcacgtaagggggaggaactgctcagttaggacccagacggaaccatggaagccccagcgcagcttctcttcctcctgctactctggcctcccagactaccactggagaacatagtgatgacgcagtctccagcccaccctgtctgtgtctccgaggggagacaggcccaccctctcctgcagggccagtcagngtgttagaacacttgcagtgtaccagacagaacctggccaggcctccaggctccntatctatcgtgccgtaccaacgaggcaagtggtactcccgagcctaggttcaggttcggcgtttgggctagggactaggtacgtttccaaccgttcctacaacccgtatccgaacccgtgtccgtacgccgtacggttcgtaggtaagttagttttacgtacgttaacgttttacgttacgttacgttacctaacctaattaacttaacttaacgttacggttaaccgttaccggttttacggacccggtaacggggtaacctaaggtaccgtacggtaacgtaacgttaacgaaacgtacgttaggtacggtctacgacctaacctattaccgttacgttaccttacctacttcccgttccccgtac

SEQ ID NO: 223448 - DNA, 638 bp, Homo sapiens
  misc_feature: GYAE6OF01AZF53.41.16.B05.1.454.CMB.1.raw
  modified_base (195)..(195): a, c, t, g, unknown or other
  misc_feature (195)..(195): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccgagggganacagccaccctctcctgcagggccagtcagagtgttaagtaacaacttagcatggtaccagcaagaaacctggccaggcctcccgaggcctcctcatctagtcgtcgccgtccgacgagggcaacgtggtactcccgagtccgtaggttcagggttcggtcgggtttggggtccgtaggggactagggtacgtttccgacttccaccgacctactccaccgtacgcctgctacgtctagtaagttattttagtacttagttttacttacttacgtactaactaattaacgttaattaacgttacggttaaccttacgttttacgggaccgtacggggtaacctaacgtcgtacggaacgtactaacgaaaacgtacgttaggtcggtacgtacgacctaccgtacttacgttcgttaccttactaccttcccgttcccgtacc

SEQ ID NO: 223449 - DNA, 672 bp, Homo sapiens
  misc_feature: GYAE6OF01BT21Y.41.16.B05.1.454.CMB.1.raw
  modified_base (196)..(196): a, c, t, g, unknown or other
  misc_feature (196)..(196): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagcccaccctgtctgtgtctccgagggganacagcccaccctctcctgcgagggccagtcagagtgttagtaacaacttagcatcggtaccagcaagaacctggaccaggcctcccgaggcctcctcatctatcgtcgccgtccacgagggacaacgtgtactcccgagtcctaggttcaggtcggtcgttgggtctgggacaggtacgttcacttctaccactactccaaccgtacgtccgtcgacgtagttctaggtaagttagttttcgacgttaagttttactttacgtacgtacctaacgtaaattaacttaaacgttaacgttacggttaaccgttacggttttacgggaacccggtaacggggtaaccttaacggtaccgtacggtaagtaaccgtaaaccgaaaaccggtaacgttaggtacggaccgttacggaccctaaccgtaccgttaccgttacgtttaccctttaccgtaccttccccgttccccgtacccg

SEQ ID NO: 223450 - DNA, 830 bp, Homo sapiens
  misc_feature: GYAE6OF01BZ1GR.41.16.B05.1.454.CMB.1.raw
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccacctgtctgtgtctccgaggggacacacgcccaccctctccgtgcgaggccagtcgagtagtagttaacgtaactaacttagactagtacggtaaccagaccaacgaaaccgtcggaccaagggtccctacccgacggtcccttaccctactaacttccgtaacgttccggtaccgacccggtaccccgaaaccgggtacggggaccttaaaccggttcgggtaacccgtaccccggtaacggtacccggttaagggtttccgtaacgggggttcgggttaccgggttgggggtaccggttaggggaacctaagggttaccgttacctaccgttcctaccgtaaccctacgtacccaccgtacgtccttcggacctacgggttaactacggttaaacgtttcgttttaccgtagttttaaggttttaccgtaacgttacgtaacccgttaaacctaaagtttaaaccgtttaaacttaaccgttacgggtttaaccctttaacgggtttaccgggaacccggttaacggggaaacccttaaggtcctaacgggtaactacgtaaaccgtaaacgtaaccgttggtaccgtaccgtacgtaacccgtacgttaacgttcccgtttaacttcccttaccgccgtttccccggtccctaaacc

SEQ ID NO: 223451 - DNA, 722 bp, Homo sapiens
  misc_feature: GYAE6OF01ESOAQ.41.16.B05.1.454.CMB.1.raw
  modified_base (195)..(195): a, c, t, g, unknown or other
  misc_feature (195)..(195): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccgagggganacacgcccaccctctcctgcagggccagtcagagtagttagtaacacttagcagtcggtaccagcaagaacctggccaggcctcccgaggcctcctcatctagtcgtgccgtccaccgaggccaacgtcggtactcccgagcctaggttcaggttcggtcggtttgggtacgtggggactaggtacgttccgaacctttccgacctaacccgtactacccgaaccgtacgtcccgtacgaccgtacgttacgtaagttaacgttaacgtttttcgacctttaaacggtttttaactttaccgttacgttaaccctaaacttaaagttaacttaaactttaaccgtttacggttaaacctttaccggttttaccgggaccgggtaaacggggtaaccctaaggtacccgtacggtaagtaaccgttaaaccgaaaaccgttaaacggttggtacggtaccgtacgaccctaaccgtacgttaccgttacgtttaccttacctaaccgtttccccgttccccgtaaccg

SEQ ID NO: 223452 - DNA, 735 bp, Homo sapiens
  misc_feature: GYAE6OF01BQONS.41.16.B05.1.454.CMB.1.raw
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
tcagtctatactatcacgaccggtgctcgatttagagctcacgtaagggggaggaactgctcagttaggacccagacggaaccatggaagccccagcgcagcttctcttcctcctgctactctggctccagataccactggagacatagtgatgacgcagtctccagccaccctgtctgtgtctccgagggganacagccaccctctcctgcacgggccagtcagagtgttanaacagttagctatcggtaccagcaagaaacctggaccaggtcctcccaggcctcctcgacttctacgtcgtcgccgtaccaccgacggggactaacgttcgggtaacctcccgaggtaccccgtacgggttccgaggttcgggtccggtttggggtacccggtacggggtacgaacggtacgttccaaccgttcctaccgaacccgtactacccgtaacccgtacggtaccctacgtccgtaacgtcgtaacggtaacgtttacgttttacggtaacgtttacggttttaacctttaacgttaccggtaacccgtaacctaagtttaacttaaacgttaaccgttcggttaaaccgttaccggttttacggaacccgggtacgggtaacctaacggtccgttaccgaagtaaccgttaacgtaaaaccggtacgttacgggtcgtaccgtagacccgtactaccttcgttacgttccttacctacgttcccgtccccgtacg

SEQ ID NO: 223453 - DNA, 691 bp, Homo sapiens
  misc_feature: GYAE6OF01DABTL.41.16.B05.1.454.CMB.1.raw
  modified_base (194)..(194): a, c, t, g, unknown or other
  misc_feature (194)..(194): n is a, c, g, or t
  modified_base (465)..(465): a, c, t, g, unknown or other
  misc_feature (465)..(465): n is a, c, g, or t
tcagtctatactatcacgaccggtgctcgatttagagctcacgtaagggggaggaactgctcagttaggacccagacggaaccatggaagcccagcgcagcttctcttcctcctgctactctggctcccagataccactggagacatagtgatgacgcagtctccagccaccctgtctgtgtctccgagggganacagccaccctctcctgcagggccagtcagagtgttaagaacaacttagctagtggtaaccagacaacggaaaccgtggacccaagggcctcccgaaggtcctccctacacttcctaacttcggtcggtccgtcccgaacccgaggggtacctaaacgtcgggttaacctccccgaggccccgtaagggtttccaaggttcgggtcggttttggggtccgtaggggacctaggtacgtttccaaccgttctacccaccgtataccaacccngtacccgtcgaccgtagttctagtaaagttattttacgtacgttagttttacttacgtcgttaccaactaatttaactaaattacgttaggtacttacgtttcggaccgtacgggacctaagtcgtacgaagtaacgttacgaaacgtacgtacggtacggtactacggacctaccgtacttaccgtacggtttaccttaccgtaccttcccgttccccgtaaccg

SEQ ID NO: 223454 - DNA, 762 bp, Homo sapiens
  misc_feature: GYAE6OF01E3VAZ.41.16.B05.1.454.CMB.1.raw
  modified_base (196)..(196): a, c, t, g, unknown or other
  misc_feature (196)..(196): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccgaggggganacacgccaccctctccgtgcagggccagtcagagttgttaagaacaacttagcagtcggtaccagcaacgaacctggaccgaggctcccgaggcctacctcatcgtactcggtcgccgtaccgaccgagggtaccaaacgttcggtaacctccccgagtccctaagggttcacgggttcggtccgggtttggggtccgtagggacaggtacggttccaacgttcctaccgaacctactacccgaaccgtacgtccgtcgtacgtacgtacgttagtaaacgtttacgttttcggtacgtttaacgttttaactttacgttacgttaacctaaaccgtaaattaaacgtttaaacgttaacgttaacggttaaccgtttaccgtttttaccgggaccggtaaccggggtaaccgtaaacggtaccgttacggtaacggtaacgttaaaccgtaaaaccgggtaacgttacgggtacggttacccgtacggtaacccgtaacccgttacgttaccgtttaccgggtttacctttaccgttaccctttaccccggttccccgtaacccg

SEQ ID NO: 223455 - DNA, 863 bp, Homo sapiens
  misc_feature: GYAE6OF01EOENR.41.16.B05.1.454.CMB.1.raw
  modified_base (197)..(197): a, c, t, g, unknown or other
  misc_feature (197)..(197): n is a, c, g, or t
tcagtctatactatcacgaccggtgctcgatttagagctcacgtaagggggagaactgctcagttaggacccagacggaaccatggaagccccagcgcagcttctcttcctcctgctactctggctcccagataccactggagacatagtgatgacgcagtctccagcccaccctgtctgtcgtctaccgagggganacacgcccaccctctccgtcgcgacgggccagtcgagtagttagtaacgtaactaagttagactagtacggtaaccagaccgaacgaaacccgtcggaccaggcccttacccgaggtccctccgtactaacgtcttaacgtccggtcgacccgtacccgaccggtaacgggacctaaacggttcgtaacccgtacccgaacggtcccgtaacgggtttccgagggttccggggtaccggtttcggggaccggttacgggggaacctaagggttacccgttaccgtaacccgttcccttaacccgaacccggtaactaccccgtaacccggtaccggtccctacggtacgtacggttaccgttaacgttaaacgggttactttttacggacgtttaacggtttttaaccgttacccgttacggttaaaccctaaaccgtttaaagttaacgtttaaaaccgttaaccgtttaacgggttaaacccgttttaaccgggtttaccgggaacccgggttaaacggggtaaccccttacggttacccgtaacgggtaacgtaaacggtaaacccggaaaaccgtaccgtttacgggccgtaacctacgtaacccggtactaccgttcgttacccgtttacttaccctaccgttcccccgttcccggtaacc

SEQ ID NO: 223456 - DNA, 795 bp, Homo sapiens
  misc_feature: GYAE6OF01C8JZ0.41.16.B05.1.454.CMB.1.raw
  modified_base (145)..(145): a, c, t, g, unknown or other
  misc_feature (145)..(145): n is a, c, g, or t
  modified_base (206)..(206): a, c, t, g, unknown or other
  misc_feature (206)..(206): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
tcagtctatactatcacgaccggtgctcgatttagagctcacgtaagggggaggaactgctcagttaggacccagacggacatggaacgcccagcgcagcttctccttcctcctgctactctggcctcccagataccacgtgganacatagtgatagacgacagtcctcacgtcccacctgtctgtcgtctaccggaggggacacnccgaccctaccctctccgtgacgacgggccagtcagtagtcgtaagtaactacgtnctagtacggacngacgtaacgaacgtcgaccacggcctccgacgtcctcactatcgtacgtcgtcgccgtaccgacggacggtactacgtacgtaccctaccgacgtaccggttagtacgtacgggttcggttacggttacgggtacgacggggtacttaaccgggttacttaccccgaaccttcccgttaaaccgaccctttaacgcccccggtaaccgtaccggtcccgttacggtaaccgttagggtttaacccttaagggttaaccggttttacgttttacccgttaagttttaaccggttttaactaaccgttaccgtaaaccttaaacttaaagtttaacgtaaaccgtttacgtttaacggttaaaccgttttacggttaaccgggtaacccggtaacggtaaccgtaacgtacggttacaacgttaaaccgaaacgttaacgtcgtacgggttacgcccgtagcccgttaacgtacgttcccgttaccgttttacctcccgtttaaccttccccgttcccgtaaa

SEQ ID NO: 223457 - DNA, 827 bp, Homo sapiens
  misc_feature: GYAE6OF01A9N59.41.16.B05.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (419)..(419): a, c, t, g, unknown or other
  misc_feature (419)..(419): n is a, c, g, or t
tcagtctatactatcacgaccggtgctcgatttagagctcacgtaagggggaggaactgctcagttaggacccagacggaaccatggaacgccccagcgcagcttctcttcctctgctactctggctccagataccacgtgganacatagtgatgacgcagtctccacgccaccctgtctgtgtctccgaaggggnaccgacgtccctcctctcctagcgacgggccagttcgaaggttagtagttaacgtaaccaagttagactagtaccgtaaccagacgaacgaaccgtggccaacgggtcctcccgaggtccctaccgtcactacctgttccgtcgaccgtcccaaccggagggtacctacgtaggttacccacccgcgtaccgtggtcgtagggtcggttcgggttaggtcggnggaacgtacggtgtacctacctacctacacctaacgtcccgaacctcgtaccgtcgtacgttacgtaccgttaagttacgtttacggtttacgttaatttaacggtttttaacttacgtttaccttaaccgttaaacccgttaaagttaaacgtttaacgttaaccgggtttaaacgttttaaccggttaacccgggtttttacgggaaccccgggttaaacgggggttaacccgttaacggtaaccggttacggtaaaacccgttaaaacgtaacccgggttaaaacctaaaccgggtttaggccggttaacccgggtacctaaaccccggtaaccgtttaccgtaaccggttttcccgttttacggttaccccttaaacgtttccccccggttccccttaaaccgg

SEQ ID NO: 223458 - DNA, 506 bp, Homo sapiens
  misc_feature: GYAE6OF02HRVZN.41.16.B05.1.454.CMB.1.raw
  modified_base (194)..(194): a, c, t, g, unknown or other
  misc_feature (194)..(194): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccagggganacagccaccctctcctgcagggccagtcagagtgttagtaacacttagcatggtaccagcaagaaacctggccaggctcccaggctcctcatctatcgtgcgtccaccagggcaactggtactcccagccaggttcaggtggcgttgggtctgggacagagttcactctcacatcacccagcctgcagtctagagtatttgctagtttattacttgtcactaatataatacttagtactactttgcgagggaccaagctacgagatacaacgtaacgtgtggctgcacatctgtcttcacttccttcccgtc

SEQ ID NO: 223459 - DNA, 655 bp, Homo sapiens
  misc_feature: GYAE6OF02I1TA4.41.16.B05.1.454.CMB.1.raw
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
tcagtctatactatcacgaccggtgctcgatttagagctcacgtaagggggaggaactgctcagttaggacccagacggaaccatggaagccccagcgcagcttctcttcctcctgctactctggcctcccagataccactggagacatagtgatgacgcagtctccagccaccctgtctgtgtctccgagggganacagcccacctctccngcagggccagtcagagtgtagtaacaacttagcatggtaccagcagaaactggccaggctccaggctcctcatctatcgtgccgtccaccgagggacaacgtggtactccgagccaggttcaggtcggcggttcggggtcgtacgggactaaggtacgttccgaccgttactaccgtaaccaattcccgaaccgtacgtcccgtacgtacgtacgttctacggtaaagttacgttttcgtacttaacgttttaattaccgttacgttaaccaaccttaaagttaacttaaacttaacgttacggtaacttaacgtttcggaccgtaaggggaaccctaacgcgtacgaagtacgtaacaaaccggtaacgttcggtcggtacctaggacctaacccgtagttaccgttacgtaccgtttaccactttcccgttaccccgtacc

SEQ ID NO: 223460 - DNA, 505 bp, Homo sapiens
  misc_feature: GYAE6OF02G4VXS.41.16.B05.1.454.CMB.1.raw
  modified_base (194)..(194): a, c, t, g, unknown or other
  misc_feature (194)..(194): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgatgcagtctccagccaccctgtctgtgtctccagggganacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgtttgggtctggggacagagttcactctcaccatcaccagcctgcagtctgaagtatttgctagtttattactgtcacaatataataactgtactactttgaccgtagggaccagctacgagatacaacgacgtgtggctgacacattctgttcttctactttcccgacc

SEQ ID NO: 223461 - DNA, 595 bp, Homo sapiens
  misc_feature: GYAE6OF02IR0T7.41.16.B05.1.454.CMB.1.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
tcagtctatactatcacgaccggtgctcgatttagagctcacgtaaggggggaggaactgctcagttaggacccagacggaaccatggaagccccagcgcagcttctcttcctcctgctactctggctcccagataccactggagacatagtgatgacgcagtctccagccaccctgtctgtgtctccagggganacagccaccctctcctgcagggccagtcagagtgttagtaacaacttagcatggtaccagcagaaacctggcaggctcccagctcncatctatcgtgcgtccaccgaggggccaacgtggtactcccgagcccgtaggttcaggtggcggttggggtcgtggggactaggacgtttcacttcaccaccatccaccagccctgcagtcgtacgtaagttatttgacttagtttacttacttacgtacaactaattaactaaataacttaggtacttacgttttacggaccgtaaggggacctaacgtacgtacgtaagtactaacgtaacgtaactaggtaggtaccgtcggacctaccgtacttacgttcgttccttactaccttcccgttccctacccg

SEQ ID NO: 223462 - DNA, 617 bp, Homo sapiens
  misc_feature: GYAE6OF02FNCSP.41.16.B05.1.454.CMB.1.raw
  modified_base (195)..(195): a, c, t, g, unknown or other
  misc_feature (195)..(195): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccgagggganacagccaccctctcctgcagggccagtcagagtgttagtaacaacttagcatggtaccagcagaaacctggccaggctcccaggctcctcatctatcgtgccgtccaccgagggcaacgtggtactcccagcccaggttcaggtcggcgttggggtctggggacaggtagttccacgttctcaccatccaaccagcctgcagtctagaagtatttgactagtttacttacttcgtactaacctaattaacttaaattaacgttagttaaccttacgttttacgggaccgtaacggggtaaccctaacggtacgtacggtaagtaactaaccgaaacgtaacgtcggtacggtaccgttacgaccctaaccgtacgttccgtttcgttacctttaccgtacgtttcccgttaccccgtacccg

SEQ ID NO: 223463 - DNA, 532 bp, Homo sapiens
  misc_feature: GYAE6OF02JFFXT.41.16.B05.1.454.CMB.1.raw
  modified_base (194)..(194): a, c, t, g, unknown or other
  misc_feature (194)..(194): n is a, c, g, or t
  modified_base (278)..(278): a, c, t, g, unknown or other
  misc_feature (278)..(278): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccagggganacagccaccctctcctgcagggccagtcagagtgttagtaacacttagcatggtaccagcagaacctgccaggctccaggctcnatctatcgtgcgtccacgaggcaacgtggtactcccgagcctaggttcaggtcggtcgttgggtctggggacaggtacgttcactctacacctatccacctagtcctgctagtctagtaagtatttgactagtttacttacgtgtacactaatataatactcgtactacgtttcggaccgtagggtaccagtcgtacgagtactacaacgtacgtgtggtactcgactactatctcgtctactctcctccgtac

SEQ ID NO: 223464 - DNA, 622 bp, Homo sapiens
  misc_feature: GYAE6OF02H2DIQ.41.16.B05.1.454.CMB.1.raw
  modified_base (195)..(195): a, c, t, g, unknown or other
  misc_feature (195)..(195): n is a, c, g, or t
  modified_base (382)..(382): a, c, t, g, unknown or other
  misc_feature (382)..(382): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccgagggganacagccaccctctcctgcagggccagtcagagtgttagtaacaacttagcatggtaccagcaagaacctggccaggcctccaggcctcctcatcctatccggtgccgtcccaccaggcaactggtactcccagccaggttcaggtcggcgttgggtctgggacagtacgttccacttcgtccaaccntccaccctagcctgctagttcgtagtaagttagttttcgacgttagttttaacttacgttcgttactaacctaaattaattaaactaacgtttacggtaacttacgttttacgggacccgtaaggggtaaccctaagtccgtacggtaacgtacgtaaccgaacgtaacgtacggtcggacctacggaccctaaccattaccgttcgttacctttaccgtacttcccgttaccccgtacc

SEQ ID NO: 223465 - DNA, 547 bp, Homo sapiens
  misc_feature: GYAE6OF02HTCXI.41.16.B05.1.454.CMB.1.raw
  modified_base (194)..(194): a, c, t, g, unknown or other
  misc_feature (194)..(194): n is a, c, g, or t
  modified_base (321)..(321): a, c, t, g, unknown or other
  misc_feature (321)..(321): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccagggganacagccaccctctcctgcagggccagtcagagtgttaagtaacacttagcagtggtaccagcaagaacctggaccaggcctcccaggctcctcatctatcgtgccgtccacgagggcaactggtacncccagccaggttcagtggcgttgggtctggggacaggagttcactctcaccatccaccagcctgcagtactagtaagtatttgtctagtttattacttgtacactaaatataaattaatacgtactacgttttacggaccgtaacgggacctaagcgtcgaagtatacaacgtaacgtaggtcggtactagccactatctcgtcttcgtacttccgttcccgtacc

SEQ ID NO: 223466 - DNA, 737 bp, Homo sapiens
  misc_feature: GYAE6OF02JMS7V.41.16.B05.1.454.CMB.1.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccgagggganacgacgcccaccctctcctgcgagggcccagtcagtagtgttaagtaacacgttagcagtcggtaccagcaagaacctggccaggcctcccgaggcctccnacgtctagtcggtcgccgtccaccggaggcctaacgttcggtaactcccgaagtccccgtaaggttccgaggtcgggtcgttcggggttcctgggggaacctaggtacgtttccgacccttacgtacccaacccgtacttacccgaacccgtacggtccctacgtaccgtacgtaccgttacggtaagttacgttttacgtacgtttaacgttttacgttaaccgttacgttacctaaacccgtaattaacgttaaacgttaaacgttacggttaacctttaacggttttacgggtacccggtaacggggtaacccgttaacgtaccgttaacggtaacgtaactaccggtaaaccgtaacgtacggttacggtacctacgggtacctaaccgtacgttaccgttgttacccgttacgttaccttcccgttacccgtaccg

SEQ ID NO: 223467 - DNA, 697 bp, Homo sapiens
  misc_feature: GYAE6OF02JAADL.41.16.B05.1.454.CMB.1.raw
  modified_base (195)..(195): a, c, t, g, unknown or other
  misc_feature (195)..(195): n is a, c, g, or t
tcagtctatactatcacgaccggtgctcgatttagagctcacgtaagggggaggaactgctcagttaggacccagacggaaccatggaagcccagcgcagcttctcttcctcctgctactctggctcccagataccactggagacatagtgatgacgcagtctccagccaccctgtctgtcgtctccgagggganacagccaccctctcctgcagggccagtcagagtgttagtaacaacttagcagtggtaccagacagaaacctggaccaggcctcccgaggtcctccgtcatctatcgtgcgtccacgagggacctaacgtggtactcccgagtcctaggttcagtcggtcggttcgggtcgtaggggacaggtacgtttcaaccgttctacgacctaacgttccaacccgtaggtcccgttacgacctacggttacccgttaaggtaaaggtttacgtttttacggactttaacgttttaacgtttacgttacgttaccttaaacccgttaaagtttaaacgttaaacgttttaaaccgttacgggtttaaacctttaaccgggtttttcggaacccgggtaaacgggtaaccgtaaggtaccgtacggtaacgtaacaacgtaaacgtacgtacggtcggtactcgaacctaccgtagttaccgttcgtaccttcactttcccgtacccgtc

SEQ ID NO: 223468 - DNA, 817 bp, Homo sapiens
  misc_feature: GYAE6OF02J3AXN.41.16.B05.1.454.CMB.1.raw
tcagtctatactatcacgaccggtgctcgatttagagctcacgtaagggggaggaactgctcagttaggacccagacggaaccatggaagccccagcgcagcttctcttcctcctgctactctggcctcccagatacccacgtggagacataggtgactggaacgcacgtcctccacgccctaccctgtcttgtcgtaccgccgaagggggtacactacgccctaaccctctccgtgccgacggcctagtcagtagtacgttacgaactacgttacgctaagtcggaacacgacaacgacgtcggacgacgtcccctacgcgtcctaccgtctacttcgtagtccgtacgtccgtaccgacgcggtactaccgtacgtacctaccgaccgtacggttagttacggtcggggcggtttacccggttcgggttacggacggggtaaaccttacggttacccgttacctaacccggtcccgttaaaccctcccggtaaaccttcccgggtaaacccgcggttacccgtacggtaactaaccggttcgttaacggttaaccgttttaacggtttacgtaccctttaaagtttacccgtttaacgccgtttaaaaccgaacttaaagtttaaccgtttaaaacgtccggtttaaccgtaaccggttaccggtttacccgggaaaccggtaacgtaaccgtacgttaaccgtacgtaaacggtaacccgtaacggttaacgtccggttacggtaacccggtcttaaccgaccgttaccgtacttaccggtaccttaccgtcctacccgtaccgttccctaacg

SEQ ID NO: 223469 - DNA, 801 bp, Homo sapiens
  misc_feature: GYAE6OF02JZVH2.41.16.B05.1.454.CMB.1.raw
  modified_base (199)..(199): a, c, t, g, unknown or other
  misc_feature (199)..(199): n is a, c, g, or t
tcagtctatactatcacgaccggtgctcgatttagagctcacgtaagggggaggaactgctcagttaggacccagacggaaccatgggaagccccagcgcagcttctcttcctcctgctactctggcctcccagattacccagtggagacatagtgatgacgcagtctccagccacctgtctgtgtcctccgagggganacaggccctacccgtctccgtgcgacgggccagtcaggtagttagttaacgtaactaacgttaggctagttacgggtaacccaggccgtaaacggaaacccggtggacccgtaagggccctaaccccggaggtccctaccgtcaactttccgtacgttccgtcgtaccgtcccgaaccggtaggggaccctaaacggttcggtaacctaccccggaagtccccgttaagggttccaacgggttcgggtaccggtttacgggggttaccctagggggaacttagggttaccgtttaccgtaccgttaccgttaccaaacccgtaagtttacccgaacccgtaccggtcccgttacggaaccgttaacggtttaccgtaacgttaaggttacgttttacgtaacgtttaacgttttaacgtacgttaacgttaccgtaaccgttaaattaaccgtttaaacgttaacgttaaccggttaacttaccgggttttacgaaacccgggtacgggtaacctacggacgttacggaacgtaactacgaacgtagtcgtacggctacgtaccgtactagtcttagtaccttctaccttaccgtccgtacc

SEQ ID NO: 223470 - DNA, 663 bp, Homo sapiens
  misc_feature: GYAE6OF02JRAF6.41.16.B05.1.454.CMB.1.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
tcagtctatactatcacgaccggtgctcgatttagagctcacgtaaggggaggaacgtgctcagttaggacccagacggaaccatggaagcccagcgcagcttctcttcctcctgctactctggctcccagataccactggagacatagtgatgacgcagtctccagccacctgtctgtgtctcagggganacagccacctntctgcagggccagtcagacgtgttaacgaacaacttagctattgtaccagcagaacctggaccaggctcccgaggctctcactcgtatcgtgcgtccactagggcaactggtactcccagtccgagttcagtcggtcgttcgggctggggactacggtacgttcaacgttcgtacaacccgtagtccacccgtaagtccgtagcgtaacgttaccgtggaaaacttgtttttcggaccttaacggtttttaacgtaaccgttggttaacctaaccgtaaatttaagttaaacttaaccgttgggttaacccttacgtttttagggacccgtaaggggtaaccctaaggtccttacggtaagtaccttaaccggaacgttaacgtcggttacggtaccttcgggaaccctaaccgtacgttaccgttagttacccttaacgacgtttacccgtccccgtaac

SEQ ID NO: 223471 - DNA, 898 bp, Homo sapiens
  misc_feature: GYAE6OF02IXCIJ.41.16.B05.1.454.CMB.1.raw
  modified_base (194)..(194): a, c, t, g, unknown or other
  misc_feature (194)..(194): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccacctgtctgtgtctccgagggganacacgccaccctctcctgcgagggccagtcagtacgttgttaacgtaacctaacgttagctacgttacggtaaccaaggaccgaacggaaaaccgttcgggacccaagggtcccctaccccgaagggtccctttaccgttaagttccttaacgttccggtccggtacccgttaccccaaccggtacggggaccctaaacgttcgggttaaccctccccaacggtcccgttaagggtttccgaacgggttcggggtccgggttttaggggtacccggtagggggtaaccctagggtttaacccgtttacccgacgtttaccgtaacccctaacgtaaccgtttacccgaaacccgaccggttcccgtaccggtaccgttaacggttaccgttaacggtaaacgtttacgttttaacggtacgtttaaacgtttttacgttaaccgttaccgttaaccgttaaaccttaaaagtttaacgttaaactttaaccggttcggtttaaacccgtttaccggtttttaaccggggacccggtaaacggggtaaccctaaggttcccgttaaacggaaacggttaaacctaccggtaaaaccggtacgttaggtacccggtacgttaccgtacgtaaacccggttactttaaccgtttcggttaccctttaccggtacccgtttacccccgttacccgtaccgtttaaccg

SEQ ID NO: 223472 - DNA, 616 bp, Homo sapiens
  misc_feature: GYAE6OF02FG2FC.41.16.B05.1.454.CMB.1.raw
  modified_base (194)..(194): a, c, t, g, unknown or other
  misc_feature (194)..(194): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccagggganacagcccaccctctcctgcagggccagtcagagtgttagtaacaacttagcatggtaccagcagaaaccctggccaggcctccccgaggcctcctcactctatcgtgccgtccaccgagggccaacgtggtactccccaggccctaggtttccaggttcggtcggttggggtcgtaggggacaggtacgtttccacttcctcaccattccacccagcctgctagtctagtaagtattttgacttagtttactttacgttcgtactaacctaattaataaacgttaaccgttacggttaccttacgttttacggacccgtaacggggtaaccctaacgtccgtacgagtacgtaccgaacgtaactggtacggctacgacctacctagttcctgttaccttcgtaccgttccttacccgtacc

SEQ ID NO: 223473 - DNA, 608 bp, Homo sapiens
  misc_feature: GYAE6OF02FRJJT.41.16.B05.1.454.CMB.1.raw
  modified_base (196)..(196): a, c, t, g, unknown or other
  misc_feature (196)..(196): n is a, c, g, or t
tcagtctatactatcacgaccggtgctcgatttagagctcacgtaaggggggaggaactgctcagttaggacccagacggaaccatggaagccccagcgcagcttctcttcctcctgctactctggctcccagataccactggagacatagtgatgacgcagtctccagccaccctgtctgtgtctccgagggganacagcccaccctctcctgcacgggccagtcagagtgttagtaacacttagcagtggtaccagcagaaacctggccaggctcccgaggcctcctcatctatcgtgccgtccaccgagggacaacgtggtactcccgagccgtaggttcaggttggcgttgggctggggacagtacgttcacttcaccaacataccaccacgtcctgctagtctagtaagtatttgactagtttacttacgttactacctaacctaaattaataaacttaacttacgttaaccttacgttttacggaccgtaacggggaacctaacgtactacggaagtaactaccgaaacgtaacgttaggtcggtaccgtacgtacctacgtacttcgttacgttacttaccgtactttccctcccgtaccc

SEQ ID NO: 223474 - DNA, 753 bp, Homo sapiens
  misc_feature: GYAE6OF02JJRBD.41.16.B05.1.454.CMB.1.raw
  modified_base (196)..(196): a, c, t, g, unknown or other
  misc_feature (196)..(196): n is a, c, g, or t
tcagtctatactatcacgaccggtgctcgatttagagctcacgtaagggggaggaacgtgctcagttaggacccagacggaaccatggaagcccagcgcagcttctcttcctcctgctactctggctccagataccactggagacatagtgatgacgcagtctccagcccaccctgtctgtcgtctccgagggganacacgccaccctctcctgccgacgggcccaggtccagacgttaggttaagtaacctacgttagctaagttcgggtaaccaggaccaaggtaaaacccgtcgggacccaacggggtccctacccccggaagggtccttaccccgtactaactttaccgttaagttcccggtcggtcccgtaccccaaccggtaggggacctaaacggttacgggttactacccccgaagtaccccgtaagggtttccaggtttcggacggttttcgggggttactacggggtacagggttactttccaacttcctaccaacctacttacccgaaccgtagcccttacggacgtacgtaccgtagtaaacgtagttttcgacttaagttttacttacgttcgttaacctacctaataacttaaactacgttacgttaccgttaacgttttcggaaccgtacggggtaccaacgtacgtacgaatacgtaacgaacgtaacgtaggtggtacctcggtaaccaccgttaagtccgttcgttaccttacctacgttcccgttacccgtacc

SEQ ID NO: 223475 - DNA, 731 bp, Homo sapiens
  misc_feature: GYAE6OF02I0UKL.41.16.B05.1.454.CMB.1.raw
tcagtctatactatcacgaccggtgctcgatttagagctcacgtaagggggaggaactgctcagttaggacccagacggaaccatggaagcccagcgcagcttctcttcctcctgctactctggcctcccagtataccactggagacatagtgatgacgcagtctcagccacctgtctgtcgtaccgtccgaggggacacgacgccctacccgttctcccgtgaccgagggccctaagtcgaagtagttgttaagtaacctaaacttggacctagtcggtaaccagacaacgaaacctggaccaggtcctcccgaggcctctactatcctagttccgtcgccgttaccaaccgtaggcctaacgtcggtaactcccgtaacggtcctaggttaccgaggttcgggtcgggtttcgggtcgtaacggggtactacgggtaacgtttcccaacgttccgtaaaccaccgtactccgaactccggctacgcgtaacgttcgtaagtaacggttacttttacggactttaacgttttacgtaccttacggttaccctaaataaacgttaataaacctttacgtaacggttaacttaccggtttaccggaccgttaagggaaccttacgccttacggaacgtacgttaaaccgaacgtcgttcggaaacgtccgttacgaaccttaccgtaagttcccgtacgtttactaacccgtccgttaccgttacccggaac

SEQ ID NO: 223476 - DNA, 576 bp, Homo sapiens
  misc_feature: GYAE6OF02FPIKB.41.16.B05.1.454.CMB.1.raw
  modified_base (196)..(196): a, c, t, g, unknown or other
  misc_feature (196)..(196): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
tcagtctatactatcacgaccggtgctcgatttagagctcacgtaagggggaggaactgctcagttaggacccagacggaaccatggaagcccccagcgcagcttctcttcctcctgctactctggctcccagataccactggagacatagtgatgacgcagtctccagccaccctgtctgtgtctccgagggganacagccaccctctcctgcagggccagtcagagtgttagtaacaacttagcatggtaccagcagaacctggccaggctcccaggctcctcatctatcgtgcgtccacgagggcaacgtggtactcccgagccgtaggttcaggtggcggttggggtctggggacaggtacgttcactctcacctactccaccngtcctgctagtctagtaagtntttgactagtttacttacttcgtacctaacctaattaataattaactaggttaacttacgttttcggaccgtaacggggaacctaacggtcctacgaagtactaacgaacgtaactggtacggacctcgaccactacgttctggttccttcacttccctcccgtacc

SEQ ID NO: 223477 - DNA, 809 bp, Homo sapiens
  misc_feature: GYAE6OF02IW0HY.41.16.B05.1.454.CMB.1.raw
  modified_base (195)..(195): a, c, t, g, unknown or other
  misc_feature (195)..(195): n is a, c, g, or t
  modified_base (508)..(508): a, c, t, g, unknown or other
  misc_feature (508)..(508): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccgagggganacacgccaccctctcctgcgagggccagtcagagttgttaagtaaacctaacgttagactagtcggtaccagacaacgtaaaccgcggacccaggccctcccgacggtcccttccctacctacttacctacgttccggtcggtcccgtacccaacccggtacggggacctaaacgttcgggtaaccctaccccgacgacccgtagggttcctaaggggttcggtacggggtttggggtccgttaggggtacgtaacggtacggtttccgaccttacctaccgaaccctactacccaacccgtacgaccccgtnaacccgttacgttacgttaacggtaaagttttcttttacggacttttaagtttttaactttaccggttagttaacccgtaaaccttaaagtttaaacttaaactttaaccggttaacgggtttaaccttttacggttttacggggaacccggttaacggggtaaccgtaaccgtacgttaaaccggtagtaaacgttaaccgaaaaccggtacggttcggttacgggaccttaacggacctaacccgttgttccggttacctttccgttaaccctccttttaccccgtacccccttaacgg

SEQ ID NO: 223478 - DNA, 745 bp, Homo sapiens
  misc_feature: GYAE6OF02H8MHQ.41.16.B05.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (441)..(441): a, c, t, g, unknown or other
  misc_feature (441)..(441): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccacgtggagacatagtgatgacgcagtcctaccagcccacctgtctgtacgtctccggagggganacacgcctacccnctctgacgagggccagcagtagtagtaacgtaactaacgttaagagttacggaaccagacgaaacgaaacctgggacccgagtccaccccgtaggcctcctacgtatacgtacgtcgttcgtccgtccaccgacgggactaccgtaggtccaccgacgaccgtaggtcgaggtcgggtcggttacgggtactcgggggtactagggtacttccaacgtccccgtaanacccgttacgtcccaaaccggttccggtccgtacggtacgtaccgttccggtaaagttaacggttttacgtttagtaccgtttaacgtttttaacgttaaccgttccggttaaccttaaacctaaaacgtttattaaaacgttaaccggtttaggttaaccgtttaccggtttaccgggacggtaaccgggtaactaccggtaccgtacgtaagtaaccgaaccgtaaacgtacggttcgtaaggtcgacgtaccctagtacccttgtaccttccggttaccttacgtaccctttccgactacg

SEQ ID NO: 223479 - DNA, 670 bp, Homo sapiens
  misc_feature: GYAE6OF02HUKWJ.41.16.B05.1.454.CMB.1.raw
  modified_base (90)..(90): a, c, t, g, unknown or other
  misc_feature (90)..(90): n is a, c, g, or t
  modified_base (194)..(194): a, c, t, g, unknown or other
  misc_feature (194)..(194): n is a, c, g, or t
  modified_base (390)..(390): a, c, t, g, unknown or other
  misc_feature (390)..(390): n is a, c, g, or t
tcagtctatactatcacgaccggtgctcgatttagagctcacgtaagggggaggaactgctcagttaggacccagacggaaccatggaanccccagcgcagcttctcttcctcctgctactctggctcccagataccactggagacatagtgatgacgcagtctccagccaccctgtctgtgtctccagggganacagccaccctctcctgcgacggccagtcgagagtgttaagtaactaacttagacatcggtaccagcaagaaaccgtggaccacggcctcccgaggcctcctacactctatcgtgccgtccgacacggactaacgtggtactccgagacctaggtcaggttcggtcgggttcggtctcggggactagtaacgttcnccgttactaccgaaccaccgttaccgacccgacgtaccgtcgtacgacgttacgtagtaagttacgttttagtacgttacgtttaactttacttacgttactaacgtaactaaacttaaacttaaacgttacgttacgttacgtttacggtacgtaacgggtaccgtaacgtcgtacgtaagtactaacgtaacgtcgtaaaaaaaaggtcggtacgtacgtacctaaccgtacgttacgttacgttaccgttacgtaccttaccgttacccgttacccg

SEQ ID NO: 223480 - DNA, 759 bp, Homo sapiens
  misc_feature: GYAE6OF02FT71W.41.16.B05.1.454.CMB.1.raw
  modified_base (200)..(200): a, c, t, g, unknown or other
  misc_feature (200)..(200): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacataggtgatgacgcagtcctccacgccaccctgtctgtcgtctccggagggganacacgcccaccctctcctgcgacgggccagtacaggtagttagttaacgtaactaacttagactacgttcggtaaccagaccaacggaacccgtggaccgacggtcctaccccgagtcccgtcctactacgttcctacgttccggtcggccgttacccaccggtacgggacctaacggtacgttacctacccgacgtacccgtaggttacgtacgggtcggttacggggttcggggtacgtacggggaacgtaggttacggttacctaaccttcccgtacctaacccgtaactccccaacccgtacggtcccgttcggtaccgtaacggtacggttaacggtaagtttacgtttttcggtacgtttaacgttttacgttaccgttacgtacctaaacttaattaaacgttaacttacgttacgttaacgtttcgttaacgggaccgtagggtaaccaacgtccgtaacgtaagaccgtaacgtaacgtacgttggacggtacgtcgtaaccgtaccttgttaccgttagttacccgttatacccgttccctccctaacg

SEQ ID NO: 223481 - DNA, 659 bp, Homo sapiens
  misc_feature: GYAE6OF02FW5TO.41.16.B05.1.454.CMB.1.raw
  modified_base (196)..(196): a, c, t, g, unknown or other
  misc_feature (196)..(196): n is a, c, g, or t
tcagtctatactatcacgaccggtgctcgatttagagctcacgtaaggggggaggaactgctcagttaggacccagacggaaccatggaagccccagcgcagcttctcttcctcctgctactctggctcccagataccactggagacatagtgatgacgcagtctccagccaccctgtctgtgtctccgagggganacagcccaccctctcctgcgagggccagtcagagtgttaagtaacaacttagcagtcggtaaccagacaacgaaaccgtggaccacggtcctacccgaggtcctcctacgattctactcgtacgccgtacccaccggacgggaccaacgttcggtactccccgagcccgtaggttcgaggtcgggtcggttggggtcaggggaactaggtacgtttaccacgttctaccgaacctatacccgaccgcgtccgtacgacgtacgtacgtagtaagttacgttttacgtacgtttacgtttacttacgttacgttacctaactaaattaacgttaaacttaacgtacgttaacgttacgtttacggaccggtaacgggaacctaagtcgtacgtagtactaacgaacgtacgtacggtcgtacacgtaccacgtattcttacttactacgtacttccctcgtacc

SEQ ID NO: 223482 - DNA, 924 bp, Homo sapiens
  misc_feature: GYAE6OF02GCW22.41.16.B05.1.454.CMB.1.raw
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
tcagtctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtcncgagggganacagccaccctctcctgcgagggccagtcagagtagttaagtaacaacttagctaagtcggtaccagaccaacgaaaccgtcggaccaggcctaccccgagggtccctcctactaacgttacttacgtcgtacggtcccgttaccgaaccggagggactaacgttgggttaacctaccccgacggacccgtaaggtttaccggagggttcgggttacggttcgggggttacgtacggggtaacgtaggtacgtttaccaaccgtttccgtaccgtaaccttacgtcccgtaaaccgaccggttacccgtaggacccgtaagtttacccggttaaggtaaacggtttaccgttttacgtaacggttttaacgtttttaaacttttaccggttaccgttaaacccgttaaaccttaaaactttaaaacgtttaaaccgtttaaaaccggtttaccgggtttaaaccgtttttaacccgggttttttacggggaaaccccggggtttaaaccgggggtaaacccgttaaaccgggttaacccgttaaccggggaaaaccgttaaaccgttaaaaccccgggtaaaaacggtttaccggttaacggggttaaccgggtaccggtttaaacccgggaaccccgttaaaccggttaacccggtttaccgttttaccggtttaaccccgtttaccctttaacccgtttacccccggttaacccccccgtttaacccg

SEQ ID NO: 223483 - DNA, 799 bp, Homo sapiens
  misc_feature: GYAE6OF02F00HZ.41.16.B05.1.454.CMB.1.raw
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
  modified_base (759)..(759): a, c, t, g, unknown or other
  misc_feature (759)..(759): n is a, c, g, or t
tcagtctatactatcacgaccggtgctcgatttagagctcacgtaagggggaggaactgctcagttaggacccagacggaaccatggaagccccagcgcagcttctcttcctcctgctactctggcctcccagataccactggagacatagtgatgacgctagtcctccacgcccaccctgtctgtntacctccgagggganacacgcccaccctctcctgccgagggcctagtcaggtagttagttaacgtaaacctaacgttacggactacgtacggttaacccaggaccaaacgtaaacccgttcggacccgaacggtcccctacccggaggtcccttaccctacgaacgttccttacggtccggtacgtacccggttacccaaccgggtaacggggtacctaaacggttcgggtaaaccctcccggtaaccggtaccgttaagggtttccgaacgggtttcggggtccggggttttacggggtacggtacggggtaaaccgtacggttacggtttacctaccgttccgtacccaaacctacgttacccgaacctacggcccgttgtaccgtacgtttcgagttaacggttacgttttacgacttttaacgtttacttacgttagtaccctaaacgttaaacttaacgttaaacgttaccgttacgttaaccgtttacggtttacgggaacccggtaacgggaaccttagtaccgttaggaactaacgtaaccgtagacggttcggacgtacgacnccgtaactcgtattcgttacctacgtccttccgtcctacg

SEQ ID NO: 223484 - DNA, 696 bp, Homo sapiens
  misc_feature: GYAE6OF02HA5X6.41.16.B05.1.454.CMB.1.raw
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
  modified_base (647)..(647): a, c, t, g, unknown or other
  misc_feature (647)..(647): n is a, c, g, or t
tcagtctatactatcacgaccggtgctcgatttagagctcacgtaaggggggaggaacgtgctcagttaggacccagacggaaccatggaagccccagcgcagcttctcttcctcctgctactctggctcccagataccactggagacatagtgatgacgcagtctccagccaccctgtctgtgtctcgagggganacacgcccaccctctccngcgacgggcctagtccagagttagttacgtaaactaattagctagtacggtacacggacaacgaaaccgtcggaccacggtcctccgacgtcctcctcagttcctacgtcggtcgccgtcccgacgacgggtaccaacgttcggtaacctcccgacggtacctagggttcgagggttcgggtcggttcggggtcgtacggggaactacggttacgttacctacgtctaccaaccgtactaccgaccgtacgtcctacgcgtacgttacgtagttagttacgtttacgactttaacgtttacttacgtcgttaaccctaataaacttaagttaaacttacgttacggttaacttacggtttacggacggtaacgggtaacccgtagtaccgacgtaaacgtactaaacgtaacgttacgtacgggtcggtaacncgacctaagttacttcgttaccgttacttaccgtacgttccctacgtac

SEQ ID NO: 223485 - DNA, 510 bp, Homo sapiens
  misc_feature: GYAE6OF01AEC57.12.11.A11.1.454.CMB.1.raw
  modified_base (418)..(418): a, c, t, g, unknown or other
  misc_feature (418)..(418): n is a, c, g, or t
  modified_base (504)..(504): a, c, t, g, unknown or other
  misc_feature (504)..(504): n is a, c, g, or t
tcagatacgacgtacacgaccggtgctcgatttagctacgactgcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatcacccaggcaaagcccccagactcatgatttatgagggacaaaaacggccctcggggatttctaatcgcttctctgctccaagtctggcaacacgccctcctgacaatctctggctccaggctgaggacgaggctgattatactgctgctcatntggtaggttatagctacgttggtgttcggcggcggacctaaggtcgaccgtctaaggtcaggcccaaggtctcgccccctcggtcnctcccg

SEQ ID NO: 223486 - DNA, 533 bp, Homo sapiens
  misc_feature: GYAE6OF01B48C2.12.11.A11.1.454.CMB.1.raw
  modified_base (478)..(478): a, c, t, g, unknown or other
  misc_feature (478)..(478): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccgagggaaggggctgggagtggggtggccaacgataaagcaaagatggaagtgagaaatactatgtggactctgtgaagggccgattcacaatctccagagacaacgcaagaactcactgtatctgacaaataaacagcctagaaagccgaggacacggctgtgtatttcngtgcgaggacgtcctacggtgaactaaatttatacaaacagaactaaagttaccg

SEQ ID NO: 223487 - DNA, 513 bp, Homo sapiens
  misc_feature: GYAE6OF01BBWMZ.12.11.A11.1.454.CMB.1.raw
  modified_base (419)..(419): a, c, t, g, unknown or other
  misc_feature (419)..(419): n is a, c, g, or t
tcagatacgacgtacacgaccggtgctcgatttagctacgactgcaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatcacccaggcaaagcccccagactcatgatttatgagggacaaaaacggccctcggggatttctaatcgcttctctggctccaagtctggcaacacggcctccctgacaatctctgggctccgaggctgaggacgaggctgattattactgctgctnatatgcaggtagtggctactttcgctacgtattccgggcgggagggaccaagctggacccgtccgtacgtcacgcccaaggccgtcgtcccccg

SEQ ID NO: 223488 - DNA, 499 bp, Homo sapiens
  misc_feature: GYAE6OF01EWDGY.12.11.A11.1.454.CMB.1.raw
tcagatacgacgtacacgaccggtgctcgatttagctacgactgcaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatcacccaggcaaaagcccccagactcatgatttatgagggcaaaaaacggccctcggggatttctaatcgcttctctggctccaagtctggcaacacggcctccctgacaatctctgggctccaggctgaggacgaggctgattatactgctgctcatatgcaggtagtggcactttcgcactattcggcggagggaccaagctgaccgtctacgtcagcccaaggcctgtcccccg

SEQ ID NO: 223489 - DNA, 598 bp, Homo sapiens
  misc_feature: GYAE6OF01BZKPY.12.11.A11.1.454.CMB.1.raw
  modified_base (299)..(299): a, c, t, g, unknown or other
  misc_feature (299)..(299): n is a, c, g, or t
  modified_base (411)..(411): a, c, t, g, unknown or other
  misc_feature (411)..(411): n is a, c, g, or t
  modified_base (524)..(524): a, c, t, g, unknown or other
  misc_feature (524)..(524): n is a, c, g, or t
  modified_base (579)..(579): a, c, t, g, unknown or other
  misc_feature (579)..(579): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagcgtggtttcgtgtagctatttagaaggtgtcagtgtgaggtgcagctggtggagtcgtgggggagcgttggtccaggccgtggggggtccctgagagtctcctgtacaacctctggattcatgtttagtagtcattggatgaacgtgggtccnccgaggctaccgagggaaggggctgggagtgggtcggaccaaagagtaaagcaagagtaggaagtagaagaaatatagtgtgactgtaggtaggaagggccgtattaccaanaactcctaccgaagaacgaaccaacgtaaccaaagaacctcacttagtatctagaacaaaagtaacacgtacctaagaaacggccgaagaccgacggtctagtgttatttcgngttaggcgtaaggtaccgtccgtacggtacaaacgttaaatttacaacgaaaacngtaaacgtaagtttacccg

SEQ ID NO: 223490 - DNA, 541 bp, Homo sapiens
  misc_feature: GYAE6OF01CBVH6.12.11.A11.1.454.CMB.1.raw
  modified_base (255)..(255): a, c, t, g, unknown or other
  misc_feature (255)..(255): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (400)..(400): a, c, t, g, unknown or other
  misc_feature (400)..(400): n is a, c, g, or t
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagcggtggtttcgtgtaggctatttagaaggtgtcagtgtgaggtgcagctggtggagtcgtggggagcttggccagccgtgggggtcctgagtgtctcctgtactacctntggattctatgtttagtagtcattggatgacgtggtccgcagctccgagggaggctggagtgggcggacaacagtaaagcgaagagtggaagtgaagaataatgngtgactntggtgaaggcctattcgataatcgtacaagganaactaacgcaaagtacncattacgatcacgaaanaaacacncgacaaggaacgcgaacgcncgtnttgattnttgngtaggacgtacggtaccgtacgtagaacgtaattaacgttctaaacgaactagtaaacgtagttc

SEQ ID NO: 223491 - DNA, 563 bp, Homo sapiens
  misc_feature: GYAE6OF01CPV9B.12.11.A11.1.454.CMB.1.raw
  modified_base (336)..(336): a, c, t, g, unknown or other
  misc_feature (336)..(336): n is a, c, g, or t
  modified_base (443)..(443): a, c, t, g, unknown or other
  misc_feature (443)..(443): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagagtctcctgtacacctctggattcatgtttagtagtcattggatgaactgggtccgccaggctccgagggaaggggctggagtgggtggccaanataaagcaagatggaagtgaagaaatactatgtggactctgtgaagggccgattcacaatctaccggagacaacgccaaagaactcactgtatctgacaaataaacngacctagaaacgccgaaggacacggtctggttgtatttctggtgacggaggaccgtccgtagggtagaacttaaatttacttaccaaaaccgagaacctaaacgtttcggttacgacccg

SEQ ID NO: 223492 - DNA, 546 bp, Homo sapiens
  misc_feature: GYAE6OF01BYMR1.12.11.A11.1.454.CMB.1.raw
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctggggagtgataagtttgtctcctgtaccaacatcaccaggccaaacgcccccagactcatgatttatgagggacaaaaacggccgtacgggtattactaatcgtcttctctgctcaagtctggcaacacggcctcctagacatctcgtcggctccgagctaggacgacgaggctgtattattactgtctgctcattagtgacgtaggtagtcggtacttaccgtttcgactacgttacgttcgggacggtacgggacctaagccgtacggacccgtcgtacggtccacggacccaggtcccgtccggtcccccg

SEQ ID NO: 223493 - DNA, 705 bp, Homo sapiens
  misc_feature: GYAE6OF01CMBAF.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattgggctgagctgggttttccttgttgctattttagaaggtgtcagtgtgaggtgcagcgtgggtggaggtcggtgggggaggcgttgggtccgaggtcccggttgggggggtccctggaggagttcctcctagtaccaacctcgtggtattcattgttagtagtcagttggatgacgtcgggtccgcgacggctccggaaggggaaggggtcgtaggggacggtggggtacgacccgaaacgaagtaaaagacgaaaggagtagggaaaggtagaaagaaaatacgtaagtggtagtactgtaggtaggtaacgggcctattacaacgtaattccgaccgaaggaacgaacaaccggacccaaaagacctacgaacttgtaactacgtacgaaataaactaaaccgagaacccgtaaggaaaccggacccgtaaggaaccgacgggtcttaggttacgttatttcgagggttacgacgggtaaacggtccgttaaccgtagggttaacaaaacccttttaaagtttaccttaaaccgaaaacctaggtaaaccgttaaaggtttcccgg

SEQ ID NO: 223494 - DNA, 824 bp, Homo sapiens
  misc_feature: GYAE6OF01AGE9G.12.11.A11.1.454.CMB.1.raw
  modified_base (435)..(435): a, c, t, g, unknown or other
  misc_feature (435)..(435): n is a, c, g, or t
tcagatacgacgtacacgaccggtgctcgatttagctacgactgcagggggtctcagagaggagccttagccctggactccaaggcctttccacttggtgatcagcactgagcacagaggactcaccagtggaagttggggctgagtcgttgggttttccttgttgtcttattttagaggtgtcagtgtgaggtgcagcgtgggtggaggtcggtgggggaggtcgttcggtaccgtggtcccggtcggggggtccctggacgtacgtccttccgtacgtacctaaccgtcgtaggtactttacgatttaggtttagtacgtactagttaggtattacggtaacgttcggggtccaccggtacggtaccggtaccggaagggggtaacggggtcggtggggtaggtcgggtacggaaccaaacgaagtaaaacgngaaaggtagtaggaagtagaaagtaacttaagtagtaggtacggtactacggtaggtacggaacgggtcttaacgtaccaactacgttaccacgaagtaacgaacccgaaccgacgaaacgtacctacgtacttagttaactacgtaagaaacctaaagtaaccgacgaacgtacggaaaaccggtcgggaacgtaccgtacgggtttacttaggtttacgtttacgttgggtacgggttaacccggaccggggttaaacccgtttcccggggtaaaccggttttaacggtaaccggtttaaaaaccttttaaaacgtttacccgtaaaaccggtaaaccccgttaaaggtaaccccggttttaaaccgtttcccggtaaacccccggg

SEQ ID NO: 223495 - DNA, 535 bp, Homo sapiens
  misc_feature: GYAE6OF01BZ804.12.11.A11.1.454.CMB.1.raw
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
  modified_base (435)..(435): a, c, t, g, unknown or other
  misc_feature (435)..(435): n is a, c, g, or t
  modified_base (498)..(498): a, c, t, g, unknown or other
  misc_feature (498)..(498): n is a, c, g, or t
  modified_base (530)..(530): a, c, t, g, unknown or other
  misc_feature (530)..(530): n is a, c, g, or t
tcagatacgacgtacacgaccggtgctcgatttagctacgactgcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaacgtcccaagttaatcatttatgaggcactaagcggccctcgaggtagtttctgatcgcttctctggctcaaggctggcgaccggcctcccngacaatatctggctccnggctggaggacgaggctcattacactgctgctcattacgtggtaggtttanagctacgtttggggtgttcgggcggccgggaacaaggtcgaccgtctaagtcacgccgagtcncgcccctgtcactctcgtaccccgcctccgtntaccg

SEQ ID NO: 223496 - DNA, 655 bp, Homo sapiens
  misc_feature: GYAE6OF01A8Z5O.12.11.A11.1.454.CMB.1.raw
  modified_base (346)..(346): a, c, t, g, unknown or other
  misc_feature (346)..(346): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagagtctcctgtacaacctctggattcattgtttagtagtcattggatgaacgtgggtccgccaggcctccggaggggaggggctgggaggtggggtgaccaanataaaaggtaagagtggaagtgaagaaatactagtgtggactgtgtaggaacggggcctaattccaactaagtcctacccaagaacgaaccaaaccgaccaaagaacctcacttgtactcgtagaacaaaactaacacgtacctaagaaacgcccggaaggacccgaacgggcttaggttacgttattttaccgtgggttacggaccggtaacgggtacccgttacccgttaacgggtctaaaaccgttaaattttaacttaacccaaaacccgtaagtaaacccttaaagggttttcccgtaacccgg

SEQ ID NO: 223497 - DNA, 591 bp, Homo sapiens
  misc_feature: GYAE6OF01CITZI.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagagtctcctgtacaacctctggattcatgtttagtagtcattggatgaactgggtccgccgaggctccgaggggaaggggctgggagtggggtgaccaacgataaagcaagatggaagtgaagaaatactatgtaggactcgtggtaggaacgggccgtagttccaacaaactcctaccgaagaacgaacgaaaccgacccaaaagaacctacgaacttagtatctagaacaaataaacagcctaagaaacgaccgaggacacggctgtagttatttcgtgtgcgaggtaccgtccgtaacggagtaaactaaagtttacttacaaaccaaggaactaaaggttccg

SEQ ID NO: 223498 - DNA, 795 bp, Homo sapiens
  misc_feature: GYAE6OF01DJL9D.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattgggctgagctgggttttccttgttgctattttagaaggtgtccagtgtgaggtgcagctgggtggagtcgtggggggaggcgttggtccgaggccgtggggggtccctgagagtctcctgtacacctctggattcatgtttagtagtcattggatgaacgtgggtccgccgaggctccggagggggaacggggctggggaggtggggtcggaccaaacgagtaaagcaaaggatagggaaagtgaagtaaatactagtggtaggtaactcgtaggtaggaagggcccgtaagttaccaacgtaacttccgtaccgaaggtaacgaaacccgaaaccggaacccgtaaaacggaaaccctttaccgaacgtttacggttaacttaccgttaacggaaacctaaaaacttaaaaccgaacggtaccccgttaaaggaaaaccgggtccccgggaaagggaacccgaacgggttaccgtttacgggttacgttttaaaccgtttttccggacgggtttacgggacccgggtaaaggggttacccccgggttttaacccgttaacgggggttaactaaaccgttttaaaaacgttttttaacccgttaaacccgaaaaaacccggtaacggtaaaacccgttaaaagggtttttacccccgg

SEQ ID NO: 223499 - DNA, 537 bp, Homo sapiens
  misc_feature: GYAE6OF01EMYBJ.12.11.A11.1.454.CMB.1.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggctggggatgattaagtttgtctcctggtaccaacatcacccaggcaaacgcccccagacctcatgatttangagggacaaaaacggccctacggggtatttactaatcgcttctctgctcaagtctgcaacnccggcctcctgacaatctctcggcctccgaggctggacggacgaggctgtattattacgtgctgctnatngnagggtagtggctactttcgacgtacttacgtcggacggacggacctaaggccgtcgtacccgtccgtacgtacacgacccgaagtcccgtccgtacccccgg

SEQ ID NO: 223500 - DNA, 543 bp, Homo sapiens
  misc_feature: GYAE6OF01BED11.12.11.A11.1.454.CMB.1.raw
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccgagggaaggggctgggagtgggtggccaaacataaaagcaagatggaagtgagaaatactatgtggactctgtgaaggccgattcacaatctcagagacaacgcaagactcactgtatctgacaaataacagcctagaaagcccggaaggaccacggntggtntatttcgtgtgacgaggtacgtccgtaacggtgaactaaatttactacaaaaccagtaactaaaggtttccg

SEQ ID NO: 223501 - DNA, 599 bp, Homo sapiens
  misc_feature: GYAE6OF01EGPMP.12.11.A11.1.454.CMB.1.raw
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagagtctcctgtacaacctctggattcattgtttagtagtctattggatgaactgggtccgccgaggctccgaggggaggggctggagtgggtgccaacataaagcaagatggaagtgaagaaatactatgtgactctgtgaaggcatcanaatctacaganacaacgccaaagactcactgtactctagactaaaataacagacctagaaacgcccgaagggaccaacgggtcttggtacgttaactttcgtaggtacggacggtaacgggtccgttaccgttaacgggtgtaaaacccttaaaattttacgtaacccgaaaaccgtacgtaaacttaaacgggtttcccgtaacccg

SEQ ID NO: 223502 - DNA, 729 bp, Homo sapiens
  misc_feature: GYAE6OF01BH30B.12.11.A11.1.454.CMB.1.raw
  modified_base (327)..(327): a, c, t, g, unknown or other
  misc_feature (327)..(327): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattgggctgagcgttgggttttccttgttgtcttattttagaaggtgtccagtgtgaggtgcagcgtgggtggagtcgtgggggagtcgttggtccaggtccggttggggggtccctaggagagtcctccgtagtaccaaccgtctggtattcattgttagtagtctagttggatggtaacgtcggggtcccnccgaggccgtaccggaggggaagggctgggaggtcggggtcgaaccaaacgaagtaaaacgacgtaaaggagtaagggaaagtaggaaagtaaaagtacttaaagtggtacggacttacgtaggtacggtaaacgggacctacgttaccaacgtaacgttccaccgaaagtaaccgaaacgaaccgaacctaaaggaaccttacgaacgttagtataccgttaagaaacctaaaagtaaccgacgtaaccgtaaaggaaaccggaccgaaaggtaccggtaacggttcttagggttacttaactttcgtacgggtagtaccgggaacgttccggttacgttaacgggtagtaaaaccttaaagttttacctaaacaaaccgtaagtaacttaaacggttccg

SEQ ID NO: 223503 - DNA, 671 bp, Homo sapiens
  misc_feature: GYAE6OF01BKM7C.12.11.A11.1.454.CMB.1.raw
  modified_base (316)..(316): a, c, t, g, unknown or other
  misc_feature (316)..(316): n is a, c, g, or t
  modified_base (365)..(365): a, c, t, g, unknown or other
  misc_feature (365)..(365): n is a, c, g, or t
  modified_base (491)..(491): a, c, t, g, unknown or other
  misc_feature (491)..(491): n is a, c, g, or t
  modified_base (563)..(563): a, c, t, g, unknown or other
  misc_feature (563)..(563): n is a, c, g, or t
tcagatacgacgtacacgaccggtgctcgatttagctacgactgcaggggaggtctcagagaggagccttagccctggactccaaggcctttccacttggtgatcagcactgagcacagaggactcacatggaattgggctgagcttgggttttccttgttgcttattttagaaggtgtccagtgtgaggtgcagctggtggagtcgtgggggagcttggtccaggccggtggggggtccctggagtagtcctccgtgtacaacctcgtggattcattgtttagtagtcagttggatcggtaacgtcggggtcccnccgaggcctaccggaaggggaacgggtctgggaggtgggtcgaccaaanaagtaaagcgaagtagtaggaagtagaagtaaatacgtagtaggtcggactcgtaggtaggaacgggcctaattcaactaatcctacgaagacgaacaaccgacaaagactcactagtactacganaaactaaataaccacgtacctaaaggaaacgccggaacggaactaccggtcttagttaacgttacgtttcgngggttacgaaccggtaacggtacccgttacccggtaaaggttacgttaaaacttaaacgttttaacgtaaccaaaaaacccgtggttaaaccttaaacgggtttcccg

SEQ ID NO: 223504 - DNA, 731 bp, Homo sapiens
  misc_feature: GYAE6OF01EOIHT.12.11.A11.1.454.CMB.1.raw
  modified_base (259)..(259): a, c, t, g, unknown or other
  misc_feature (259)..(259): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaccagcagtgatggcgtgggatgataagttgtctctgtaccanatcaccagacaacgccccagactcatgtattagtggaaggaacaaaaaccggccgtagggtactttacgtaatcgtcttacgtcgtcggtactaccgtagtctcggacctaacgaccggtcccttacccgtagaacctaacgttccttacggtcgggtcctaccgacgggtcgttaggaacgggtaaccggaggtaccgttagttaactttactttacgtcgtacgttacgtaccgttactaagttacgtacggtacggtaacgggttacggtaccgggttaccgtttaacccgtttaccgtacccgttaacgtttaaccgggttcccgggggaaaccggggtaaccggggaaacccgttaacgggaccccggtttacccgggtaacccccggttaccccggtttaaccgtaccccggaacccggtaacccccgtaaaccggggtccccgttccccgggtaaccccccccgg

SEQ ID NO: 223505 - DNA, 497 bp, Homo sapiens
  misc_feature: GYAE6OF01AMW4I.12.11.A11.1.454.CMB.1.raw
  modified_base (209)..(209): a, c, t, g, unknown or other
  misc_feature (209)..(209): n is a, c, g, or t
  modified_base (480)..(497): a, c, t, g, unknown or other
  misc_feature (480)..(497): n is a, c, g, or t
tcagatacgacgtacacgaccggtgctcgatttagctacgactgcagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttcngtgcgaggacgtcctacggtgacaaatttattcaaaccagacaaagttcgttcgccaagccgtcacactactttgacagctggggccagggaaccctggtcaccgtctcctcagcctccaccaagggcccatccggtcttcccccctggccacccctcctccaagacgccaccctcgtcgggggcacacgccggcccctggggcctcgcccgtggtcaacgggacctacttccctacgtcgtatctgagcgggctggcaaggcgcatagcnnnnnnnnnnnnnnnnnn

SEQ ID NO: 223506 - DNA, 521 bp, Homo sapiens
  misc_feature: GYAE6OF01A9Z4A.12.11.A11.1.454.CMB.1.raw
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
  modified_base (498)..(498): a, c, t, g, unknown or other
  misc_feature (498)..(498): n is a, c, g, or t
tcagatacgacgtacacgaccggtgctcgatttagctacgactgcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccngcagtgatgctgggatgataagttgtctctggtaccanatcaccaggacaaacgccccagactcatgtatttatggacggacacgtaagccggcctcgtagggtttctacgtcgtcttctcgtcggctccgagtctgacacgcggcctcctgacatcgtcgtgctcgagctggagacgagcgtattatacgtgtgctacagtagtggacggtagtagtcttagttcgattcgtctaggttcggacggacggaccagcgtcgtacccgtcgtggtacncgaccgacgtcgtccgtcccccg

SEQ ID NO: 223507 - DNA, 647 bp, Homo sapiens
  misc_feature: GYAE6OF01DVQVH.12.11.A11.1.454.CMB.1.raw
  modified_base (542)..(542): a, c, t, g, unknown or other
  misc_feature (542)..(542): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagcttggtccagccgtggggggtccctgagagtctcctgtacacctctggattcattgtttagtagtctattggatgaacgtgggtcccgcgaggctccggaggggaggggctgggaggtggggtcgaccaaacaataaagcaaaggagtaggaaggtagaaagtaaatacgtagtggtggtaactcgtaggtaggaacgggcctaattacaactaatcctaccagaacgaacaacgaccaaagacctcacttagtactctagaacaaataaccagtacctaaggaaacgccggaaggaccgacggtcgttagttagttactttcggnggtacggccgggtaacgggttacccgttaccggttaagggtaacgtaaactttaaacgttttactaaacccaaaaccgtaacgtaaacgttaaacggtttcccgg

SEQ ID NO: 223508 - DNA, 678 bp, Homo sapiens
  misc_feature: GYAE6OF01B8LOW.12.11.A11.1.454.CMB.1.raw
  modified_base (246)..(246): a, c, t, g, unknown or other
  misc_feature (246)..(246): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagngtctcctgtacacctctggattcatgtttagtagtcattggatgaacgtcgggtcccgccgaggcctccggaggggaacggggctggggagtggggtcggaccaacaagtaaagacaagagtggaagtagaagaaatactagtggtggtactcgtggtaggaagggtccgtacttacaactaactcctacgaagacgaaccaaccgaccaaagacctcaacttgtactcgtagaacctaaaataaccacgtaccctaaggaaacgacccgggtaaggacccacgggtcctaggttacgtttatttccggaggttcccgggacggtacgggtacccgggttacccgttaaacggggttacgtaaaacctttaaaacgtttttaccgaaacccaaaaacccgtaaggtaaacccgttaaaacgggttttccccg

SEQ ID NO: 223509 - DNA, 838 bp, Homo sapiens
  misc_feature: GYAE6OF01CVS36.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagcttgggttttccttgttgctattttagaaggtgtccagtgtgaggtgcagctgggtggagtcggtgggggagtcgttgggtccaggcccggttggggggtccctggagacgttcctccgtagtacctaacctcgtaggtatttctagttgttttagtagttctagttggatcggtaacgtcgggtcccgccgaggtcctaccggaggggaacggggcgtggggaggtcggggtacggaccaaacgaagtaaaacgcgaaggagtaggaagtagaaagaaattacgtaagtggtacggtaacttcgtaggttaacgggaacgggtacccgtaagtttaccaaacgttaaacttcccgtaacgaaacggaacgaaaccccgaaacccgtaaccgaaaacgtaaaccttacccgtaaccgtttaggttaaaccttccgttaaacggaaaccctaaaaaaacggttaaaacccgacgggtaaacccccttaaaggggaaaaccccgggaccccgggaaaacggggtaaccccgtaacgggggttacctttagggttaacggttttactttttacccgggagggttacggacccgggtaacgggtacccctttaaccgggtaacggttacgtaaaactttaaacgtttaaccgttaaacccgaaaacgtaaggtaaaccgttaaaacggtttcccgg

SEQ ID NO: 223510 - DNA, 1121 bp, Homo sapiens
  misc_feature: GYAE6OF01DLUC1.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaagttgggctgagcgttggttttccttgttgtcttatttagaggtgtccagtgtgaggtgcagcgtggtgggagtcggtgggggaggtcgttcggtccgaggtcccggttcgggggggtccctggaggtacgttccgttccgtacggttaacctaaccgttcgttaggtaactttacctaagtttaggtttttaaggttaacggtttccttaaggtttagggtaacttacgggtaaaccggttccgggggttaccccggaccggtaacgggtaccgttacccggggaaagggggggaacgggggtaccggttagggggtagggttcgggggtaacggacccgtaaaaacgtaagtaaaaaacggcgtaaaagggaaggttagggaaaggttaggaaaagtaaaacgttaacgttaaggttacggttacggtaaccgttcggttaagggtacggggtaaaacggggttcccgttaagtttaccaaaccgttaaaccgttcccgtaaaacccgaagggaaaccgaaacccgaaacccggtaaaccccgaaaaaacggtacccccgtttaaccgtaaccggtttacgttaaaccgttaccgttaaacgtaaaacccgtaaaaaaaacggttaaaccccgtaacggtaaaccccgttaaacgggtaaaaaaccccgggcccgggtaaaacccggggaacccgttaaaccccggggtttacgttttacggggttttaacggtttttaaccgttttaccccgggttaggggtttaaccgggaacccgggggtttaaaacccccgggggtttaaccccgggtttttaaccccgggttaaaacggggggtttaaacccccgttttaaaaaaacgttttaaaaaaccggtttttttaaaacccccggttaaaaaccccgttaaaaaaacccccgggtttaaacggggttttaaaaaaccccggtttaaaaaccgggttttttaaaccccccccgggg

SEQ ID NO: 223511 - DNA, 599 bp, Homo sapiens
  misc_feature: GYAE6OF01E31YF.12.11.A11.1.454.CMB.1.raw
  modified_base (249)..(249): a, c, t, g, unknown or other
  misc_feature (249)..(249): n is a, c, g, or t
  modified_base (287)..(287): a, c, t, g, unknown or other
  misc_feature (287)..(287): n is a, c, g, or t
  modified_base (445)..(445): a, c, t, g, unknown or other
  misc_feature (445)..(445): n is a, c, g, or t
  modified_base (475)..(475): a, c, t, g, unknown or other
  misc_feature (475)..(475): n is a, c, g, or t
  modified_base (518)..(518): a, c, t, g, unknown or other
  misc_feature (518)..(518): n is a, c, g, or t
  modified_base (531)..(531): a, c, t, g, unknown or other
  misc_feature (531)..(531): n is a, c, g, or t
  modified_base (542)..(542): a, c, t, g, unknown or other
  misc_feature (542)..(542): n is a, c, g, or t
  modified_base (559)..(559): a, c, t, g, unknown or other
  misc_feature (559)..(559): n is a, c, g, or t
  modified_base (590)..(590): a, c, t, g, unknown or other
  misc_feature (590)..(590): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagcgtggtttcctgttgtcttattttagaagtgtccagtgtgaggtgcgagcgtggtggaggtcgtgggggagcgttggtccaggccggtggggggtccctgagngtctcctgtacacctctggattcattgtttagtacgtnagtttggatgaacgttggggtcccgccgaaggcctaccggaggggacggggcgtagggaggtggggtcgaccaaacgaataaagacgaagtagtggaaagtgaacgtaaatacgtaatggtagacgtcgtggtaggacggccgtaatcgaacacgtanaccagtaacaaccgaacgaccaaagtaacncctatgtaatcctaagaacaaataacgacgtccgtaaggaacnccggaaggtaccncggtataggtntactttcgagtgacggngtacgtcgtagagactaatttacgacaaagnaactgttcg

SEQ ID NO: 223512 - DNA, 687 bp, Homo sapiens
  misc_feature: GYAE6OF01CN4CF.12.11.A11.1.454.CMB.1.raw
  modified_base (359)..(359): a, c, t, g, unknown or other
  misc_feature (359)..(359): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattgggctgagcttgggttttccttgttgctattttagaaggtgtcagtgtgaggtgcagctgggtggagtcgtgggggaggtcttgggtccaggccggtcgggggggtccctggagtagtcctccgtagtacaacctctggtattcattgtttagtagtctattggatgaacgtgggtccgcgaggctccggaaggggagggctgggaggtgggtcgaccaaanataaagcaaagtagtaggaagtagaagaaaattactaagtggtacggtactcgtaggtaggaacgggtccgtattaccaactaactcctacgagaacgaccaaacgtaccaaacgaacctcaacgttagtactacgtacgaactaaaactaaacacggtaacctaacggaaacggcccgaaggaccgacgggtcttaggttagttaacgtttcgtaggtcgggtaccggtacgggttacccgttaccggtaaacgggtacgttaaaacttaaacttttacgttaaacccaaaacgtaaaccggtaaaccgttaaaaggtttaccccgg

SEQ ID NO: 223513 - DNA, 737 bp, Homo sapiens
  misc_feature: GYAE6OF01AZ7CH.12.11.A11.1.454.CMB.1.raw
  modified_base (297)..(297): a, c, t, g, unknown or other
  misc_feature (297)..(297): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggaggcttggtccagcctggggggtccctgagagtctcctgtacactctggattcatgtttagtagtcattggatgaactgggtccnccaggctccgagggagggctggagtgggtgccaagataaagcaagataggaagtgaaggaaatactagtgtaggacttcgtaggtggaaaggggcccgtaagtttaccgaacaaacgtttcccgtacccgaaggtaaacggaacccaaaacccggaccctaaaacgggaaaccttacccgtaaacctttagggttaaaccttaccgttaacggaacctaaaaataaaaccgacggtacccttaagggaaaaccggcccggtaaaggggacccgtaaccgggtccgttaggttacgtttaacgttttccgttgggtacggtaccgggtaaacgggtaccggtttaccccggttaacgggttacggtaaaacttaaaacgttttttaaccgtaacccgtaaaaacccgaacggttaaaaccgttaaaacggttttccccggg

SEQ ID NO: 223514 - DNA, 544 bp, Homo sapiens
  misc_feature: GYAE6OF01BJ24R.12.11.A11.1.454.CMB.1.raw
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccaggccgtggggggtccctgagagtctccgtgtaccaacctcgtggattcattgttagtagtcattggatgaactcggtccaccaggctccgaggggaggggctggaggtgggtgaccaacagtaaagcaagagtaggaagtagaagtaaatactagtggtgacgtgtggtaggaacgggcctattcaactaactcctacgagacgaaccaacgaccaaagaacctcaacttnatcagacaaanaacnactagaacgcgaagcagntgtntntcgtgtagcgaggtctacgtgacataattnacaaancgaatagttccg

SEQ ID NO: 223515 - DNA, 815 bp, Homo sapiens
  misc_feature: GYAE6OF01CAX7S.12.11.A11.1.454.CMB.1.raw
tcagatacgacgtacacgaccggtgctcgatttagctacgactgcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggcgtgggatgattaagtttgtctccgtaggtaccaacactaccaccaggaccaaacgcccccaagacctcatcgtaatttagtaggaacgggaaccgaaaaaaccgggtcccggtacggggtaattttaccgtaaacgttccgttacctttcctcgttacggtcccttaaccgtaacggttccgttacggaacctaaccgtacccgggtaccccttacccgtacgtaaacctaacgttccggttaccgttacggggtacccttaccgggaacgggtccgtacgggaaacgggtaccggtaacgggtaccgtttaacgttaaacgttttaacgtttaaccgtggttacccgttacggtaccttaaccgtaacgttaacgttacggtaccggttaacggggttacgttaccgggttaccctttaaccggtttaccgaaccgttaacggtttaccggttaccgggggaaccgggttaacggggaacccctaagggtcccggttaacccggtaccccggtttaacccgttaacgggtaccccaaccggtaacccccgaacgggttcccgttcccccggttacccccccgg

SEQ ID NO: 223516 - DNA, 568 bp, Homo sapiens
  misc_feature: GYAE6OF01BV6U1.12.11.A11.1.454.CMB.1.raw
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctggggatgattaagtttgtcttcctggtaccaacatccaccaggacaaacgccccagactcatgatttagaggaggacgaaaacgcccgtacgggtattctaatcgtcttctcgtgctcaagtctcgacaacaccggcctccctgactaactctcgtcgggtcctccgaggcctggacggacgaggctagtaactttagtactcgtctgtcctagatagtagactagggtagtcgtactactttcgactacgtagttccgggacgggacgggtaccaaggtcctacggtacctacccgttacgtccgtacgacccggtacggctcccggtccccccg

SEQ ID NO: 223517 - DNA, 784 bp, Homo sapiens
  misc_feature: GYAE6OF01C4J36.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggagcttggtccagtccgtggggggtccctgagagtctcctgtacaccgtctggattcattgtttagtagttctagttggatgaacgtgggtccgccgaggctccgaggggagggctgggaggtgggtcgaccaacgagtaaagcaagtacgtggaagtaggaaagtaaacgttacgtaagttacgggtacggtaaccgtccgttagggttaggaaacgggggtacccgtaagttttacccgaaactaacgttccccgttaacccgaaagggaaccggaaaccccaaacccgggaaccctaaaaacggtaaccccttaccggtaaaccgtttcggtttaaacttccgtaacggtaaaccaaaaacgttaaacccgacggtaaccccgttaagggaaaacccggccgggtaaacgggaaccgtacgggtacgtttcggttaacgtttaccgttttcggtacggttacggaccgggtaaccgggttaccgttacccggttaacgggttactaaaacgtttaaactttttaccgtaaaccaaacccgttaagtaaacccgttaaacggtttacccgg

SEQ ID NO: 223518 - DNA, 582 bp, Homo sapiens
  misc_feature: GYAE6OF01CJTVG.12.11.A11.1.454.CMB.1.raw
  modified_base (227)..(227): a, c, t, g, unknown or other
  misc_feature (227)..(227): n is a, c, g, or t
  modified_base (360)..(360): a, c, t, g, unknown or other
  misc_feature (360)..(360): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtnatgctggggatgattaagttgtctcctggtaccaacactcaccaggcaaacgccccagactacatgattagtgaaggaaccaaaaacggccgtacggggtattactaagtcgtcttctctggtctacgagtcnggacaacaccgacctcctagacctaattcgtccgtcgggtcctccgaggccttagggacggacggtaggcgttagactttagtactgtctcgctactatatcgacggaaggttgtcgtcttacgttcgactacgttacggtaccgggacgggaacggtaccaaggccgtcgtacccgtacgttaacgtcgaaccggcccaacggtccctcccggtacccccg

SEQ ID NO: 223519 - DNA, 731 bp, Homo sapiens
  misc_feature: GYAE6OF01DZ4P5.12.11.A11.1.454.CMB.1.raw
  modified_base (524)..(524): a, c, t, g, unknown or other
  misc_feature (524)..(524): n is a, c, g, or t
tcagatacgacgtacacgaccggtgctcgatttagctacgactgcagggggaggtctcagagaggagccttagccctggactccaaggcctttccacttggtgatcagcactgagcacagaggactcaccatggaagttgggctgagtcttgggttttccttgttgcttattttagaggtgtcagtgtgaggtgcagctggtggagtcgtgggggagcgttggtccgacggtccggtgggggggtccctggacgtagttcctccgttacggtaacctaaccgttcgtaggtatttctaagtttgttttaagtagttctagtttaggtaagtggaacgttcggggtcccgaccgacgggtccgtaccggaaggggggaaggggtccgtggggtaggttggggtacggacccaaacgaataaaagcgaagtagtaggaagtagaaagaaattcgtaagtggtggtactgtagtaggtaacggctacgtacactaacgtcacgagaacgacaacgacaagtaacctnacttagacttacgtagaactaaaatacgacgtacccgtaaggaaaccgccgggaacgtaccaacgggtacttggtttacttgtttccggtggtacggccgggtaaccggtcccgtttaaccggtaacgggttaacgtaaacctttaaaaagtttttactaaacccccgaaaattaccgggtaaaacgttaaacccggttttcccggg

SEQ ID NO: 223520 - DNA, 827 bp, Homo sapiens
  misc_feature: GYAE6OF01BJY7U.12.11.A11.1.454.CMB.1.raw
tcagatacgacgtacacgaccggtgctcgatttagctacgactgcagggggtctcagagaggagccttagccctggactccaaggcctttccacttggtgatcagcactgagcacagagactcaccagtggaattgggctgagcgttgggttttccttgttgcttattttagaaggtgtccagtgtgaggtgcagctgggtggagtcgtgggggagtcgttcggtccgaggcccggttcggggggtcccctaggaggtacgttcctccgttagtaacctaaccgtcgtggtacttctagttgttttaagtacgttactagttggactacgtaacgttcgggtaccccgaccgaggtccgttaccgggaagggggtacgggtcggttaggggagggttcggggtacggaccctaaacgtaaagttaaacgacgtaaaggtaagtaggggaagtaacggaaagtaaaacgttaacgttagttagggtacgtaaccgttgtacgggtaacggtaaccgggtacctaagttaccgtaaacctacgttccctaacccggaacggtaacggaaaacccaacccggaaaccgtaaaacggtaaaccctcggtaacgtttgttaaacgttccgtaaacggaaactaaaaacgtaaaccgtacggtaaccctaaggaaaaccggcccggaaacgggtaaccgtaccggttacgttaaggttacgtttaactttcgggtagtcgggaccgtacgggttacccgtagttaaacggtactaaacttaaacgttttacgaaaccctaaactaaagtacgttaaaccggtttcgtaaaccc

SEQ ID NO: 223521 - DNA, 707 bp, Homo sapiens
  misc_feature: GYAE6OF01B9HNK.12.11.A11.1.454.CMB.1.raw
  modified_base (297)..(297): a, c, t, g, unknown or other
  misc_feature (297)..(297): n is a, c, g, or t
tcagatacgacgtacacgaccggtgctcgatttagctacgactgcagggggggtcacaagaggcagcgctctcgggacgtctccaccatggcctgggctctgctgctcctcactctcctcactcaggacacagggtcctgggcccagtcctgccctgactcagcctgcctcgtgtctgggtctcctggacagtcgatcaccatctcctagccactcggaaccagcagtgatgctgggatgataagttgtctcgtgtacacactaccaccagacaaacgccccagactcatgatttanagaggaacgaaaaacggcccgtagggtatttcgtaactcgtccttcgtctacggcctaccgtaacgtcgtacggaccaaacgaccggtccctacccgtacggtaactaacctcgttaccggtcgggtacccttaccgaagggtcctagggaacggtaccggagggtacctaggtaacgtttaacttaaccgtcgtacggttacgtacttacctaagttacgtcgggtaaccgtaaggggttacggtacgggttaccttaccggtttaccgtaaccgttacgttacggttaccggggaccgggtaaccgggtaaccgtaaggtccccggtaccgtacccccgggttacctttaacccgggtaccgaacccggttaccccgaacgggttccccgtacccggtccccccccgg

SEQ ID NO: 223522 - DNA, 554 bp, Homo sapiens
  misc_feature: GYAE6OF01DSB3A.12.11.A11.1.454.CMB.1.raw
  modified_base (303)..(303): a, c, t, g, unknown or other
  misc_feature (303)..(303): n is a, c, g, or t
  modified_base (484)..(484): a, c, t, g, unknown or other
  misc_feature (484)..(484): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaggtgtccagtgtgaggtgcagctgggtggagtcgtggggggaggcttggtccaggccgtggggggtccctgagagtctcctgtacacctctggattcattgtttagtagtcattggatgaactgggtccncaggctccgagggagggctggagtgggtgcaacataaagcaagatggaagtgaagaaatactatgtggactcgtgtggaagggccattcaactaatcctacagacacaacgaccaaagactcatgtactctagacaaataacagtacctagaaacgccgaggacacggctagtgttattcnggtcgcggtaggacgttaccgtaggtactaaactaaatttctaacaaacctaagtaactaacggttaccg

SEQ ID NO: 223523 - DNA, 662 bp, Homo sapiens
  misc_feature: GYAE6OF01EW2I5.12.11.A11.1.454.CMB.1.raw
  modified_base (541)..(541): a, c, t, g, unknown or other
  misc_feature (541)..(541): n is a, c, g, or t
tcagatacgacgtacacgaccggtgctcgatttagctacgactgcgaggggggggtcacaagaggcagcgctctcgggacgtctccaccagtggcctgggctctgctgctcctcactctcctcactcaggacacgacgggtcctgggcccagtctgccctgacctcagcctgcctccgtgtctgggtctcctggacagtcgatcacatctcctgcacgtggaacccagccaggtgagtggcgtggggagtgattaaggtttcgtctccgtaggtaccaacataccaaccaggaccaaacgcccccagacctctagtgtatttagtacggaacggtaactaaaaaccggcccgttacggggtaactttacgtaaacgtccgtactttacgtccgttcggtcctaccggtaacgttcgtcggacctaaccgtacccggcccttcccgagtacctaacgttccgtacgtcgggtacctaccgaggtcggtggaacgggacggagggtccgtaggttatttaacgttcgtacgtcgtagtcctanagtacgtagacgtagggttacgtcggtctaccgttcgactacggttactcgggacggtaccggacgtacgtcgtccggtaccgtcctacgtcgaccgacgaccggtctcccggtacccccg

SEQ ID NO: 223524 - DNA, 764 bp, Homo sapiens
  misc_feature: GYAE6OF01BIZRW.12.11.A11.1.454.CMB.1.raw
  modified_base (237)..(237): a, c, t, g, unknown or other
  misc_feature (237)..(237): n is a, c, g, or t
tcagatacgacgtacacgaccggtgctcgatttagctacgactgcgaggggggggtcacgaagaggcagcgctctcgggacgtctccaccatggcctggctctgctgctcctcactctcctcactcaggacacgagggtcctgggcccagtctgccctagactcagcctgcctccgtgtcctgggtcctcgtggactagtcgactccaccgtatcctccgtgcgaccgtaggaaccngctacggtgaatggcgtagggagtgtagttaagttgtcctacgtacgtaaccaccactacccgaccgtacggacctaacccggcccacgtactctagtgtactttgacggaacggaaccgtaaaaccggtcggtacggtaacttacgtaacgtccgtcctcgtcgtcgcctacgagttaccgtacggtaccaccgtaccgtccaccgtagtactacgtcgtccggtacgggtccttaaccgggacggtacgttcggaaacggtccggtaggtacctttaggtactttaaccggttagtaccggttcgtacgttcccgtagtaacgtaggtaccggttaggtaacgggtccgggtttacgtacggttccgtttaaccggaccgttaaccgggttaccgttaccggggaaccccgggttaaaccggggtacccttaaggtcccgggttaaccctaccccggttaaccccgtacggttacccgaacccggtaaccgttacccgggtccccgtccccggggttaacccccg

SEQ ID NO: 223525 - DNA, 578 bp, Homo sapiens
  misc_feature: GYAE6OF01CMALB.12.11.A11.1.454.CMB.1.raw
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
  modified_base (390)..(391): a, c, t, g, unknown or other
  misc_feature (390)..(391): n is a, c, g, or t
  modified_base (419)..(419): a, c, t, g, unknown or other
  misc_feature (419)..(419): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctcgccctgactcagcctgcctccgtgtctggtctcctggacagtcgatccaccgtctcctgcacgtgggaccagtaatgtatttagtaatttgacctgtctctggaaccaacaactacccggacaaacgtccctaagttactactattagngacggcactagccgcctgagtagtttcntactctcttctcgtgctcgngtcgngcaacgcgcctcnacatctgtgactcgagtcngagnnggacgtctagttattattacgtgtacgnaagtccgtaggtcggacctacgtacccgtacccgtggtaccgggtcgggtacgggttaggttcggtaccgggacgggtaacggccgtaaggtccgttacgacccggttcgagtacgccgtaccgacgccgtacccgtcccgtagtccctcgtctccccg

SEQ ID NO: 223526 - DNA, 704 bp, Homo sapiens
  misc_feature: GYAE6OF01CT336.12.11.A11.1.454.CMB.1.raw
  modified_base (346)..(346): a, c, t, g, unknown or other
  misc_feature (346)..(346): n is a, c, g, or t
tcagatacgacgtacacgaccggtgctcgatttagctacgactgcagggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcttggtccagcccgtggggggtccctgagagtctcctgtacacctctggattcattgtttagtagtcagttggatgacgtgggtccgccgaggctccggaggggagggctgggaggtgggtgaccaanagtaaagcaagagtaggaagtagaagtaaatactagtggtggactcgtggtaggaacgggtccaattccaacgtaactccgtaccgaaggaacgaacccaaacggacccaaagaacccttacaccgttagtaactcgtaagaaccaaaacgttaaccacggtccctaagggaaaacgcccgggtaaggaaccgtaccgggtacgttaggttacgttaacttttccggtggttaccggaccgggtaaacggggttaccccgttacccggttaaacggggtaacgttaaaacctttaaaagtttttaacccaacccaaaaacccgttaaggtaaaaccccttaaagggttttacccccgg

SEQ ID NO: 223527 - DNA, 875 bp, Homo sapiens
  misc_feature: GYAE6OF01CR78D.12.11.A11.1.454.CMB.1.raw
  modified_base (650)..(650): a, c, t, g, unknown or other
  misc_feature (650)..(650): n is a, c, g, or t
tcagatacgacgtacacgaccggtgctcgatttagctacgactgcagggggaggtctcagagaggagccttagccctggactccaaggcctttccacttggtgatcagcactgagcacagagactcaccatggaattgggctgagcgttgggttttccttgttgctattttagaggtgtccagtgtgaggtgcagcgtggtggagtcggtgggggaggtcgttcggtacccgaggtcccggttcgggggggtccctaggaggtacgttccttccgtagtacctaaccgtcgtggtacttcgtagttgttttagtagttctaagtttggaattaggaaccgtcggggtcccgccgtacggccgtaccgggaagggggtacggggtcgtaggggtagggtcggggtacggaacccgtaaacgaacgtaaaacggacgtaaaggtaagtagggtaaagtaaggaaaagtaaaagttacttaagtaggtacggtaacgttcgttaggtacgggtaacgggtacctaacttccaaactaccgtaccgtaaccgaaggaaaccgaaacccgaaaccgaaccctaaaaggtaacccctttacgtaaccgtttacgtaaccgttacgtaaccggtaaaacctaaacgtaaaacccggngttaaaccccgaaagggaaaacccggtacccgggaaaggtaacccgtacggtacggtttacgttacgtttacggtttttccggaggttaccgggaacgggtaaccgggttaacccggttacccgggtttaaaggtaaaccgtttaaaacctttaaaaagttttaacccgttaaaccgtaaaaccccgttaaacggtaaaaccgtttttaaacccgggttccccgg

SEQ ID NO: 223528 - DNA, 706 bp, Homo sapiens
  misc_feature: GYAE6OF01AS3DS.12.11.A11.1.454.CMB.1.raw
  modified_base (601)..(601): a, c, t, g, unknown or other
  misc_feature (601)..(601): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaagttggggctggagtcttgggtttttccttgttgcttattttagaaggtgtccagtgtgaggtgcagctggtggagtcgtgggggagtcgttggtccagtccggtggggggtccctggagacgtcctccgtgtaccacctcgtggtacttctattgtttagtagtctagttggatggtaacgtcgggtcccgccgacggtccgtaccggaaggggtaacggggcgttggggagggttggggtacggacccaaagaagtaaaggagaaagagtaaggaagtagaaagtaaatactagtgtacggtactcgtaggtaggaacggtccgtaattacaacgtatcctacgagaacaacgaacgaccaaagtaccacgtactaggtactcgaactaaactaaactaaacgcgtaaccgtaacggaacgacccgtaaagggaccacggtcgttacggttagtttacgtttcgnggtaccggtacgggtaacgttacccggttaaccggtacggttaaacgttaaacccttaaaagtttaccgtaaaccaaacgaagttaaaccgttaagttaccccgg

SEQ ID NO: 223529 - DNA, 672 bp, Homo sapiens
  misc_feature: GYAE6OF01CEN6E.12.11.A11.1.454.CMB.1.raw
  modified_base (251)..(251): a, c, t, g, unknown or other
  misc_feature (251)..(251): n is a, c, g, or t
  modified_base (330)..(330): a, c, t, g, unknown or other
  misc_feature (330)..(330): n is a, c, g, or t
  modified_base (457)..(457): a, c, t, g, unknown or other
  misc_feature (457)..(457): n is a, c, g, or t
  modified_base (516)..(516): a, c, t, g, unknown or other
  misc_feature (516)..(516): n is a, c, g, or t
tcagatacgacgtacacgaccggtgctcgatttagctacgactgcgagggggggtcacaagaggcagcgctctcgggacgtctccaccatggcctgggctctgctgctcctcactctcctcactcaggacacgagggtcctgggcccagtctcgccctgactcacgcctcgcctccgtgtctgggtcctccgtgacagtcgactccacctatcctcctgctaacgtacggaaccgagacagtcgagtcggngtagggagtagtaagttagtttcgtacgtcctaggaacaacactaccaaccgacgactaaaccgccccaagtactacgntagtacttagaacggaacgaaacgaaaacccgtccgtaggtactttacaactctcttcgacgtgcctaacgagtcgccggacaaccgtaccgtccaccgtacaacgttactccgtcgtcgggtaccncgaggtcgtaacggacgggccgtaagtcctaaccgtaacgtttaacctcgtcgttaccncgtactaacgttagttaggtaggttacgtacgtaccgtgggttcgttcgggtccggacgggccggtaaccggtacgtaacggtaccgtccggtaacgtaccgccgacccggacgtcccggcccttaccccggaccgttcgtcccgtctttccccgg

SEQ ID NO: 223530 - DNA, 694 bp, Homo sapiens
  misc_feature: GYAE6OF01DG0OX.12.11.A11.1.454.CMB.1.raw
  modified_base (239)..(239): a, c, t, g, unknown or other
  misc_feature (239)..(239): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (685)..(685): a, c, t, g, unknown or other
  misc_feature (685)..(685): n is a, c, g, or t
tcagatacgacgtacacgaccggtgctcgatttagctacgactgcgagggggggtcgacaagaggcagcgctctcgggacgtctccaccatggcctgggctctgctgctcctcactctcctcactcaggaccactagggtcctgggccccagtcctcgccctgacctcagcctcgtcctcgtgtcgtcggtctaccgtggaccagtcgatccaccagttcctcctgcactggaaacccngcaggtgatggtcgagggtatgtattagttcgtctccgtacggtaccaactactccgaccccgaaggaccaaaccggccccctaacgactactattagtactttagtacggaacggaaaccgtaaaaaccggtccggtaccgggttaatttaccgtaacgtcctccgttcgtacgtcgtaacccgtaccgtacgacctcgggaaccaaccgcccgtacccttaccgacgtaaaccacgttccgtcggtccgtccgtcgacggtacgtcggaaaggaccgggtagtacgttagtttacttcgtgttcncttancgttaggtggtacggtacgtacgtcgttacttcgtagtttccgtacgttacggtccggacggacggtaaacgcgtaccgtcggtacccgttcggacggtccaccggtaccgtccgtacccgtccgtccccggtntaaccccgg

SEQ ID NO: 223531 - DNA, 733 bp, Homo sapiens
  misc_feature: GYAE6OF01CCUA5.12.11.A11.1.454.CMB.1.raw
  modified_base (198)..(198): a, c, t, g, unknown or other
  misc_feature (198)..(198): n is a, c, g, or t
  modified_base (250)..(250): a, c, t, g, unknown or other
  misc_feature (250)..(250): n is a, c, g, or t
  modified_base (286)..(286): a, c, t, g, unknown or other
  misc_feature (286)..(286): n is a, c, g, or t
tcagatacgacgtacacgaccggtgctcgatttagctacgactgcagggggagtctcagagaggagccttagccctggactccaaggcctttccacttggtgatcagcactgagcacagaggactcaccatggaattgggctgagctgggttttcctgttgctatttagagtgtcagtgtgaggtgcagctggtaggngtcgtgggggagcgttggtccgagccgtggggggtccctaggagcgtcctcncgtacacctcgtggtattcgattaggtttagtagtntagttggacttggaacggttcgggtcccgaccgacggtccgtaccgggaaggggaacggggtcgtaggggtacggttggggtcggaaccctaaagtaacgtaaaggacgtaaaggagtagggaagtaggaaagtaaattacgtaagtcggtaggtactcgtaggacggaggtaccgtattacgactatccacagaacgaccaacgtacgaaacgacgtactactgttaactacgagaaactaaacgtaacaacgtaccgtaaggaacccggaccggaaagggtaccaacgggtttcgttacggttaagtttcggttaccgttaggtcggtaaaccgggttacgggtacccgttaacccgggttacgggttaaactaaaaccgttttaaacgtttaacttaaaccccgtaaaacgtaaacgttaaacccgtaaacggggttttacccc

SEQ ID NO: 223532 - DNA, 717 bp, Homo sapiens
  misc_feature: GYAE6OF01BVNX4.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaggtgtccagtgtgaggtgcagctggtggagtcggtgggggagtcgttggtccaggccggtcgggggggtcccctggagacgttcctccgtgtacctaacctcgtggtattcattgtttagtagtctagttggatacgaacgtcgggtcccgaccgagggccgtaccggaagggggaaggggcgtaggggtaggttgggggtacggacccaaagaagtaaaacggacgaaaggagtagggaaagtacggaaagtaaaattacgtaagtggtacgtacgttcgtaggtaggaacgggtccgtattaccgaactaactccctaccgaagtaacgaaccgaaaccgaccaaaacgtaccctctaacgttagtactcgtaacgaaaccaaataaaccgcgacctaagggaaccgaccgggaaggtaccgacggttcttaggttacgtttacgtttcgtgggtcggtacggacggttacccgttcggtaacggtacttaaaccttaagtttacctaaacgaaacctacgttaaacgttaacggttcccgg

SEQ ID NO: 223533 - DNA, 756 bp, Homo sapiens
  misc_feature: GYAE6OF01ACMZO.12.11.A11.1.454.CMB.1.raw
  modified_base (194)..(194): a, c, t, g, unknown or other
  misc_feature (194)..(194): n is a, c, g, or t
  modified_base (577)..(577): a, c, t, g, unknown or other
  misc_feature (577)..(577): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagtcgttgggttttccttgttgcttattttagagtgtccagtgtgaggtncagcgtgggtacggagtcggtgggggagtcgttgggtcccgaggtcccggtcggggggttacccaggacgtacgttccctaccgttacgtaaccaacccgttgtaggtacttcgtaattcggttttagtagtcagtttggatcggaacgtggtcccgccgaggccgtaccggaggggacgggtcgtagggacggtgggtacgaccaaaagtaagtaacggacaaggtagtaggaaagtagaagtaaacttacgtaagtggtacggtacttcgtaggtacggacgggccgtaattaccgaactaacgtcctaaccgagacgtaaacccaaaccggcctaaaagaccgtacaattacgtactacgaacgaaacaaaacgtaaccncggtaacgtaacgggaaacgccccggtaaggaactccgggttatttagggttaacttacgtttcggaggtacggaacccggttacggtacccgtttacggaacgggtttaaaccaaaacttttaaacgtttacccaaaacggaaaccccttaaagtaaaccgtttaccggggttacccc

SEQ ID NO: 223534 - DNA, 686 bp, Homo sapiens
  misc_feature: GYAE6OF01A2SRY.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagcttgggttttccttgttgcttattttagaggtgtccagtgtgaggtgcagctggtggagtcgtgggggagcttggtccagccgtgggggtccctggagacgtcctcctgtaccaaccttctggtacttcattgtttagtagtctagttggatggaacgtgggtcccgcgacggctccgaggggacgggtctgggaggtgggtcgaccaagataaacgcaaagagtaggaagtgaagaatactagtgtgactcgtgtaggaacggcctattcaactatccgtaccaagacgacaaccgaccaaaggtacctccgaacttaggtaacttcgacgtaaactaaaacgtaaaccaggtacccgtaaaggaaaccggtaccccgggaacggtaaccgaccgggttacctttaggttacgtttacgtttccgtagggtacggtaaccgggtagggttaccccgttacccggtaaagggttacgtaaaccttaaacttttaacgaacccgttaaaaccgacgtaaacccgtttaaacggttacccgg

SEQ ID NO: 223535 - DNA, 794 bp, Homo sapiens
  misc_feature: GYAE6OF01CE1XE.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaagttgggctgagcgttgggttttccttgttgcttattttagaagtgtccagtgtgaggtgcagcgtggtggagtcggtgggggaggtcgttcggtccgaggcccggttcgggggggtccctggacggtacgttccttccgtagtaccaaccttcgtggtattctagttgttttaagtagttctagtttggataggtaaccgtcggggtcccgccgacggtccgtaccggaagggggaaggggcgttaggggagggtggggtacggaacccgaaaataagtaaaaggacgaaaggtaagtagggaaagtaggaaagtaaaacttacgttaagtggtacggtacgttcgtagggtaacgggaaacgggtaccctaagtttaccaacgtaaacttcctaaccgaagaaacgaacccaaaccgaaccaaacgtaacctcaacttgtactactaagaaactaaaactaaaccgacggtaacccgtaaggaaaacggacccgggtaacggaaccgtaccgggttcgttaggttacgtttagttttccggaggtacggaccgggtaacgggttacccgttaccggttaacgggttaactaaaaccgtttaaattttacctaaaacccgaaaaccgtaaacgttaaaccgttaaaccgggtttacccg

SEQ ID NO: 223536 - DNA, 891 bp, Homo sapiens
  misc_feature: GYAE6OF01DXS4C.12.11.A11.1.454.CMB.1.raw
  modified_base (159)..(159): a, c, t, g, unknown or other
  misc_feature (159)..(159): n is a, c, g, or t
  modified_base (183)..(183): a, c, t, g, unknown or other
  misc_feature (183)..(183): n is a, c, g, or t
  modified_base (638)..(638): a, c, t, g, unknown or other
  misc_feature (638)..(638): n is a, c, g, or t
  modified_base (673)..(673): a, c, t, g, unknown or other
  misc_feature (673)..(673): n is a, c, g, or t
  modified_base (687)..(687): a, c, t, g, unknown or other
  misc_feature (687)..(687): n is a, c, g, or t
tcagatacgacgtacacgaccggtgctcgatttagctacgactgcaggggaggtctcagagaggagccttagccctggactccaaggcctttccacttggtgatcagcactgagcacagagactcaccatggaattgggctgagcttggtttcttgtgnttatttagagtgtcagtgtgagtncagcgtggtggtagtcggtggggagtcgttcggtaccagggtcccggttggggggttccctaggacggtacgttccgttaccgttacggtaaccctaaccgttcgttaggtactttacgtaagttttaggttttaagtaacgttacgtaaggttttagggaacttacggtaaccggttcggggttaccccggaccgacgggtcccgttaacggggaacggggggtaacggggttcggttaaggggtacgggttacggggtaccgggaaacccctaaaagtaaacgtaaaacggacgtaaaaggtaacggtaaagggtaaagttacggaaaagttaaaacgttacgttaaggttacgggtacggactttagggtacggtaacggggtaaaccgggtcctaaactttaccgaactaaccgttccaaacgtaagaaacctaaacgaaaccccggtaanaaaaccgtacctacgtagttacgtaactacgtaanaaaacccgttaaanaaccgtacgaaccggtaaaggaacccggacggaaacggacgttaccggtactttagggttactttaagttcggtaacggtacggtaaaccgggtaccgggttaaccccgtttacgggtaaacggttaacgtaaaaccctttttaaagtttaaccccaaaccgaaaaacccggttacgttaaaaaccggttaccgtttaccccgg

SEQ ID NO: 223537 - DNA, 698 bp, Homo sapiens
  misc_feature: GYAE6OF01ER1M6.12.11.A11.1.454.CMB.1.raw
  modified_base (571)..(571): a, c, t, g, unknown or other
  misc_feature (571)..(571): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagtcttgggttttccttgttgcttattttagaggtgtccagtgtgaggtgcagcgtgggtggagtcggtgggggagtcgttcggtccaggcccggttcgggggtccctggagtacgtcctcctgtaactacctgtggtacttctattaggtttagtagttactagttggacttaggaaccgttcgggtcccgaccgaggtccgtaccgggaagggggaacggggtcgtagggacgggttggggtacggaacccaaaataacgtaaaagaccgaaaggtagtagggaaacgtagaaacgtaaatacgtaagtggtacggactcgtggtacggaacggtcctaattcgaactacgtcctaaccgaagtaacgaacctaaccgaaccgtaaagacctacctaattcggtactacgtagaactaaataaccgntacgaagaaacgcgaacgacgtacgattggtacttacgttcgagtcgacggacggtacctacggttaagactaaacttaaacgtttctaaacccaacgtaaataaccgttaaacgttcgtaaacccg

SEQ ID NO: 223538 - DNA, 771 bp, Homo sapiens
  misc_feature: GYAE6OF01BCZRT.12.11.A11.1.454.CMB.1.raw
  modified_base (519)..(519): a, c, t, g, unknown or other
  misc_feature (519)..(519): n is a, c, g, or t
  modified_base (621)..(621): a, c, t, g, unknown or other
  misc_feature (621)..(621): n is a, c, g, or t
  modified_base (649)..(649): a, c, t, g, unknown or other
  misc_feature (649)..(649): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaagttggggctgagcttgggttttccttgttgcttattttagaaggtgtccagtgtgaggtgcagctggtggagtcgtgggggagcgttggtccaggccgtggggggtccctgagagtcctcctgtacacctgtgtattcattgtttagtagtctagttggatagaaccggttgggtcccgccaggtcctaccggaggggagggcgtgggaggtggggtacggacccaagtaataaaggcgaagagtagggaaagtagaaagtaaattacgttagtcggtaggtacttacgtaggtacgggaacgggtaccgtaattaccgaacctaattcccgtaaaccgaagggtaaccgaaacctaaaccccggaccaaaacgttaaacccctanaacgtttaggtaacctttaccgaaacgaaaccttaaaacgttaaaccgaccggtttacccgaaaggaaacccgggcccggtaaacggacgttaaccgggttnttaacggtttagttttaaacctttcggnggttaccggaaccgggttagggtaaaccccgtttccggtaaaccgggttagttaaaacccttaaagtttttcccgaaacccgaaacggaggtaaacccttaaacgggttttcccggtaaccg

SEQ ID NO: 223539 - DNA, 863 bp, Homo sapiens
  misc_feature: GYAE6OF01CQJ6C.12.11.A11.1.454.CMB.1.raw
  modified_base (341)..(341): a, c, t, g, unknown or other
  misc_feature (341)..(341): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggattggggctgagcgttgggttttccttgttgcttattttagaggtgtccagtgtgaggtgcagcgtggtggagttcggtgggggagtcgtttggccaggtcccggtcggggggtccctggagtacgttcctccgtacgtaccaaccttcgtaggactttcatttcggtttagtagtcgtaagttggattcggtaacggttcggggtcccnccgtacgggtcctaccggaagggggaacgggggtcgtaggggtagggttcggggtacggaaccctaaacgtaaagtaaaacggccgaaaaggagttaggggaaagttaggaaacgtaaattaaccgtaggtttcggttacgggtaaccttcggttagggtaacggggaaaaccggggtcccgttaactttaaccgaaccgtaaacgttccccgtaaccgtaacgggtaaccgaaacccgtaaaccccggaccctaaaaacggtaaccccgttccaacgtttacgtaacgtttacccgacggtaaaaccttaaaaacgaaaccgtacggtaaccccgttaaagggaaaccggttacccggggaaccggtaccggaccgggtttacttagggttttactttaacggttttcgtagggttaccggcggggtaaacggtccgggtttacccgtacgggttaattaaactttaaacgttttacctacggaaaacctaggtaaacgttaaccggtttccgtaacccgg

SEQ ID NO: 223540 - DNA, 866 bp, Homo sapiens
  misc_feature: GYAE6OF01EFM2V.12.11.A11.1.454.CMB.1.raw
  modified_base (747)..(747): a, c, t, g, unknown or other
  misc_feature (747)..(747): n is a, c, g, or t
  modified_base (755)..(755): a, c, t, g, unknown or other
  misc_feature (755)..(755): n is a, c, g, or t
  modified_base (763)..(763): a, c, t, g, unknown or other
  misc_feature (763)..(763): n is a, c, g, or t
tcagatacgacgtacacgaccggtgctcgatttagctacgactgcagggggtctcagagaggagccttagccctggactccaagcctttccacttggtgatcagcactgagcacagaggactcaccagtggtaagttggggctgagcgtttgggttttccttgttgtcttagttttagaaggtgtccgtagtgtggaggtgcgagtcgtgggtggtaggtcgggtgggggacgtcgttggtcccgaggtccgggttcgggggtccctaggacggtacgttcgttacccgtagtaacctaacccgttcgttaggtactttacgtaaggttttaggttttaaggttacgttacgttagtttacggtaacgttacggtaaccggttccggggttccccgaccggtacgggtccccggtaacggggtaacgggggggtaacggggtcggttacggggagggtttaccgggggtacggaaccccgaaaaacgtaagttaaaaacggacgaaaagggtaggtaagggtaaaggttaacggaaaaagtaaacgttaacgttaggttacgggtaacggtcttacggggttagggaccgggtaaacgggtaaccgttacttaacaacgtaacccgttaccgtaaccggaaggaccgtaaacccgaaacccggtaaccgaaacgtacctacggttattacgttacgaccttacggaaactaaataacgcgtacgaagaaccgacgtacgacgtccgngttagttnttacgttntacggtcgggaagttaccggttccgtacccgagggtaaccttaaaccttaacgttaaacgtacccgtaaacgtaagtaaaacctttcggttaccgaaaccccg

SEQ ID NO: 223541 - DNA, 598 bp, Homo sapiens
  misc_feature: GYAE6OF01E1S0I.12.11.A11.1.454.CMB.1.raw
  modified_base (301)..(301): a, c, t, g, unknown or other
  misc_feature (301)..(301): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgcgtgggagtgataagtttgtctcctggtaccaacatccaccaggacaaacgcccccagactcatgatttanggagggacaaaaacggcccgtacgggtatttcaatcgcttctctgctcagtctgcacgacgcctcctgacactctcgnggcctccgaggcgtaggaggacgnggtctagtatttactactgtctcgctacatcgtagacgtagggttagtcgtacttaccgtttccgactaccgttagttaccggggacggtaacgggaaccctaaggtaccgttcccgggtaaccccgttcccggttaacccgtaccggtaacccggaccccggtaaacgggtcccgtccccggtacccccccggg

SEQ ID NO: 223542 - DNA, 693 bp, Homo sapiens
  misc_feature: GYAE6OF01CXX8O.12.11.A11.1.454.CMB.1.raw
  modified_base (569)..(569): a, c, t, g, unknown or other
  misc_feature (569)..(569): n is a, c, g, or t
  modified_base (584)..(584): a, c, t, g, unknown or other
  misc_feature (584)..(584): n is a, c, g, or t
  modified_base (675)..(675): a, c, t, g, unknown or other
  misc_feature (675)..(675): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaagttgggctgagtcgttgggtttttccttgttgcttattttagagtgtccagtgtgagtgcagcgtggtggagtcgtgggggaggtcgttcggtccgacgtccggtcgggggtcccgtcgagtacgtctccgtgtgcacgtcctccgtaggtacgttcctaccttacgtacaactatcgtcatagcgtccgtcggtaccaccgacggtcctaccgtaggttaggacggggtacgtcgggtaggtcgggtccgttacgtaagggtttacgttaggttacgggttagggttgggttagggtacgacgtaagtaacgttaacgtacgacgtaacggtaccgttccggtaggacggggtaccgttacacgcctacgtacctacgaaggaattaaaccgtaacttaacccgaaagtaaccgacgtgtattttaagcgtanaacttaagcgaaacncgtaccgtggaacgacggccggtaaacggaccgtacgggtacctagttacgtacgtggtacgacgttaacgtcgttacgggaccgttacgngttaaggtgggtaggacg

SEQ ID NO: 223543 - DNA, 712 bp, Homo sapiens
  misc_feature: GYAE6OF01AOJI2.12.11.A11.1.454.CMB.1.raw
  modified_base (571)..(571): a, c, t, g, unknown or other
  misc_feature (571)..(571): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
  modified_base (629)..(629): a, c, t, g, unknown or other
  misc_feature (629)..(629): n is a, c, g, or t
tcagatacgacgtacacgaccggtgctcgatttagctacgactgcagggggaggtctcagagaggagccttagccctggactccaaggccctttccacttggtgatcagcactgagcacagaggactcaccatggattggggctgagtcgttgggttttccttgttgtcttagttttagaaggtgtccagttgtgaggtgcagtcgtgggtggaggtcgggtggggggagtcgttcggtccgaggccgggtggggggtccctggagcgttcctcctgtaccactcgtggtacttctagtttgtttagtagtctagttggatgtaacggtcgggtcccgcgacggcctaccgggaggggacggggtcgtagggtgggtggggtacggaacccgaaagtaaaggtaaaagacgaaggtaggtaggtaaggtaacggtaataaacgttagttagtggtacgtaacttcgtagggtacggtaaacgggtccgttaacgttaccaacgtaacgttcccaacggagaaccggtaaccaaaccgaaccgtaacgaaccttccgaaattcgtactcganaaactaaanaaccgngtacctaaggaaccgccggaagtacgcgttcgtagttacgttnttggtgacggtacgtacggtaccgtacggtaacgagttaaacttaaagtttccaaacgaaaccttagtaacgtacttaccggg

SEQ ID NO: 223544 - DNA, 778 bp, Homo sapiens
  misc_feature: GYAE6OF01DVJZT.12.11.A11.1.454.CMB.1.raw
  modified_base (187)..(187): a, c, t, g, unknown or other
  misc_feature (187)..(187): n is a, c, g, or t
  modified_base (553)..(553): a, c, t, g, unknown or other
  misc_feature (553)..(553): n is a, c, g, or t
  modified_base (608)..(608): a, c, t, g, unknown or other
  misc_feature (608)..(608): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagcttgggttttccttgttgcttatttagagtgtcagtgtgagtncagctggtggagtcgtgggggagtcgttggtccgaggtccggttcgggggggtccctggacggtacgttccttaccgttagtaaccctaaccgttcgttaggtatttccgtaagtttggttttagtacgttactagtttgggaattacggtaacggttccggggtcccgaccgtagggtaccgttaccgggaagggggaacggggggcttaggggtaggggttgggggtaccggaacccgtaaaacgtaagtaaaacggaccgaaaaggtacgtaaggggaacgtaaggaaagtaaaattaacgtagttggtacggtacttcgtagggtaggaacgggtctatttacactaactctaacgaagganaacccgagacctaaagacctatacttagtactaccgagaacctaaaagtaaccgngtaaccgtaagaaaccggaccgaagggtacccgtaaggtcttaggttactttactttcggtagttacgggacgtacgggtacccgttaccgtagggttaactaaacgtttaaacgttttaaccaaccggtaaaccgtaaaggtaaccgtttaaacggttcccggtaaccg

SEQ ID NO: 223545 - DNA, 743 bp, Homo sapiens
  misc_feature: GYAE6OF01B24BL.12.11.A11.1.454.CMB.1.raw
  modified_base (344)..(344): a, c, t, g, unknown or other
  misc_feature (344)..(344): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaagttggggctgagcttgggtttttccttgttgcttattttagaaggtgtccagtgtgaggtgcagcgtggtggagtcggtggggggagtcgttggtccaggtccggttcggggggttccctggaggagttccttccgtacgtaccaaccttcgtggtacttctagttgtttagtagttctagtggtataggtaacgtcggtcccgaccgnggtccgtaccggaggggtaggggcgtaggggtagggtcgggcggtaccaaacgtaagtaaagcgtaagagtaggaaagtaagaacgtaaatactagtaggtggtacttgtaggtaggacgggctattacaacgtactccgacgagacgaaccgaaccgaacctaagtacctacgtactacgttataccgtagaaacctaaataaccgaagtacccgaaggtaaccggaccgggaaacggacaacgggttcgttagttacgtttacgtttacggtcggttacgggtacccggtacgggttaccccggtttacgggttaccggttaaacgttaaaaccttttaaacgtttaacttaaacccgaaaaccgtaacggtaaacgtttaacgggttaacccccgg

SEQ ID NO: 223546 - DNA, 862 bp, Homo sapiens
  misc_feature: GYAE6OF01EP9XZ.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaagttggggctgagtcgttgggttttccttgttgtcttattttaggaaggtgtccagtgtgaggtgcagcgtgggtggaggtcggtgggggacgtcgtttggtaccgacggtcccggttcggggggtccctaggacgtacgtcctccgtaggtaaccctaaccgttcgtaggtactttccgtagtttacggtttaagtacgttacgtagtttaggtaattacggtaaccggttccgggggttcccccaccggtacgggtacccgtaccggggaaggggggtaacggggtccgtagggggtagggtacggggtaccgaacccgtaaaagtaagtaaaacgcgtaaaaggaggtaagggtaacgtaaggtaaacgtaaagttacgtaggttcggtacgtaacgttacggtagggtaggaaccgggtaccttacgtaacctacgtaccttaccggaacccgtaagggtaaacccgtaacccgaaacccggtaaccgtaaaacgtacccctacgtaaagtttccgttaaactcggtaactaaaccgtaaaactaacgaccgggtacctaaaggggaacccgacgggaccggtaaccgtacgtcggtttagttacttagtttcggcggtacggtaccgggtaaccggttacccgttacggttaaaggtaccgtttaaaacttaaacgtttccgaaaccaaaaccgtcgttaaaaccgttaaccgggttaccccg

SEQ ID NO: 223547 - DNA, 612 bp, Homo sapiens
  misc_feature: GYAE6OF01DODM0.12.11.A11.1.454.CMB.1.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
  modified_base (306)..(306): a, c, t, g, unknown or other
  misc_feature (306)..(306): n is a, c, g, or t
  modified_base (444)..(444): a, c, t, g, unknown or other
  misc_feature (444)..(444): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
tcagatacgacgtacacgaccggtgctcgatttagctacgactgcaggggggtctcagagaggagccttagccctggactccaaggtcctttccacttggtgatcagcactgagcacagaggactcacatggaattggggctgagcttgggtttttccttgtgcttatttaagaggtgtccagtgtcgagggcaccgtggnggagtcgtggggagccgtggtccagccgtgggccgtccctgccncgcgcctgtgtcgcctgtggttactttcctactatttctactccatcgcgacgtcggtccnccggtaggtcctaccgagggacgacggggcctacgggagggtcgggtcgaccgttaattagtcgacctagtattggacgtcgacgtaacaaacgtatttcgaacactaacgttccgtagggacggctatccacactcncagacaataatacaactacctacttanacncgaacaatacgactagacctgaacgaaccgaagaacgacgtaccggtattcgttactagttaacgttcgacggacgacggtaagaacgactaaccgaaccgtaccacgtacgaacctaggttacgcggtcggggttcg

SEQ ID NO: 223548 - DNA, 818 bp, Homo sapiens
  misc_feature: GYAE6OF01B8PGF.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcacagtggaagttgggctgagtcgttgggttttccttgtgtcttattttagaaggtgtccagtgtgaggtgcagcgtgggtggacgtcggtagggggagtcgttcggtccgaggtccggttcggggggtccctaggagtacggttcctccgtagtacctaaccgtcgtacggtattccgaagtttgtttaagtacgtctaagtttgggatacggtaacgttcggggtacccgaccgtaacgggtcccgttaccggaagggggaacggggttcgtacgggggtaggttaggggtaaccgggaacccttaaaacgaagttaaaaccgggacgtaaaaggagttaagggaaaggttaccgaaaggttaaacgttaccgttagtcggtacggtaacttacgtttagggaagggtaaaccggtccctaagtttaaccaaaccgtaagtttccgaacccgaaaggtaaccgaaaccccgtaaaccggaacccgtaaaacgtaacctaccgtaattacggtacttaccgttaaggaaacctttaaacgaaaacgcggtaacccttaagggaaacgaccgtaacgggaacgacgtcttagtaccgtttaattccgaggtaccggacgtacgggtacctcccggttaaggaccttaaaagtaacttttacaaccaaacccgtagtacctaaggtttaccccg

SEQ ID NO: 223549 - DNA, 734 bp, Homo sapiens
  misc_feature: GYAE6OF01DGEB4.12.11.A11.1.454.CMB.1.raw
  modified_base (654)..(654): a, c, t, g, unknown or other
  misc_feature (654)..(654): n is a, c, g, or t
tcagatacgacgtacacgaccggtgctcgatttagctacgactgcgaggggggggtcacaagaggcagcgctctcgggacgtctccaccatggcctgggctctgctgctcctcactctctcactcaggacacgagggtcctggcccagtctgccctgacctcacgcctcgccttccggtgtctcgggtcctcgtggaccagtcgatcacctatctcctgcctacgtacggaaccagcgaggtcgatcggacgtggggagtagtaagttaacgtttcgtcctaccgtacggtaaccctaacgtacctaccgacccgaacggaccaaacccgaccccgaacgtacctaacgacgttagttaagttacgtacgggaaacgggtaaaccgaaaaaacccggttccccggttaacggggttaacttttaaccgtaacgtccgttaccgtttcgttaccggtacgtacctacgtaacggtctacggacctaacccgccggtaccctccgtacgactacgttccgtacgtacggcttaccggagaccgtaggacggacggtacgtactagtactttagtacctcggtctcgacttagacttcgtacggacggttcggtagttccgtaccgttagttccgaacgttccgtacggtaccgggnggtaacgaccgtacgtcggaacccggtacccgtacgtaccggtacctaacccggaccgtacggtcccgtcccgtacccgg

SEQ ID NO: 223550 - DNA, 902 bp, Homo sapiens
  misc_feature: GYAE6OF01C0S1I.12.11.A11.1.454.CMB.1.raw
  modified_base (220)..(220): a, c, t, g, unknown or other
  misc_feature (220)..(220): n is a, c, g, or t
  modified_base (759)..(759): a, c, t, g, unknown or other
  misc_feature (759)..(759): n is a, c, g, or t
tcagatacgacgtacacgaccggtgctcgatttagctacgactgcaggggaggtctcagagaggagccttagccctggacctccaaggccctttccacttggtgatcagcactgagcacagaggactcaccagtaggagttgggctgagtcgtttgggttttccttggttcgtacttaagttttaggtaaggttcgtccgtaaggtggtaggaggtgcgnggtcgttgggtagggtaggtcgggtgggggacggtcgttcggccgtacggtcccgggtgggggtccctggacggtcgttcctccgtagtacctaaccgttcgtggtacttagtagtttggtttaagtagtcgtaagtttggacgttacggtaaccggtcgggtcccgaccggacgttaccggtaccgggaaaggggaccggggtggttacggggtacgggtttaccgggacgaacccgtaaaacgtaagtaaaaccggagtaaaggaaggttaagggtaaaggaaccggtaaaacgtaaaagttcggtaaagtttgggtaccggttacgttacggtacggggtaaacgggtaacgggtacccctttaagttaacccggaaccttaacgtaccgtaacccggaaacgaccggaaacgttaccccgaaagtaaaaccgttaaacctcgtaaacgttacgtttacgaaccgagtttaaaacgtaaacggtaacccgaacgggttaacgaaaccggaccgggtaacggtaaccgtaccgggtntttacggttacggtagtttttaccggccggtaggtaaacccgggtagttaccgggtaaccggttacggtaacggttaactttaaacggttaacctaaaaccgttaaaggacccgtttaaagttaaccggttaccgtaacccgg

SEQ ID NO: 223551 - DNA, 867 bp, Homo sapiens
  misc_feature: GYAE6OF01CZX7O.12.11.A11.1.454.CMB.1.raw
  modified_base (196)..(196): a, c, t, g, unknown or other
  misc_feature (196)..(196): n is a, c, g, or t
tcagatacgacgtacacgaccggtgctcgatttagctacgactgcagggggtctcagagaggagccttagccctggactccaaggcctttccacttggtgatcagcactgagcacagaggactcacatggagttggggctgagtcgttgggttttccttgttgtcttagttttagaaggttgtccagtgtgaggtncagcgtgggtggagtcgtgggggacgtcgttcggtccgacggtccggtcggggggttaccctaggaggtacgttccttacctcggtaaaccacccgttcgtagggtaacttttcgtaagttttaggtttagttaacgttactaagtttaggagttacggtaaccggttcgggtccccgaccgtaacgggtccttaaccgggaacgggggagggggtaccgtaggggtagggttcggggttaccgaaccgtaaacgtaaacggttaaacggaccgtaaaggtaggtaaggtaaaggtaggaaaacgtaaataacgttagtacggtacggtaacgttccggtagggtaaggtaaccgggacctttaacgtaccgaacctaacttaccgtaccgaacggaacgaacccgaaacccgtacccgaaacgttaaaccgtactaccgttaagtacctaccgtaacgtaaacctaaaacgtaaaccgtacgtaaccgaaacgggtaaacccggtaccggaaaccgggtacccgtacggttacgttacgttaggtttactttcggtaacggtaccggtacggaaccgggttaccgttacccggttaacggttaacggttaaacctttaaagtttaccaaacgttaaccaaagttaaccggtaacgtttccgtaaacccgg

SEQ ID NO: 223552 - DNA, 823 bp, Homo sapiens
  misc_feature: GYAE6OF01AWZYU.12.11.A11.1.454.CMB.1.raw
tcagatacgacgtacacgaccggtgctcgatttagctacgactgcaggggggggttcacaagaggcagcgctctcgggacgtctccaccatggcctgggctcctgctgctcctcgactctcctcactcaggacacgacgggtcctgggcccagtctcgaccctgacctcgacgtcccgtcgcccttccggtgtccgtcgggttcctccgtggacctaggtccgatccaacctatccgtcctgcctacgtacggaaaccctggccgtaggtgtacgtcggccgttagggggtaattaggtaagtttaacggttttcgtccgttccgtacggtaacccaaacgtacctaccgaaacccgacggaaccaaacccgcccccaagtacctacctagtacgtaatttacgtacggtaacgggtaaaccgaaaaaaccgggtcccggtacgggtaactttactaacgttccgtctttacgtccgtacgtaccgtaccgtaacgttcgtacggaccaaaccgtaccggtaccccttacccgtacgtaacctaacttccgtccgtcgggtaccctccggtacggtacgtacgggaacggtaaccgggacggttacgttacgtaactttaacgttaccgtacgtccgtacgtaccctactaagttacgtagtaaccggtaggttacggttcggtaccgttacgttcccggaacgtaccggttacggtaccggggaacgggtaacggtaaccgtaaggtccggtaccggtacccgttaccggtaaccgttccgaacccggtacccgtaccggtcccgttccccggtacccccgg

SEQ ID NO: 223553 - DNA, 902 bp, Homo sapiens
  misc_feature: GYAE6OF01BSJBU.12.11.A11.1.454.CMB.1.raw
tcagatacgacgtacacgaccggtgctcgatttagctacgactgcaggggtctcagagaggagccttagccctggactccaaggcccttttccacttggtgatcagcactgagcacgagaggactcaccagtaggaagttggggctggagtcgtttgggtttttcctttggttgtctttaagtttttaggaaggttcgttaccgaggttggtggtacggttgacagtcgttagggttagggaggttccggtagggggggtaggtcggtttccgggttacccgacggccggttgggggtaccttccccgtagggaacgtaccggttccttccgttacggtaacccctaacccgtgttaggtactttccgtagttttaggtttaacggttacgttaccgtagtttacggtagttacggtaaccggttccggggtcccgaccgtagggaccgtaccgggaaggggtaacggggtcggtagggtcgggtcggggttacgaaccgtaaagtaacgtaaaacggacgtaaaggtagtaacgggtaaaggtaacgaaaggttaaacgttacgttaaggttacgggttagtaccggttacgttagggtaacggtaaccgggttaccgttaacctaccgtaaccgttaaccgtccgtaaccgtaaggtaaccgaaacccgtaaacgaaccgtaaaccgtaacctccgttaacgtacgttactaacctaagaaaccttaaacgtaacgacgtaaccgaacggtaacggaaccggtaccgtaaccggtacgtacggttactttaggttcgtttacgaccggttggaccggtacggtacggttacggtaacggttaagtaactttaacgttaacccttaacgtaaaccaacggttaaccgttagggttaacccg

SEQ ID NO: 223554 - DNA, 707 bp, Homo sapiens
  misc_feature: GYAE6OF01A5M4O.12.11.A11.1.454.CMB.1.raw
  modified_base (352)..(352): a, c, t, g, unknown or other
  misc_feature (352)..(352): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattgggctgagctgggttttccttgttgcttattttagaaggtgtcagtgtgaggtgcagctggtggagtcgtgggggagtcttggtccagccgtgggggtccctgagagtctctcgtacaacctctgtattcattgttagtagtctattggatgaacgtcgggtccgcgaggctaccggaagggaacggggcgtaggtaggtgggtacgaccgaaanaagtaaaagacgaaagagtaggaagttaggaaagtaaataacgtagtaggtacggactcgtaggtacggaaggtaccgtattacaactaacgttaccctaacgaagaacgtaaacgaaaccgaaccgaaaacgaaccttactaacgtagttaacttcgttaacgaaacctaaaactaaaccgtacggtaaccctaaaggtaaaacccggacggaaaccggtaccgaacggttcctaggtttacgtaacttttcgaggttcgacggttaacggtaacccgttacggtacggttaacgtaaacttaaacgtttaactaaacccgaaaacgtaacgtaaacttaaaccgggtttaccg

SEQ ID NO: 223555 - DNA, 895 bp, Homo sapiens
  misc_feature: GYAE6OF01EU4MX.12.11.A11.1.454.CMB.1.raw
tcagatacgacgtacacgaccggtgctcgatttagctacgactgcgaggggggggtcacgaggaggcagcgctctcgggacgtctccaccatcggcctgggtctctgtctacttccctcaccctcctcactcgagggcacgtagggtcctcgggcctatcctcgccctgactcacgtcctcgcccttcggtgtccgttcgggttcctccgtaggactcgtacgactaccacctacttcctaccgtaaccacgtaacgggaaccacggacgttacgggttacggttcgggtttacgggttagtttaaactaaccttagttccgttccttaccgtacggtaaccaactacgaccgaccgacggacgtaaccgacccgaacccctaaactcgtagtttagttttacgttttagacgtttacgtacctaaacggttaacccgttccggtaccgttacgggtttaccggggtttccaaggggttaccctttccgggttccttttaaccgggtccgttacccggttacgtaaacccggttacggtttaccggtaaaccgtaacccggttaacccgggtccccgttaccccggttaaccccggtaccctaaccggtttccttaccggttcccggttaacggtcccgttaaccggaaccgggttcgaacggggtaacgggtaccgtaggtaccggttaattaaccgtttagttcgtacgaccgtaccgtataacggtaataaccgtaggaaacgcgtacccgacgttaccctacccgtttacgtttcgtacggttaccggttacgggaacgggtttacccgaccgtacggtccttaccggtccctaacgtcggaacccgtaccccggtacgtacccaacccttcggtacgtaccccttaccgg

SEQ ID NO: 223556 - DNA, 903 bp, Homo sapiens
  misc_feature: GYAE6OF01C2TQV.12.11.A11.1.454.CMB.1.raw
  modified_base (179)..(179): a, c, t, g, unknown or other
  misc_feature (179)..(179): n is a, c, g, or t
  modified_base (231)..(231): a, c, t, g, unknown or other
  misc_feature (231)..(231): n is a, c, g, or t
tcagatacgacgtacacgaccggtgctcgatttagctacgactgcagggggtctcagagaggagccttagccctggactccaaggtcctttccacttggtgatcagcactgagcacagagactcaccatggaagttgggctgagtcgttgggttttccttgttgtcttatttagaggtntcagtgtgaggtgcagtgtggtggagtggtgggggtagtcgttcggtaccgnggtcccggtcgggggttccctggtacgtacgtccgttcccgtcgtaacccgtaccgttcgtaggtacttcgttagttttaggtttagtacgttcgtaggttaggagttaggtaaccggtccgggtaccccgtacccgtacgggtcccgtaccggggaaaggggggtacgggtccggttaggggtacgggttacggggtaccggaaccgtaaaagttaaccggtaaaggaccggtaaaaggttagggaaggttaaaggtaacgtaaaggttaaattaaaccgtgttggtaacggtcctttaggggtacgtaacggggaacggtacccgttaaacgtactaaccgttacctaccgttaacccgaacggaaacgaacccgtaaccgaaaaccgtaactaacccgtaccgtaacgttacgtaacgtaaacgtaacctaagtaaaaaccttaaccgaacccggtaaacgaaccgggtaaacggaccggtaaccggggtaaccggtaccgtttacgtttacgttttaaggttaccctttaggggttacggcggttacggaaccgggtttcccgtaaaccgggtttaacggtaaacgttaaacgtttaaaacgtttaaccgtaaaaccccgttaaacctaaagggtttaaacccgttaaagggttccccggtaaacccg

SEQ ID NO: 223557 - DNA, 861 bp, Homo sapiens
  misc_feature: GYAE6OF01BWS4I.12.11.A11.1.454.CMB.1.raw
tcagatacgacgtacacgaccggtgctcgatttagctacgactgcagggggtctcagagaggagccttagccctggactccaaggcctttccacttggtgatcagcactgagcacagaggactcaccatggaattgggctgagcttggttttccttgttgctattttagaaggtgtcagtgtgaggtgcagctgggtggagtcgtgggggagtcgttggtccaggccgttggggggtccctgagtagtctcctagtaccaaccgtcaggtattcattgtttagtagtctattgatgaacgtcgggtcccgcgacggctaccgaggggaacgggtcgtagggacggttgggtacgaccgaaacgaacgtaaagacgaagacgtaggtaagtacgaagaaactactaagtgtacggtatcgtagtagaacgggtaccgtattacgaactaacttcctaaccgtaagaaccggaaacaaacccgtaaaccgaaaacgaaacccttaccgaaccttagttaaacgttacccgttaagaaacccgtaaaaaacgtaaaaccgtaacgtaacccgtaaacggaaaaaccggtaccccgggaaacgggtaaacccggaaacccgggttaccgtttaacgggttttaaccgggtttaaaccttttttccgggttaacgggtttaaaccggggacccgggttaaaaccggggttaaccccggtttaacccgttaacccgggtttaaaacggttaaaaaccctttaaaaaaccgttttttttaaacctaaaacccccggttaaaaaacccgttaaaaccgttaaaaccccggtttaaaaaagggtttttccccgggtttaaaaccccccgg

SEQ ID NO: 223558 - DNA, 918 bp, Homo sapiens
  misc_feature: GYAE6OF01AFCQ1.12.11.A11.1.454.CMB.1.raw
tcagatacgacgtacacgaccggtgctcgatttagctacgactgcagggaggtctcagagaggagccttagccctggactccaaggcctttccacttggtgatcagcactgagcacagaggactcaccatggaattggggctgagcgttggttttccttgttgcttattttagaaggtgtccagttgtgaggtgcgagcttgggtggagttcggtagggggaggtcgttcggtccgacgtccgggttcggggggtccctggacgtacgttcctccgtacgtacctaccttccgtaggtattacctagtttaggttttacgtagttcgtagtttaggacgtacggtaacggttcggggtaccccgccgtacgggtcccgttaccgggaagggggtaaccgggggtcgttagggggtacgggttcggggtacgaccccgaaaagtaaagtaaaaccggacgtaaaacggtagttaacgggtaaagtaaggtaaaagtaacgttaacgttaggttacggttacggttaaccgtttacgggtagggttaaccgggaaaccgggtccgttaaacgttaaccccgaacgtttaccgtacccgttaacctaacgggaaccgtaaaccccgaaacccgaacgtaaaccgttacccacgtactttacgttaccgtacctaacgtaaacgttaaaacgaacccgacggttaaccgaaacggaaccgggtacccgaaagggttaccgaccggttactacggtttatttacgttccggttaggaacccgttacggggtacccgggtttaaccccgttaacgggtaaccgggtttaaagtttaaaaacccgtttaaaacgttttttaaacccaaaacccgggtaaaacccggttaaacgttaaaaaccccggttccgggtttaaaccccgg

SEQ ID NO: 223559 - DNA, 655 bp, Homo sapiens
  misc_feature: GYAE6OF01EFUBU.12.11.A11.1.454.CMB.1.raw
  modified_base (300)..(300): a, c, t, g, unknown or other
  misc_feature (300)..(300): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcctgggggtccctgagagtctcctgtacaacctctggattcattgtttagtagtcattggatgaactgggtccnccaggcctccgagggaaggggctggagtgggtgaccaacataaagcaagataggaagtgaagaaatacgtagtgtaggactcgtagtggaagggccgtattcaactaatccgtaccaagacgaacaacgccaaaagaacctcaacgttgtaactcgtagaacctaaaataaacagtacccgtaaggaaacggcccggtaaagggaccacggggtcctttaggtacgttaattttccgtggtaccggtaccgggtagggttaacccggttaccgttaacggggtacgaaaacgttaaaacttttttacgaaccccaaaaaacccgtacggtaaaacctaaaagggttttaccccgg

SEQ ID NO: 223560 - DNA, 747 bp, Homo sapiens
  misc_feature: GYAE6OF01BS43J.12.11.A11.1.454.CMB.1.raw
  modified_base (142)..(142): a, c, t, g, unknown or other
  misc_feature (142)..(142): n is a, c, g, or t
  modified_base (555)..(555): a, c, t, g, unknown or other
  misc_feature (555)..(555): n is a, c, g, or t
  modified_base (585)..(585): a, c, t, g, unknown or other
  misc_feature (585)..(585): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccagtggagttgggntgagtcgttgggttttccttgttgtcttagttttaggaggtgtccagtgtgaggtgcagtcgtggtcggtagtcggtagggggacgtcgtttcgggccgtcggtccggtacggggggtccctggacgtcgttctccgtagtaaccaccgtcgtcggattcgttatttggtttagtagtctagttggatggtaacgtcggtcccgacgacggccgtacggaggggtaggggtcgtacgggtgggtcgggtaccggaccaaagtaagtaacgagtaaaggagtaaggtaagtaggtaataattacgtaggtacggtggtacctggtaggtacggacggtaccgtacttacaacgttacctaccgaaccgaaggacccaaacgaaccgtaaccgtaaccgtacttctaacggtttntacttacggaacgtaaacaaacggtaaccncgtaacccgtaaggaaccggacgacggtacgtgtacttggttacgtttacgttaggcgaacggttcgggtaccggtaaaccttccgggttaaaacgttacgtaaaacttttaccgttaaacgttaacccaaagtaaacgttaaccgtttaaccgggtacccg

SEQ ID NO: 223561 - DNA, 631 bp, Homo sapiens
  misc_feature: GYAE6OF01DBM20.12.11.A11.1.454.CMB.1.raw
  modified_base (291)..(291): a, c, t, g, unknown or other
  misc_feature (291)..(291): n is a, c, g, or t
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (559)..(559): a, c, t, g, unknown or other
  misc_feature (559)..(559): n is a, c, g, or t
  modified_base (573)..(573): a, c, t, g, unknown or other
  misc_feature (573)..(573): n is a, c, g, or t
  modified_base (594)..(594): a, c, t, g, unknown or other
  misc_feature (594)..(594): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaagttggggctgagtcgttgggttttccttggttgtcttaagttttaggaaggtgtccgtagtgtgaggtgcaggcgtgggtggagtcggtgggggaggtcttggtccaggccggtcgggggtccctgagtcgtcgtcctagtacaccttcgtaggtnttcgtaattggtttaagtagtctagttggatcgtaacgtcgggtcccgcgacggtctaccggaggggagggcgtgggaggtgggacgacaaacgagtaaacggagaaggagtaggtaaagtagaaagtaaactgtaagtggtagacctgtcggaggtagggacctactcgaactacgcctaacgagaacggaccaacgacaaacgtctactagttgactnagtaaactaaanacgacgtacgaaggaaacccgngacncgacgttgtntaggttcttcgggngtagcggtacgttacttacgngtaataacttaacttacaacagtaacgtagtcgtacg

SEQ ID NO: 223562 - DNA, 542 bp, Homo sapiens
  misc_feature: GYAE6OF02HG3Y8.12.11.A11.1.454.CMB.1.raw
tcagatacgacgtacacgaccggtgctcgatttagctacgactgcaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggatgataagtttgtctcctggtaccaacatcacccaggcaaagcccccagactcatgatttatgagggcaaaaaacggccctacggggatttctaatcgcttcctctggctccaagtctggcaacacggcctccctgacaatctctgggctccaggctgaggacgaggctgattattactgctgctcatatgctagggtagtgggtcacgttttcgctacttagttcggacgggagggtaacccaaggtccgtaggacccgttcctaaccggttccaacggaccccgtaagggcctcggtacccccccgg

SEQ ID NO: 223563 - DNA, 506 bp, Homo sapiens
  misc_feature: GYAE6OF02IW41R.12.11.A11.1.454.CMB.1.raw
tcagatacgacgtacacgaccggtgctcgatttagctacgactgcaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctggggatgataagtttgtctcctggtaccaacatcacccaggcaaagccccagactcatgatttatgagggcaaaaaacggccctcggggatttctaatcgcttctctggctccaagtctggcaacacggcctccctgacaatctctcgggctccaggctgaggacgaggctgattattactgctgctcatatgcaggtagtggctactttcgctactattcggcggagggaccaagctagaccgtcctacgtcagccccaaggccgtcgtcccccg

SEQ ID NO: 223564 - DNA, 520 bp, Homo sapiens
  misc_feature: GYAE6OF02H6UMU.12.11.A11.1.454.CMB.1.raw
  modified_base (389)..(389): a, c, t, g, unknown or other
  misc_feature (389)..(389): n is a, c, g, or t
  modified_base (433)..(433): a, c, t, g, unknown or other
  misc_feature (433)..(433): n is a, c, g, or t
  modified_base (466)..(466): a, c, t, g, unknown or other
  misc_feature (466)..(466): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgttagtagtcattggatgaactgggtccgccaggctccgagggaagggctggagtgggtggccaacataaagcaagatggaagtgagaaatactatgtggactctgtgaagggcattcanatctcagagacaacgcaagactcaactgtatctgacaaataacngcctagaacgccgaggacacggctgtgtattcngtgcgaggacctcgtaggtcgaactaatttactacaaaccagacctaagttccg

SEQ ID NO: 223565 - DNA, 510 bp, Homo sapiens
  misc_feature: GYAE6OF02HERDB.12.11.A11.1.454.CMB.1.raw
tcagatacgacgtacacgaccggtgctcgatttagctacgactgcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacaccaggcaaacgcccccaaactcatgattatgagggcactaagcggccctcgaggggtttctatcgcttctctggctcgagtctggcaacacggcctccctgaccatctcgtcggggtccaggctggaggacgaggctagtattatactgctagttcatatacaagcacttccactctgtggtcgttcggcggtggacagctgaccgtctaagtcacgcccgagctcgcccctggtcactctccg

SEQ ID NO: 223566 - DNA, 511 bp, Homo sapiens
  misc_feature: GYAE6OF02H4Z2L.12.11.A11.1.454.CMB.1.raw
tcagatacgacgtacacgaccggtgctcgatttagctacgactgcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctcctggtaccaacaacacccaggcaaagcccccaaatcatcgatttatgaggcactaagcggccctcaggggtttcttatcgcttctctggctcgagtctggcaacacggcctcctgacatctctggctcaggctgaggacgaggcggattattatgttgctcatatggcggtagtagctacgtttcgattcgtcctagttcggcggtaggaccagctcgaccgtccgtggcagcccaggcctcgcccccgtgtcctatcccg

SEQ ID NO: 223567 - DNA, 472 bp, Homo sapiens
  misc_feature: GYAE6OF02GHDP5.12.11.A11.1.454.CMB.1.raw
  modified_base (456)..(472): a, c, t, g, unknown or other
  misc_feature (456)..(472): n is a, c, g, or t
tcagatacgacgtacacgaccggtgctcgatttagctacgactgcagggaaggggctgggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggactcctacggtgacaaatttattcaaaccagacaaagttcgttcgccaagccgtcacactactttgacagctggggccagggaaccctggtcaccgtctcctcagcctccaccaacgggcccatccggtccttcccctggccaccctcctccaagacgcacctctggggcacacgcggccctgggctgcctggtcaagctactcctacgtcgtatctgagcggctggcagcgcatagnnnnnnnnnnnnnnnnn

SEQ ID NO: 223568 - DNA, 505 bp, Homo sapiens
  misc_feature: GYAE6OF02HJUCZ.12.11.A11.1.454.CMB.1.raw
tcagatacgacgtacacgaccggtgctcgatttagctacgactgcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggatgataagtttgtctcctggtaccaacatcacccaggcaaagcccccagactcatgattatgaggcaaaaacggcctcggggatttctaatcgcttctctgctccgagtctggcacacggcctcctgacaatctctgggctccaggctgaggacgaggcggattagttactgttgctcatatgcgggtagtagctactttcgattgtcctagttcggcggaggaccaaggctgaccgtctgggtcacgcccaaggcctcgcccctggtccc

SEQ ID NO: 223569 - DNA, 734 bp, Homo sapiens
  misc_feature: GYAE6OF02II8AZ.12.11.A11.1.454.CMB.1.raw
  modified_base (107)..(107): a, c, t, g, unknown or other
  misc_feature (107)..(107): n is a, c, g, or t
tcagatacgacgtacacgaccggtgctcgatttagctacgactgcaggggggggtcacaagaggcagcgctctcgggacgtctccaccatggcctgggctctgccgntcctcactctcctcactcagacgacagggtccgtcggcccgacgtctcgccctcgactcctacgcctcgcctcccgtcgtctcgggtcgtcctcggacgagtcgtactcaccaactctcctcgcactacggaaccgacgcgagtagatgcgtgggaggtagtagtaaagttttgttctccttcggtaccgaaaccatccaccccacggcgaaaacgacccccacgactaccatagtatttaatggaagggacgaaaaaaaccggacccgtcggggtaagttttactaactcgtccttcttctggtctaccaagttcgtcggacaaaccacggtccctccctagaaccaaatttcccgttacgttcggggccttacccgagggactgggaagggaaaccggacgggtcttcggtaaattttaacgttttaacgtccgcgttcgtccgtactaacgttaagttcggacgtaacgggttagggttcggccttacctttttcggacctaaccgttaagtttccgggggacgggaaccggggtaaccaaacggtcccgttcggtaaccccggttaccctaacggtacaccggtaccccaaacggggtccttcccgcccccccggttacccgg

SEQ ID NO: 223570 - DNA, 554 bp, Homo sapiens
  misc_feature: GYAE6OF02HTCLZ.12.11.A11.1.454.CMB.1.raw
  modified_base (427)..(427): a, c, t, g, unknown or other
  misc_feature (427)..(427): n is a, c, g, or t
  modified_base (485)..(485): a, c, t, g, unknown or other
  misc_feature (485)..(485): n is a, c, g, or t
  modified_base (513)..(513): a, c, t, g, unknown or other
  misc_feature (513)..(513): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgttagtagtcattggatgaactgggtccgcaggctccagggaaggggctggagtgggtgccaacataaagcaagataggaagtgagaaatactatgtggactctgtgaagggcgattcgaacaatctccagagacaacgccaaagaactcaactgtanctagacaaaataaacagacctagaaacgccgaaggaccacgggtctgtagttatttcngttgacggaggtaccgtcctaacgggtnaactaaagtttacttaccaaacgtagaacctaaagtttccg

SEQ ID NO: 223571 - DNA, 509 bp, Homo sapiens
  misc_feature: GYAE6OF02HB650.12.11.A11.1.454.CMB.1.raw
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctggggatgataagtttgtctcctggtaccaacaataccccggcaaagtccccaagttaatcatttatgagggcactaagcggccctcaggagtttctgatcgcttctctggctcaaggctggcgaccgggctccctgacatatctggctccaggctgaggacgaggctcattactactgctgctcatatggagttatagctacgttgggtgttcggcggcgggaccagtgaccgtctaggtcaggcccaaggctcggccccttcggcactcgttcccg

SEQ ID NO: 223572 - DNA, 596 bp, Homo sapiens
  misc_feature: GYAE6OF02IG9CB.12.11.A11.1.454.CMB.1.raw
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagcggtggtttcgtgtaggcgtactttagaaggtgtccagtgtgaggtgcagctggtggagtcgtggggggaggcttggtccagccgtggggggtccctgagagtctcctgtacaacctctggattcatgtttagtagtcattggatgaacgtgggtccgccaggctcgagggaagggctggagtgggtgccaacgataaagcaagatggaagtgaagaaatactatggtaggactcgtagtgaagggcccgattcaactaatcacctagagacaacgcaaagactcactgtatcgtanaacaaagtaaacncgacctaggaacgccgaaggtaccaacgggtcttaggtacgtatttccgtgtagtcgggaacggtccgttaccgtaacgggtacgtaaaccgtaaattttactaaccaaaaccgtagtaaaccctaaggtttaaccccgg

SEQ ID NO: 223573 - DNA, 535 bp, Homo sapiens
  misc_feature: GYAE6OF02I3R56.12.11.A11.1.454.CMB.1.raw
  modified_base (440)..(440): a, c, t, g, unknown or other
  misc_feature (440)..(440): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (524)..(524): a, c, t, g, unknown or other
  misc_feature (524)..(524): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagagtctcctgtacaacctctggattcatgtttagtagtcattggatgactgggtccgccaggctccgagggaggggctggagtgggtggccaacgataaagcaaagagtaggaagtagagaaatactatgtaggactctgtggaagggccgattcactaaatctaccgaagagacaacgaccaaagaacctcactntatctgacaaataacagcctagaagccgagacaggctagtntattcngtgcgaggcgtctaggtgaactaatttactacaaacngtactagttcg

SEQ ID NO: 223574 - DNA, 579 bp, Homo sapiens
  misc_feature: GYAE6OF02I9Y25.12.11.A11.1.454.CMB.1.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
  modified_base (495)..(495): a, c, t, g, unknown or other
  misc_feature (495)..(495): n is a, c, g, or t
  modified_base (511)..(511): a, c, t, g, unknown or other
  misc_feature (511)..(511): n is a, c, g, or t
  modified_base (539)..(539): a, c, t, g, unknown or other
  misc_feature (539)..(539): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggaggcttgggtccnggccgtggggggtccctggagagtctcctgtacaacctctggattcatgttagtagtcattggatgaactgggtccncaggctccgagggaagggctggagtgggtggacaacataaagcaaaggataggaagtgaagaaatacgtagtgtaggactcgtaggtaggaagggtccgtattacgaactaaagtcctaccaaggacgaacaaacgaccaaaggaactcaactagtatactagacaaaataacagacctagaacgcgaagacngtctagtagtattcgngacgacggaggtaccgtacgtaaggtanaacttaaatttcgtaaaccgaacaagtacgtaagttccgg

SEQ ID NO: 223575 - DNA, 640 bp, Homo sapiens
  misc_feature: GYAE6OF02H9L74.12.11.A11.1.454.CMB.1.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagatacgacgtacacgaccggtgctcgatttagctacgactgcgagggggtcgtcagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtctgggggaggcttggtccagccgtggggggtccctgagagtctcctgtacacctctggattcatgtttagtagtcattggatgaatgggtccncaggctccgagggacgggntgggagtgggcggccaacataaagcaagatggaagtgacgaaatactagtgtaggacttcgtagttaggaacggggcctaagtttaccgaactaagtccctaccgaaggaacgaaccgaaaccgtccaaagtaaacctcgtaacctgttaactcgtacgaactaaaattaaccaaggtccctaaggaaacacccggtaaggacgtaaccggccgttaggtagttactttgtaggtcgacggaacgggtacgtttcccgagggttactaactaaagttttacaaccgtaaaccgataaccgttaaacgtttccgtaaccccgg

SEQ ID NO: 223576 - DNA, 724 bp, Homo sapiens
  misc_feature: GYAE6OF02G923J.12.11.A11.1.454.CMB.1.raw
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagagtctcctgtacaacctctggattcattgtttagtagtcattggatgaactgggtccncaggctcgagggagggctggagtgggtgccaanataaagcaagagtaggaagtgaagaaatactagtgtaggactcgtaggtaggaacgggtccgtaatttaccaacgtaacttcctaacccgaaggtaacgaaaccctaaaccggacccaaaaggtaaacctccgaacgttaggttaacttccgtaagaaacctaaaaacttaaaccgacgtacccttaagggaaaaccggtcccggaaagggtaacccgacgggtcctttaggttacggtttaacttttcggttacgggtacgggaccgggtaaacgggttaccccggttacccggttaacgggggttaactaaaaccgtttaaaaagttttttaccgtaaacccaaaaaccccggtaaggtaaaccccgttaaaaggttttcccccggg

SEQ ID NO: 223577 - DNA, 592 bp, Homo sapiens
  misc_feature: GYAE6OF02GOZT0.12.11.A11.1.454.CMB.1.raw
  modified_base (466)..(466): a, c, t, g, unknown or other
  misc_feature (466)..(466): n is a, c, g, or t
  modified_base (514)..(514): a, c, t, g, unknown or other
  misc_feature (514)..(514): n is a, c, g, or t
  modified_base (547)..(547): a, c, t, g, unknown or other
  misc_feature (547)..(547): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagagtctcctgtacaacctctggattcatgtttagtagtcattggatgaactgggtccgccaggctccgaggggaaggggctggaggtgggtgccaaacataaagcaagagtaggaagtgaagaaatactatggtggactcgtgtaggaacgggccgattcaactaatcctaccgagacgaaccaacgaccaaagactcacttagtatctgaacaaaataaacngacctaagaaacgcccgaaggaccacgggtctaggtattacttttcgngtcggacggtaaggaccgttccgtaacgggtanaaaccttaaagttttacaccgaaaaccagtaacctaaaggttccg

SEQ ID NO: 223578 - DNA, 530 bp, Homo sapiens
  misc_feature: GYAE6OF02IHHU8.12.11.A11.1.454.CMB.1.raw
  modified_base (338)..(338): a, c, t, g, unknown or other
  misc_feature (338)..(338): n is a, c, g, or t
  modified_base (424)..(424): a, c, t, g, unknown or other
  misc_feature (424)..(424): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccgaggggaaggggctggagtgggtggccaanataaagcaagataggaagtgaagaaatactatgtgactctgtgaagggccattcacatctcagagacaacgccaagaactcacttntatctgacaataggactaatttagagagaggaagacaacggtcttaatatttctgtcgcgagacgcccgtcggacgagtacgtctacggactacttactattacgg

SEQ ID NO: 223579 - DNA, 690 bp, Homo sapiens
  misc_feature: GYAE6OF02IUA26.12.11.A11.1.454.CMB.1.raw
  modified_base (366)..(366): a, c, t, g, unknown or other
  misc_feature (366)..(366): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattgggggctgagctgggttttcctgttgctattttagaaggtgtccagtgtgaggtgcagctggtggagtcgtgggggaggcttggtccagccgtgggggtccctgagagtctcctgtacacctctggattcatgtttagtagtcattggatgaacgtgggtccgcaggctccgaggggaaggggcgtggagtggggtgacccgaagataaagcaagataggagtaggaanaaagtactagtgtaggacttctggtaggaaggggccgtaagtttacaacgtaattcctaccgaggaacgaaccaaaccgcccaaaaggaaccctctacttaggtaactcgtagaactaaaataaaccgagacccgttaaggaaaaccggtacccggaagggaaccctccgggacgtttacggttacggtttacgttttccgtagggttcgggaccggtaacggggttaacccgttacccgggttaaccggtacggttaaaaccttaaatttttaacgttaacccgtaaaaccgtaacggttaacctaaacggttttaccccggg

SEQ ID NO: 223580 - DNA, 521 bp, Homo sapiens
  misc_feature: GYAE6OF02JITEA.12.11.A11.1.454.CMB.1.raw
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (437)..(437): a, c, t, g, unknown or other
  misc_feature (437)..(437): n is a, c, g, or t
  modified_base (469)..(469): a, c, t, g, unknown or other
  misc_feature (469)..(469): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttgggtccagccgtggggggtccctggagagtctcctgtacaacctctggattcatgtttagtagtcattggatgaactgggtccncaggctcgagggaggggctggagtgggtgccaanataaagcaagatggaagtgaagaaatactatgtggactctgtgaagggcattcacaatctcagagacaacgcaagactcactgtatctgacaaataacngcctagaaacgccgaagacagctgtagtattngtgcgaggtactcgtaggtgaataatttataccaacgagtaccaagtttccg

SEQ ID NO: 223581 - DNA, 556 bp, Homo sapiens
  misc_feature: GYAE6OF02GE5YL.12.11.A11.1.454.CMB.1.raw
  modified_base (393)..(393): a, c, t, g, unknown or other
  misc_feature (393)..(393): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (472)..(472): a, c, t, g, unknown or other
  misc_feature (472)..(472): n is a, c, g, or t
  modified_base (504)..(504): a, c, t, g, unknown or other
  misc_feature (504)..(504): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcctggggggtccctgagagtctcctgtacaacctctggattcatgtttagtagtcattggatgaactgggtccgccaggctccagggaagggctggagtgggtggccaacgataaagcaagatggaagtgaagaaatactaatgtggactctgtgaagggccgattcanaatctccagagacaacgccaaagaactcactgtanctanacaaataaacagcctagaaagccgaaggaccacggctgtnttattcgtgtgcgaggccgtcctaacgggtanaacctaaattttacttaacaaacccgtaagaaccgtaaagttccgtaaccgg

SEQ ID NO: 223582 - DNA, 554 bp, Homo sapiens
  misc_feature: GYAE6OF02IT46K.12.11.A11.1.454.CMB.1.raw
  modified_base (294)..(294): a, c, t, g, unknown or other
  misc_feature (294)..(294): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggatgatagttgtctctggtaccaacatcaccaggcaaacgccccagactcatgtatttanggaggcaacgtaacgccggacctcgacgggtttctatcgtcttctctggctcgngtcngcacncgctcctgacatctcgnggctcgagcgtgacggcgaggtcggtatttacgttacgttgttcgctactagtagtcggtacgggtagtacgtccttacgtttcgagttacgtcgttaggtcgggacggtacggacgtaacggctacggtcccgttacggtcggtaccaccggacccgtacggtcccgtccggtccccgg

SEQ ID NO: 223583 - DNA, 708 bp, Homo sapiens
  misc_feature: GYAE6OF02H99ZJ.12.11.A11.1.454.CMB.1.raw
  modified_base (552)..(552): a, c, t, g, unknown or other
  misc_feature (552)..(552): n is a, c, g, or t
  modified_base (603)..(603): a, c, t, g, unknown or other
  misc_feature (603)..(603): n is a, c, g, or t
  modified_base (647)..(647): a, c, t, g, unknown or other
  misc_feature (647)..(647): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtggggggtccctgagacgtctcctgtaccaacctcgtggattcattgttagtagtctagttggatgaacgtcgggtccgccgaggcctccggaaggggaaggggctgggaggtggggtacggaccaaagaagtaaaacggcaaaggacgtagggaaagttaggaaaggaaaattacgtaagtggtacgggtactcgttaggtagggaacggggtccgtaatttaccaaacgtaaacttcccgtaacccgaaggaacgaaaccaaaccgccccgaaaagtaacctcaaaccgttgtaactctagaaacctaaaaagtaaaccncgtaccaaaggaacgaccgggaagaccacggtcttaggtctttaagtttcngggtacgtacggaacgggttacccttaccgtaaccggggttaanaaaccgtttaaacttttaactaacccgaaaaccgtagttaaacccgttaaggtttccccgg

SEQ ID NO: 223584 - DNA, 537 bp, Homo sapiens
  misc_feature: GYAE6OF02GLYSD.12.11.A11.1.454.CMB.1.raw
  modified_base (434)..(434): a, c, t, g, unknown or other
  misc_feature (434)..(434): n is a, c, g, or t
tcagatacgacgtacacgaccggtgctcgatttagctacgactgcagggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcctggggggtccctgagagtctcctgtacaacctctggattcatgttagtagtcattggatgaactggtccgcaggctccagggagggctggagtgggtgccaacataaagcaagatggaagtgaagaaatactatgtggactctgtgagggccgattcacatctccagagacaacgccaaagactcactgtatctgacaaataacngaccctagaaacgccgaaggaccgaacgctgtagttatttcgtgtcgcggaggaccgtcctaacgggtgaactaatttactacaaacctgaacctaagttccg

SEQ ID NO: 223585 - DNA, 742 bp, Homo sapiens
  misc_feature: GYAE6OF02HEFRS.12.11.A11.1.454.CMB.1.raw
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatccacccaggaccaaacgcccccagacctcatagtatttaagtgaacgggaacgaaaaaaccggcccgtaccggggtaacttttactaacgttccggtctttccgttacgtacggtcctacccgtaacgttccgtacgggacctaaccgaacccggtccccttccccgtacggaaacctaacttccgttaccgttcggggccttacccgaacgggtacgtacggaacggggtaaccggacgggtcgttaggtaagttttaacgtttacgttggtccgttcgtcttacctagttaagtcgtacggtaagggttacggttacgggtccttaaccgtttccgtaccttaacgttacgttaccggggtaccggggtaacggggaacccgtaacgggtccgtacggtaaccccggttacccgttacccggtaaccgtacccggtaaccccgaacgggttcccgttacccggttacccccccgg

SEQ ID NO: 223586 - DNA, 734 bp, Homo sapiens
  misc_feature: GYAE6OF02F9QPL.12.11.A11.1.454.CMB.1.raw
tcagatacgacgtacacgaccggtgctcgatttagctacgactgcagggggtctcagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtcgtgggggaggcttggccagccgtggggggtccctgagagtctcctgtaccacctctggattcattgtttagtagtcattggatgaacgtggtccgcaggcctccgagggaggggctgggaggtgggtcgccaacgagtaaagcgaagagtaggaagtggaagaaatacgtagtggtaggtactcgtggtaggaacggggaccgtattccgaactaacgtcctaccgaaggtaacgaaccaaaccgccaaaggaaacctcaacttagtactcgtacgaactaaacgtaaactcgacccgttaaaggaaacccggtacccggaaacgggtaaccggtaaccgggttccgtaacggtttacgtttaacgtttttaccgttacgggttacggtaccgggttaaccggggtaaacccggtttaccccggttacggggtaaacctaaaccggttttaaaagttttaccctttaaacccggaaaaccccgtaacgggttaaacccgtttaaacgggttttccccgttaaaccccgg

SEQ ID NO: 223587 - DNA, 665 bp, Homo sapiens
  misc_feature: GYAE6OF02I8P5H.12.11.A11.1.454.CMB.1.raw
  modified_base (528)..(528): a, c, t, g, unknown or other
  misc_feature (528)..(528): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattgggctgagctgggtttctgtgctatttagaggtgtccagtgtgaggtgcagctggtggagtcgtgggggaggcttggtccagcccgtggggggtccctggagagtctcctagtaccaacctcgtggattcatgtttagagtcattggataggaactgggtccgccaggctcgagggaggggctggacgtgggagaccaacaagtaaagcaaaggactaggaagtcgaagaaatactagtagtggaaccttgtagtaggaacgggtaccgtaagttcactaaacttctacccgagtaaccggaacaaccggaccaaaggaaccctacacgtagtactaccgttagaaactaaaactaaaccgagacctaaggaaaccgaccgtagggaaccncgggcttaggtacgttaacttttcgaggtggaacccggttacgggtaacccgtttaacccggtacggggttaattaaacccgttaaagttttaacgtaccctaaaacgtaaccggtaacgtaaaccggtttaaccgg

SEQ ID NO: 223588 - DNA, 692 bp, Homo sapiens
  misc_feature: GYAE6OF02IGKBN.12.11.A11.1.454.CMB.1.raw
  modified_base (246)..(246): a, c, t, g, unknown or other
  misc_feature (246)..(246): n is a, c, g, or t
  modified_base (301)..(301): a, c, t, g, unknown or other
  misc_feature (301)..(301): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagngtctcctgtacacctctggattcatgtttagtagtcattggatgaactgggtccnccaggctccgagggagggctggagtgggtcgaccaaacgagtaaagcaaagagtaggaagtgaagaaattactatggtggtactcgtagtaggaacgggcctattcgaactaagtctaccgaggagaaccaacgaccctaaagaacttccgaagtagttactcgttacgaaactaaaaacgtaaacgacgtacccgtaaagaaaccggccggaaaacgggttaaccaaccgggtccttaggttaacgttagtttttaccgcggttaagggaccggtaagggtaaccctttacccggttaaacggggtactttaaaaccgttaaaaacggttttttctaaaacccgtaaaaaccccgtaacgggtaaaccttaaaaaccgggttttccccgg

SEQ ID NO: 223589 - DNA, 608 bp, Homo sapiens
  misc_feature: GYAE6OF02GUQWZ.12.11.A11.1.454.CMB.1.raw
  modified_base (473)..(473): a, c, t, g, unknown or other
  misc_feature (473)..(473): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctatttagaggtgtccagtgtgaggtgcagctggtggagtcgtgggggaggcttggtccagccgtggggggtccctggagagtctcctgtacaacctctggattcattgtttagtagtctattggatgaactgggtccgccaggctaccgaggggaggggctgggaggtgggtgccaacagtaaagcaagagtaggaagtagaagaaatactagtgtggactcgtgtaggaacgggccgtattccaacaatccctaccgaagacgaacaaccgaccaaaggacctcgaacttgtatcagaacaaataacngacctagaacgccgaaggacctaggctaggttagttacttcgtaggtcgacggtacggtaccgttaccggtaacgggtaataaccgttaaacgttttactaacccgaaaccgtacggtaacgttaacggttcccg

SEQ ID NO: 223590 - DNA, 881 bp, Homo sapiens
  misc_feature: GYAE6OF02IROIB.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagcgtgggttttcctgttgctattttagaaggtgtccagtgtgaggtgcagctggtggagtcgtgggggaggcttggtccagccgtgggggtccctgagagtctcctgtacacctctggattcatgtttagtagtctattggatgaactgggtccgcgacggctccgaggggaaggggcgtgggaggtggggtggacccaacagtaaagcaagagtaggaaagtgaagtaaagtactaatggtaggaacgttcgtaggttaggaaacgggggtcccgtaagtttaccgaactaaacgttacccttaccgaaaggtaacgaaacccgaaaccggacccgtaaaacggaaacccttaccgaaaccttacggtttaaacgttacccgttaacgggtaaaacccttaaaaaaacgtttaaaaaacccgacgggtaaccccgtttaaagggtaaaaaacccggggaccccgggaaaagggggaaaccccgtaaacccgggggtacccgttttaagggtttaaccgggttttaagttttttaccgggtttacgggttaccgggaacccgggggttaaacgggggtttaaacccccggttttacccgggtttaaaaccccgggggttaagttaaaaacccggttttaaaaaacgtttttttaaaccgtttaaacccggtaaaaaaaccccccggtaaacgggtttaaaaaccccggttaaaaccgggttttttaacccccgggg

SEQ ID NO: 223591 - DNA, 543 bp, Homo sapiens
  misc_feature: GYAE6OF02FY2WQ.12.11.A11.1.454.CMB.1.raw
  modified_base (481)..(481): a, c, t, g, unknown or other
  misc_feature (481)..(481): n is a, c, g, or t
  modified_base (529)..(529): a, c, t, g, unknown or other
  misc_feature (529)..(529): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattgggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccgagggaaggggctgggagtgggtggccaacataaagcaagatggaagtgagaaatactatgtggactctgtggaagggccattcacaatctcagagacaacgccaagaactcacttgtatctagacaaataacagcctagaaacgccgaaggacacggctgtagttatttcngtgacggaggaccgttccgtaacggtgaacttaatttctaccaaaccngtaactaagttccg

SEQ ID NO: 223592 - DNA, 573 bp, Homo sapiens
  misc_feature: GYAE6OF02HCD7N.12.11.A11.1.454.CMB.1.raw
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccaggccgtggggggtccctggagagtctcctgtacaacctctggattcattgtttagtagtcattggatgaactgggtccgcaggctccgagggaagggctggagtgggtgccaacataaagcaagataggaagtgaagaatactatggtggactcgtgtaggagggccattcgactaatcctcaagacgacaacgccaaagactcgatgtatcganaacaaataacngactagaaacgccgaagggaccacggctagtagttatttcgtggtggacgtacgggaccgttaccgtaacgggtataacttaaagtttctaaccgaaaccgtagaaccttaaaggtttccg

SEQ ID NO: 223593 - DNA, 868 bp, Homo sapiens
  misc_feature: GYAE6OF02IHZ6M.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctggagagtctcctgtacaacctctggattcattgttttagtagttctagtttggatagaacgtcggggttcccgccgacggccgtcccggaagggggaagggggctagggagggtggggtcggacccgaaacgtaagtaaaaggcaaaggaagtagggaaagtaggaagaaaatactaagtaggtaggactacgtaggtaggaacgggaccgtaagttacgaactaaacttccgtacccgaaaggtaacgaaccgtaaaaccggaccctaaaaaggaaaccttaccgaaaccgttaggtttaaccttccgttaaggtaaaccctaaaaaacgttaaaacccaacggtaacccccgttaaaagggaaaaacccgggccccggggtaaaaggggaaaccccgtaaaccggggtccgtttaacggtttaacgggtttaaccgtttttttaccggtagggttttaaccgggacccgggtaaaaggggggttaacccccgtttaaccccgggtttaaaccgggggttaaaccgttaaaacccgttttaaaaaacgtttttttaaccggtttaaaccccgaaaaaaccccggttaaagggtaaaccccgtttaaaaacgggtttttacccccggg

SEQ ID NO: 223594 - DNA, 690 bp, Homo sapiens
  misc_feature: GYAE6OF02HDS9E.12.11.A11.1.454.CMB.1.raw
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccaggccgtggggggtccctgagagtctcctgtacaacctctggattcatgtttagtagtcattggatgaactgggtccncaggctccgagggagggctgggagtgggngaccacagtaagcaagataggaagtgagaaatactagtgtacggactcgtgtaggaacgggccgtaagttacaactaattccctaaccgaggtaacgaaccaaacgacccaaagaacccttcaacgttgttaactcgttacgaactaaaactaaacacggtaccctaaggaaaccggccggaaaggacccgtaacgggtcgttaggttacgtttaattttccggtagttaggaccgggtaaacgggtacccggttaccccgtaacggggttaacgaaacccgttttaaaagttttacctttaaacccgaaaacccgtaaggtttaaaaccttaaaccgggtttacccggtttaaccccgg

SEQ ID NO: 223595 - DNA, 756 bp, Homo sapiens
  misc_feature: GYAE6OF02IJZBG.12.11.A11.1.454.CMB.1.raw
  modified_base (219)..(219): a, c, t, g, unknown or other
  misc_feature (219)..(219): n is a, c, g, or t
tcagatacgacgtacacgaccggtgctcgatttagctacgactgcaggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactggaacccngcagtgatggctgggatgataagtttgtctcctggtaccaacatcaccaggtcaaacgccccagactacatcgatttatgagggaccaaaaaaccgggccctacggggtactttactaaacgtcggactttccgtctggtacctacctaacgttcctacggcctaaacgtaacccgggtcccttccccgttagaacctaaacgttcccgttcggtcgggcccttaccgaacgggtccttacggaaacgggacggtacgggaccttcgggtaactttaacgtttacccgttggtaccttaacgggtttccaaacgttttaacggtaaaccttaaaccgggactaaacccgttttcccgtacccgttaaccgtttacgggttaccgggtttccgggttacccgggttaccggggtcgggtaacccgtaacggtcccgtttacgggaacccccggtttaacccgttaaacggttcccggtaaccgtaaccccggtaacggtccgtttccccggtaccccccgttacccgggttaaccccg

SEQ ID NO: 223596 - DNA, 575 bp, Homo sapiens
  misc_feature: GYAE6OF02H18R4.12.11.A11.1.454.CMB.1.raw
  modified_base (547)..(547): a, c, t, g, unknown or other
  misc_feature (547)..(547): n is a, c, g, or t
  modified_base (550)..(553): a, c, t, g, unknown or other
  misc_feature (550)..(553): n is a, c, g, or t
  modified_base (555)..(556): a, c, t, g, unknown or other
  misc_feature (555)..(556): n is a, c, g, or t
  modified_base (558)..(559): a, c, t, g, unknown or other
  misc_feature (558)..(559): n is a, c, g, or t
  modified_base (561)..(575): a, c, t, g, unknown or other
  misc_feature (561)..(575): n is a, c, g, or t
tcagatacgacgtacacgaccggtgctcgattttagctacgactgcagggaaggggctggagtgggtggccaacataaagcaagatggaagtgagaaatactatgtggactctgtgaagggccgattcacaatctccagagacaaagccaagaactcactgtatctgcaaataaacagcctgaaagccgaggacacggctgtgtatttctgtgcgaggcgtcctacggtgactaaattttataccaaaccagaacaaagttcgttcgccaagccgtcacacttactttgacagcgtggggccaacgggaaccctggtcctaccgttcctcctcgacgcctaccaccgaacgggccccagttccggtccttcccccgtggtccacccctccctccgaacgcgccacccgtcggtcggggcaacgacggccggcccgtcgggcctacgccgtcgggtaccaaacgggtaccttaccgtttccgtaaccggttcgtacttccgtggaacggccgggtcttcgggaccgtagggcctacgagttacgcgtncgnnnncnngnncnnnnnnnnnnnnnnn

SEQ ID NO: 223597 - DNA, 796 bp, Homo sapiens
  misc_feature: GYAE6OF02F65BA.12.11.A11.1.454.CMB.1.raw
tcagatacgacgtacacgaccggtgctcgatttagctacgactgcaggggaggtctcagaggaggagccttagccctggactccaaggcctttccacttggtgatcagcactgagcacagaggactcaccatggaattgggctgagctgggtttccttgttgctatttagaagtgtccagtgtgaggtgcagctggtggagtcgtgggggagcttggtccaggccgtggggggtccctggagagtctcctgtacaacctctggattcatgtttagtagtcattggaatgaacgtgggtcccgcaggctccgaaggggaggggctgggagtggggtggccaagagtaaagcaaagtacgtggaaagtgaagtaaatactagtgtaggactgtagtaggaacgggcctaattccaactaacgtccctaccgaaggtaacgaaaccgaaaccgtacccgaaaaggtaaacccttaccgtaaaccgtttaggttaaacctttccgtaagggtaaaccctaaaaaaactttaaaaacccggtaggtaacccccgttaaaggggaaaaacccggtcccggtaaaacgggggtaaccccgtaacgggggtccctttagggtttaaaccgtttaacgttttttccgtaggggttccggtaaccgggtaaacgggggtaacccgtttaccccggttaaaccggggttacgtaaaaaccccgttttaaaacgttttttaacccgttaaaacccgaaaaaccccggttaacggttaaacccggttaaaaaccgggtttttcccccgg

SEQ ID NO: 223598 - DNA, 602 bp, Homo sapiens
  misc_feature: GYAE6OF02JXP33.12.11.A11.1.454.CMB.1.raw
  modified_base (303)..(303): a, c, t, g, unknown or other
  misc_feature (303)..(303): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (502)..(502): a, c, t, g, unknown or other
  misc_feature (502)..(502): n is a, c, g, or t
  modified_base (582)..(582): a, c, t, g, unknown or other
  misc_feature (582)..(582): n is a, c, g, or t
tcagatacgacgtacacgaccggtgctcgatttagctacgactgcaggggaggtcgtcagagaggagccttagccctggactccaaggcctttccacttggtgatcagcactgagcacagaggactcaccatggaattggggctgagctgggttttccttgttgctattttagagtgtccagtgtgaggtgcagctggtggagtcgtgggggaggcttgggtccagccgtggggggtccctggagagtctcctgtacaacctcgtggattcatgtttagtagtcagttggatgactgggtccncagctcgagggagggctggagtgggtgacaacagtaaagcaagtagaggaagtgaagtaaatactagtgtggtactctgggtagaacggggcgtattcacgtaatctacgagacgacaccgacgaagaactcacttagtacngttanaactaaacgtaaacgcgtacctaaggaaccgaccgaaggtacccaacgggtnttacggtgttaactttcgggtcgacggtacggtaccggttacctacgggtacaacgtttaacgtttactaccaaaccggngttaaccgtaagtttcccgg

SEQ ID NO: 223599 - DNA, 564 bp, Homo sapiens
  misc_feature: GYAE6OF02HLOY4.12.11.A11.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacngtcgatcacatctctgcatgaccngcagtgacgttggtgttatactatgtctctgtaccaacagcaccaggcagacgaccccaactcatgtatttatggaggaacgaaaaaccggccgtagggtactttactaatcgcttctcgtcggcctacagtcgtcggacaacgacggtccctccgtagaacctactcctcgtgggcctccgaggtcgtaggacggacggaggcttagtattattacgtgcttgtctcagtatgacgtaggtagtcgtactacgttcgactacgttagtcggacggacggacgtacggtctcggtaccgtacgtaccgtacgaccgtaccgacggtccgtccgtccccgtcgtcccg

SEQ ID NO: 223600 - DNA, 650 bp, Homo sapiens
  misc_feature: GYAE6OF02HRPE3.12.11.A11.1.454.CMB.1.raw
  modified_base (466)..(466): a, c, t, g, unknown or other
  misc_feature (466)..(466): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccaggccgtggggggtccctggagagtctcctgtacaacctctggattcattgtttagtagtcattggatgaacgtgggtccgccgaggctccgaggggaaggggctgggaggtggggtcggacccaaacagtaaaagcaaaggataggaagtgaagaaatactaagtggtggactcgtaggtaggaacggggtccgtattaccgaataactcctaccgagacgacaaaccgaccaaagaacctnacttagtancgtanaacaaanaacgngtacctaaggaaacgcccggaaaggaccgtaacggtctaggttacgtttactttcgtaggttcggaccggtaacgggtacccgttaccgtaacgggtagtaaaccgttaaattttacgtaaccgaaacccgtaaggtaaccgttaacggtttacccgg

SEQ ID NO: 223601 - DNA, 751 bp, Homo sapiens
  misc_feature: GYAE6OF02JM8C4.12.11.A11.1.454.CMB.1.raw
  modified_base (585)..(585): a, c, t, g, unknown or other
  misc_feature (585)..(585): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcgttggtccagtccggtcggggggtccctggagacggtctccgtgtcgcacgtcctctggtattcctaaccgttttagacctaacttagtcgtacctataggacggtccggtcggggtccccgacccgtacgggtccgtcccgaagggtacgggtaaacgggggtccgtaggggtaagggttcggggttaccgttacggtaagggtttaagtttacggttaggggttaggttggggttagggtacggtacggaaggttacgtaacgtaaccggcgtaacggtaccgttccgggtaacgggaacggggttccgttacgacggtctacgtcctaccgaagacgtaactaactaccgaaagaacctacgtnttaacgttacttgacctaagtacgtacgaaccgtagtccgtaagacgaaccggccggaacggaacgtcccggtagttacttaaacggttcgttaggcgttaaccggacggttacgttaccgggtaccgggttaacccggtacttaccgggtagggtcgggtaacgg

SEQ ID NO: 223602 - DNA, 765 bp, Homo sapiens
  misc_feature: GYAE6OF02FTU4H.12.11.A11.1.454.CMB.1.raw
  modified_base (220)..(220): a, c, t, g, unknown or other
  misc_feature (220)..(220): n is a, c, g, or t
  modified_base (305)..(305): a, c, t, g, unknown or other
  misc_feature (305)..(305): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactggaaccngcagtgatgcgtgggatgataagttgtctccgtggtaccaacacgccaccgaggcagaccgacccccaactcatgtattttgatntactactaacgtccgcccttgtacgggtttctgtacgtcgtctttctcgtcggtccttaccgtaagtcctacgtaccgtacgacccggtccccttccctacggtaaccctacgttccttccggtcgggtcctacccggagggtccgtagggacgggtaccggtacggtccgttaggttaatttaacgtttacgtttacggaccgtaacggtccttaacgtaactttaaaccgtaaaccgtaacgggtacctaacggtaccctaaccggtacccctttaacccccgttttcgtttttacccggggtttacccgttttaacccgggggtaaaccgggtttaacccgggggtaaccccgtttaacccggggttaacccgttaacccccgggtttaccccggtttaaccccggttaccccgggaaccccggtaaacccccggtaaccccgggtaaacccccccc

SEQ ID NO: 223603 - DNA, 611 bp, Homo sapiens
  misc_feature: GYAE6OF02HOMP9.12.11.A11.1.454.CMB.1.raw
  modified_base (176)..(176): a, c, t, g, unknown or other
  misc_feature (176)..(176): n is a, c, g, or t
  modified_base (306)..(306): a, c, t, g, unknown or other
  misc_feature (306)..(306): n is a, c, g, or t
  modified_base (485)..(485): a, c, t, g, unknown or other
  misc_feature (485)..(485): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagctgggttttccttgttgctattttagaaggtntccagtgtgaggtgcagctggtggagtcgtggggggaggcgttggtccagccgtggggggtccctgagagtctcctgtacacctctggattcattgtttagtagtctattggattggaacgtgggtcccnccgaggcctccgaggggaaggggcgtgggaggtggggtcggaccaaacgtaagtaaacgacgaaaggagtagggaagtagaagtaaattactagtggtacggacttcgtggtacggaacgggccgtattacaactaatcctaccaaggaacgaccaaaccgaccaaacgacctacactnttactcagaacaaaataacacgactaagaacgccgaggacacggctgtattatttcgtgtcggcgacggtactccgtacggtataacttaatttactaccaaaccgataactaagttccgtaaccg

SEQ ID NO: 223604 - DNA, 627 bp, Homo sapiens
  misc_feature: GYAE6OF02GNTJF.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcctggggggtccctggagagtctcctgtacaacctctggattcatgtttagtagtcattggatgaactgggtccgccaggctccgagggaaggggctgggaggtggggtcggacccaagataaagcaagactaggaagtgaagaaatactagtgtaggacttcgtagtaggaagggccgtattcactaactccgtaccagacgacaacgaccaagaacctcaacttgtatcgtgaacaaactaaacacgaccgtagaaacgtccgaaggaaccgacggtcttaggttagttacttttcggtgtacggtcgggtaacggtaccggttacccgttaacgggtacgtaaccttaaacgttttaccgtaaccgaaaaccgtagtaaaccgtaaacgttttcccgg

SEQ ID NO: 223605 - DNA, 581 bp, Homo sapiens
  misc_feature: GYAE6OF02GVAIE.12.11.A11.1.454.CMB.1.raw
  modified_base (472)..(472): a, c, t, g, unknown or other
  misc_feature (472)..(472): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagagtctcctgtacaacctctggattcattgtttagtagtcattggatggaactgggtccgccaggctccgaggggaggggctggaggtgggtgccaagataaagcaagataggaagtgaagaaatactagtggtaggactcgtggtaggaaggggccgtattacaactaatcctaccagaacgacaacgaccaaagaacctcaacgttgtattcagacaaaataaacncgacctagaaacgccgaaggacgacggctgtatacttcgtgtaggcggaacggtccgttaccggtaggtagaacttaatttacaaccaaacgtacgtactaaggttccg

SEQ ID NO: 223606 - DNA, 489 bp, Homo sapiens
  misc_feature: GYAE6OF02HGQOH.12.11.A11.1.454.CMB.1.raw
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
  modified_base (467)..(489): a, c, t, g, unknown or other
  misc_feature (467)..(489): n is a, c, g, or t
tcagatacgacgtacacgaccggtgctcgatttagctacgactgcagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggactcctacggtgacaaatttatcaaaccagacaaagttcgttcgccaagccgtcacactactttgacagctggggccagggaaccctggtcaccgtctcctcagcctccaccaagggcccatcggtcttccccctggccaccctcctccaagacgcacctcgtcggggcacagccggccctgggctgcctggtcaaggctacttccctacgtcgtatctgagcgggntggcaacgggcgcagtagntcgnnnnnnnnnnnnnnnnnnnnnnn

SEQ ID NO: 223607 - DNA, 742 bp, Homo sapiens
  misc_feature: GYAE6OF02JP1Q8.12.11.A11.1.454.CMB.1.raw
  modified_base (239)..(239): a, c, t, g, unknown or other
  misc_feature (239)..(239): n is a, c, g, or t
tcagatacgacgtacacgaccggtgctcgatttagctacgactgcaggggtctcagagaggagccttagccctggactccaaggcctttccacttggtgatcagcactgagcacagaggactcaccatggaattgggctgagctgggttttccttgttgctattttagaaggtgtccagtgtgaggtgcagctggtggagtcgtgggggagcttggtcagtccgtgggggtcctagagngtcgtcctgtaccgtaactcgtggacttcagttgtttagtactcgatttaggacgtgaacgtggtacccgcctaaggcttaccggaggggaacggggtctagggaggttcggggtacgtaccggaaaactacggtaaacgggactaaaggtacgtaggaacggttaagaaacggtaaactagtaagtggtacgtaacgtgtagtacggaacgggtacctaacgtttacacgtaacgtccgtaccggaagaacaaaccggaacgtaccgaaagtaaccgttctaaacgtacgttaacgtcgtaacgtaactaaaagtaaaacgctaaccgtaagaaacccggtcgaaacggtacggtaaccggtacgttacgtacggttaactttcgtaaccggttcgacgttaaccggggtacgtttaccggtaccggttaagtaacccgtttaacgttttaccggttaaaccgaaccttaacggtaaacccgttaagtttcccggttaaccg

SEQ ID NO: 223608 - DNA, 625 bp, Homo sapiens
  misc_feature: GYAE6OF02GW0O0.12.11.A11.1.454.CMB.1.raw
  modified_base (221)..(221): a, c, t, g, unknown or other
  misc_feature (221)..(221): n is a, c, g, or t
  modified_base (300)..(300): a, c, t, g, unknown or other
  misc_feature (300)..(300): n is a, c, g, or t
  modified_base (495)..(495): a, c, t, g, unknown or other
  misc_feature (495)..(495): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgctgggatgattaagttgtctcctggtaccaacatccacccaggacaaacgccccagactcatgtattagngaaggacaaaaacggccgtacgggtattactaatcgtcttctcgtcgcgtcgagtctggacctaacgaccggcccttcccgacgactaactcgtcgtcgggcctccgaggtcgtagacgggacggaggtacggtatttacttacgttgttgtctactagtagtcggtacgggttagtacgtccttacgtttacgngttcgttccgttaaggttccggggacggtacgggaaccgtacgggtccgttaccggtacccggttccgtacgggttaccgacggtaccccgtaacggtcccgttacccggtcccccggttcggtaccccg

SEQ ID NO: 223609 - DNA, 721 bp, Homo sapiens
  misc_feature: GYAE6OF02GGPLG.12.11.A11.1.454.CMB.1.raw
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccatctcctgcactggaaccagcagtgatgctgggatgataagttgtactcctggtaccaacatcacccaggaccaaagccccagactcatgtatttatggaacgggaccaaaaaacgggtcccgtacggggtatttaccgtaaagtcgtaccttccttcgtcggtccttacccgaaggtttacccgtcgggaacccaaaccggtaacccgggtcccccttacccccgttacggtaaaccctaaacgtttccgtcggttccggggtaccgtccccgtaacgggtccgttacggaacggggtaccggacgggtccgtacggtaagtttactttaacggttagtcctgtacctactagttagtaggtccggtaagggttacgtacgggtcctaacggtttccgacgtaccgttacgttaccggggacggtaacgggtaccgaacggttcccgttacggttacccgtacccgttaacgtccgtaaccggacccggtaacggtccctcccgggttaaccccccg

SEQ ID NO: 223610 - DNA, 852 bp, Homo sapiens
  misc_feature: GYAE6OF02H0MTP.12.11.A11.1.454.CMB.1.raw
  modified_base (178)..(178): a, c, t, g, unknown or other
  misc_feature (178)..(178): n is a, c, g, or t
tcagatacgacgtacacgaccggtgctcgatttagctacgactgcaggggaggtctcagagaggagccttagccctggactccaaggcctttccacttggtgatcagcactgagcacagaggactcacatggaattggggctgagctgggttttccttgttgcttattttagaaggtntccagtgtgaggtgcagcgtggtggagtcgtgggggagcgttggcaggccgtgggggtccctaggagtagtctacctgtacaacctgtaggtattcgaattgtttagtacgtacgtagttggattacggtaaccgttcggggtaccgaccgtaggtacccgtacgggaaggggacggggtcgtagggaggttcgggtacgaccaaacgaagtaaacggaccgaaaggtaacggtaggaaacggtagaaagtaaaagttaacgtaggttaggtacggtaccttcgtaggtaacgggtaaacgggtccgtaagtttaccgaaactaacgttccgtaacccgaaggtaaaccgtaaaccgaaaccggtaacccgtaaaagtaaccctacgtaaaccgttacgtaaacttaaccgtaaccgtaaaactaaaaaccgtaaaccgaacggtaaccccgtaaagggaaaaaccggtaccccgggaaaggtaaccccgggtaaccgggttaaccgttaacggttacgtttaacgttttacccggtagggtacggtaacccggggtaaagggttaaccccgttaacgggtttaacgggtaaaccgttaaaccgtttaaacgttttacccgtaaaacccaaaaaccggtttaagggttaaaccccgtaaacgttttaacccggg

SEQ ID NO: 223611 - DNA, 820 bp, Homo sapiens
  misc_feature: GYAE6OF02GYC23.12.11.A11.1.454.CMB.1.raw
  modified_base (314)..(314): a, c, t, g, unknown or other
  misc_feature (314)..(314): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttgggcccagccgtcggggggtaccctggacgagtactcctgtacaacctcgtaggattcagttgtttagtagtctattaggatacgaacgtcgggtccnccgaggcctaccgaggggtaacgggccgtagggaggtcggggtacggacccaaacgtaagtaaaacgacgtaaaggaggttagggaaaggttcggaaaggtaaaattaccgtaagttaggtacggtaccgttacggttaggtaaggaacgggggtaccgttaacttaccgaacgtaaacgtcctttaccggaaaggtaaaccaacccgaaacccgtaccgtaaaacggtaaccctaccgtaacgttacggttaactccggtaaggtaaaccaaaacgttaaaccgaaccgtacccgtaaacgggaaaacgtcccggaaaggtacccgaaagggtccctttaagggttaacccgtttaattttcccgggacggttaacgggtaccgggtaacgggtttacccggttaccggtaaaccgggttaacgaaaccttttaaaacggtttacccttttaaaccgaaaaccccgttaaggttaaacccgttaacggtttcccgtaaccccggg

SEQ ID NO: 223612 - DNA, 821 bp, Homo sapiens
  misc_feature: GYAE6OF02GNITK.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctatttagaaggtgtccagtgtgaggtgcagctggtggagtcgtgggggagcgttggccaggcccggtcggggggtccctggagtaggttcctccgtgtaaccaacccgttcgtaggtattccattaggttttagtacgtctaagttggattagaacgttggggtcccgccgaggcctaccgaaggggtaacgggcgtgggaggttggggcggaccaaacgtaagtaaacggactaaaggaagtagggaaagtaggtaagaaacgttacgtatacgggttaggtacgttacgtagggtaacgggaacggggtacccgtaatttacccgaactaaaacgtttcccgtaaccgaaaggtaaacgtaaacccgtaaaccgacccgtaaaaacgggaaccctacctaacgtttacggtaacttcccgttaacgggaaaaccttaaaaacgttaaacgaaccgttaaccggtaacgaaaaccggggtaccggaaccgggtaaaccgtacgggtccgtttaggtacggtttttactttccggttaggacccggtaccggggttaacgggtaccgtttaccccgggtaacggttcgtaaaacttttaacgttttaaccgtaacccgaaacccgttaacgtaaggttaaacccgttttaccccggg

SEQ ID NO: 223613 - DNA, 695 bp, Homo sapiens
  misc_feature: GYAE6OF02G6NKX.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctatttagaggtgtcagtgtgaggtgcagctggtggagtcgtggggggagcgttggtccgagccgtggggggtccctggagagtctccgtgtacaacctctggattcattgtttagtagtctattggatgaacgtgggtccgccaggctccggaggggagggctgggaggttggggtacgccgtaacaagtaaaacggacgaaggtagtagggaagtacggaaagaaagttaactagtggtagtaaccgtcgttgggtaggaaccggggtacgtagttacgaacgtaagttacccgtaccaagggtaaccgaacctaaaccggaccgaaaacggtaacctaccaacttgtaacttctacgtaacgtaaaataaaacgtcgaaccggttaacgaaacggacccgaaggaaccggaaggccgttaggttacgttattccgtgtacggacggaacggtacccgttaccgtaacgggttacgtaaacttaactttaacgttaaccaaaccgtacgtaacgttaacggttaacccgg

SEQ ID NO: 223614 - DNA, 718 bp, Homo sapiens
  misc_feature: GYAE6OF02GAB4B.12.11.A11.1.454.CMB.1.raw
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
tcagatacgacgtacacgaccggtgctcgatttagctacgactgcaggggggggtcacgaagaggcagcgctctcgggacgtctccaccatggcctgggctcgtgctgctcctcactctcctcacgtcaggacaacgacgggttccctggggcccctaggtcctggccccttaggaccttccgagcccgttgccccttccggtgttccgtgggtcctccgtgggacaggtcactccaccatccgtcctgacnccgtggaacccnggacaggtgactgcgtgggatcgataagttgtctcctggtaccaacatccaccaggaccaaacgtcccccagtacctcagttgtattttagcggacgggactacgtaacggccggtccgttcgttaggggttttccttacgtcggtccttcgtactcggcctaccggacgtcgtcgggaccaaccgtccgggtccctccgtagacctacgttccgtcgtcgggccttacccggaggtcgacgggacggacggcgggtacgttacttagttacgttcgtatccttagtagtacggtcgggtacggttagtaacgtcgttaacgttcgtacttcgtttccgtacggttcgggaccggtaacgggtacctaacggtccgttacccggtacccggtttcccggtacggttacccgaaccgggttaccccgaacgggttcccgttcccggtacccccgg

SEQ ID NO: 223615 - DNA, 615 bp, Homo sapiens
  misc_feature: GYAE6OF02GWXQW.12.11.A11.1.454.CMB.1.raw
  modified_base (458)..(458): a, c, t, g, unknown or other
  misc_feature (458)..(458): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagagtctcctgtacacctctggattcattgtttagtagtctattggatgaacgtggtccgccaggctaccggaggggaacggggctgggaggtggggtcggaccaacaagtaaagacgaaaggagtagggaaaggtagaaagaaatacgtaagtggtaggactcgtggtaggaagggccgtatcaactatctacagacgacaacgcaagaactcactntatctagaactaaataacagacctaagaaacgtccggaagaccgaggtccttaggtattaatttcgtaggtacgacggtaacgggtaacctccggtaacggtacgtaacttaaatttacgtaaccaaaccgaagttaactaacggttccgtaacccg

SEQ ID NO: 223616 - DNA, 890 bp, Homo sapiens
  misc_feature: GYAE6OF02IH7O5.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtggggggagtcgttggtccaggcccggtggggggtccctaggtagtacgtccttcccgtagtaccaacctcgtggtactttcgatttggtttaagtagtctaagttgggaacttaggaacgttcggggttcccgacccgaacgggtcccgttacccgggaagggggggaacgggggtccgtagggggtacgggttcgggggtacgggtaaccccgaaaacgtaaagttaaaaacggacggaaaacgggtagttaacggggtaaaggttaagggaaaacgtaaaagttaaaccgtaagttcgggtaacggttaacgtcgtaggttacgggaaacggggtcccgtaacgtttaccaaaccgtaaacgtttcccaacccggaaaggaaacccgtaaaccgtaaaacccggaaccccttaaaaacggtaacccttaccctaaacggttacgttaaacttcccgtaaagaaacctaaaaaaccgttaaaacgtccgtaaccccgttaaagggaaaacccggacccggggaacgaaccgtaacccgggttacggttacggtttaagttttaccgttttcgacgggttcggaacgggtacgggttaaccccttacggtaaccgggttattaaacccgttaaagttttaacctaccgaaaacccgtggtaaaccgttaacgtttcccgg

SEQ ID NO: 223617 - DNA, 1023 bp, Homo sapiens
  misc_feature: GYAE6OF02HWHOE.12.11.A11.1.454.CMB.1.raw
tcagatacgacgtacacgaccggtgctcgatttagctacgactgcagggggtctcagagaggagccttagccctggactccaaggcctttccacttggtgatcagcactgagcacagaggactcaccatggaattggggctgagtcgtgggttttccttgttgcttattttagaaggtgtccagtgtgaggtgcagcgtgggtggagtcgtgggggagtcgttgggtccaggccggtcggggggtccctggagacgtcctcctgtaccaacctcgtaggactttcagttagtttaggtagttactagtttggattaggtaacgttcggggtccccgaccgacggtccttcccgggaaagggggtacgggggtccttaggggacgggttggggggtacggacccctaaaacgtaacggttaaaacggacgtaaaacggtaggttagggggaaaaggttcggaaaaaggtaaaacgttaaccgttaaggtttagggtaccgggttaaccttccggtttaaggggtagggtaaaccgggggtccccgttaagtttacccgaaaccggttaaatttcccccggtaaccggaaaacggggaacctaaacccggaaacccggtaaacccgtaaaaaggttaaaccccctagttaaacccgttaggttaacccgtttaccggtaacggtaaaaccttaaaaaagtaaaaccccggtaacgtaaccccggtttaaaagggaaaaccccggggttaacccggtaaacggggggaaacccccgtacgggggtttaacccttttacggggttaaacggtttttacggtttttacccgggtagggtacccggggttacggggttaacccgggggtttaaacccccggtttcccggggtttaaaacgggggtttaacccgttaaaaaacccgtttttaaacgttttttaacccggtaaaaccccggtaaaaccccggtaaaggtttaaaaaaccccggtttttaacccgggttttacccggttaaaacccccgggg

SEQ ID NO: 223618 - DNA, 647 bp, Homo sapiens
  misc_feature: GYAE6OF02GNQAY.12.11.A11.1.454.CMB.1.raw
  modified_base (414)..(414): a, c, t, g, unknown or other
  misc_feature (414)..(414): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagctgggtttcctgttgctatttagaagtgtccagtgtgaggtgcagctgggtggagtcgtgggggaggcttggtccaggccgtggggggtcccctgagagtcctctagtaccaacctcgtggatttcgattgtttagtagtctattgggatggaactggggtccgccgaggtcctaccgaggggaacgggggcttggggaggttggggcggacccaaacgaagtaaaaggccgaaagagtaggaagtgaagaaatacgtatggtaggactntggtgaagggtccatttccaacaatcctacaggaacaacgacgaccaaagaacctcaactgtactctaggtaacaaaactaacgacgtaccgtaagaaacgccggaggaaccgcgggtcttaggttcgtaattttcgaggttgtaccgggtaggtaccggttacccgttaagggtaactaacgtaaatttttacgaacgaaaccctaagtaacgttaaccggttcgtaacccg

SEQ ID NO: 223619 - DNA, 771 bp, Homo sapiens
  misc_feature: GYAE6OF02FWZWW.12.11.A11.1.454.CMB.1.raw
tcagatacgacgtacacgaccggtgctcgatttagctacgactgcaggggaggtctcagagaggagccttagccctggactccaaggcctttccacttggtgatcagcactgagcacagaggactcaccatggaatggggctgagctgggtttccttgttgctatttagaaggtgtccagtgtgaggtgcagctggtggagtcgtgggggaggtcgttcggtccagccgtgggggggtccctggagagtctcctgtaccacctctggattccattgtttacggagttcagtttggactagtaacgtcgggtcccgtccaagggtcctcccggtaaagggggaacgggggtcctgggggtaacggtggggggtcgtacccgaaaaccgtagttaaaacggactaaggaagttgggaaagtggaaaggaaacttaatagttaggtaggaacccttgtaggtacgggaagggtcccgaaattccgaactaagtcccttaccgaacggaacgtaacgaacccgaccaaacggtaaaccactaacgtacgtaacgttcgtacgaactaaaacgttaaaccaaacgtaccgaacggtaaacgtccggaaacgggaccgttaaccggaccgttaggttcgttattttaccggtaggttaacggaccggttaaacgggaccccggttaaccccggtaagggtttaaccgaaccgtttaaatttttaaccggtaaaccttaaaacccgacgggttaaacctaaacggttttaaccccggg

SEQ ID NO: 223620 - DNA, 711 bp, Homo sapiens
  misc_feature: GYAE6OF02FLKQR.12.11.A11.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
  modified_base (696)..(696): a, c, t, g, unknown or other
  misc_feature (696)..(696): n is a, c, g, or t
tcagatacgacgtacacgaccggtgctcgatttagctacgactgcaggggggttcacaagaggcagcgctctcgggacgtctccaccatggcctgggctctgctgctcctcactctcctcactcagaccacagggtcctgggcccagtctgccctgactcagcctgcctccgtgtctggtctcctggacagtcatcaccatctcctgcnctaggaccagcngtgatgctggagtgataagttntctccgtgtaccaacactcacccaggcaaacncccccganctcatgatttagngacgggtacaaaaaccggccctacggggtactttacgaactccgtaccttctacgttcggacctacccgtaacggtccgttacgggaccaaacccgtacccgggtacccttacccccgttacggtaaccctaaacgttcccgtttacccgtttccggggtccctttaacccggaacgggtaccgtttaacgggaacgggttaacccggaacggtaccgtacggttaactttaacgtttaacccttacggtccgttacggtacctaccgtaagttacgtacggacgtaacgggttacgtacggtacctaacgttcgtacgtacctacggttacggacggtacggaaccgtacgtaccgtacgtaccctaccgtaccggtaccaccggtacccacggtaccncccggttacccccgg

SEQ ID NO: 223621 - DNA, 688 bp, Homo sapiens
  misc_feature: GYAE6OF02FTINF.12.11.A11.1.454.CMB.1.raw
  modified_base (163)..(163): a, c, t, g, unknown or other
  misc_feature (163)..(163): n is a, c, g, or t
  modified_base (175)..(175): a, c, t, g, unknown or other
  misc_feature (175)..(175): n is a, c, g, or t
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (603)..(603): a, c, t, g, unknown or other
  misc_feature (603)..(603): n is a, c, g, or t
tcagatacgacgtacacgaccggtgctcgatttagctacgactgcaggggaggtctcagagaggagccttagccctggactccaaggcctttccacttggtgatcagcactgagcacagaggactcaccatggaattggggctgagctgggttttcctgttgntatttagaggtntccagtgtgagtgcagctaggtggagtcgtggggggacgccgtggttcaacggccgttggggggaactccccgttggacgtactcgttaccctgtcgcctacgccttcgtcggtatttcagtccttnacgttctactattacgtatagtaacgttcgggtaccncctaagacctccgtaggggacggggtcgtaggtagggtcggtcttacgtactgtaactgtaaggtacgtctaaccgtaaacgtaactttacgtactttaccacgtcccgatccgtaagtacggtacgggtaccgtacactaactcctacccgtaagacgtaaacaccgtaccaacgtcaccgtacaccgtagtaactccggtactaccgtaacgtacggaaactaccgttacgacggtacgacccgggacgacgtacccggtanaacgttttacgttcggttacgtaggtacgtacggttaaagttttaggaacggtacgaccgaaagttcggaaaccggggtaggggg

SEQ ID NO: 223622 - DNA, 660 bp, Homo sapiens
  misc_feature: GYAE6OF02FI14T.12.11.A11.1.454.CMB.1.raw
  modified_base (488)..(488): a, c, t, g, unknown or other
  misc_feature (488)..(488): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggaggtcgtggggggaggcttggtccaggccgtgggggggtcccctggagagtctcctgtaccaacctctggattcatgtttagtagtcagttggatcgaacgtgggtcccgccgacgggcctccggaggggaacggggcgtgggaggttcggggtacggacccaagaagtaaacgacaaagagtggaagtgaaagaaatactaagtggtaggactcgtggtaggacgggacctatacaactaactcctacagacaaccgaacaccaagaacctcacgttgtactcgtanaaacctaaactaaacgcgaacccgtaaggaaaccgccggaagaaccgtacgggacttagggttactttaacgttcgtacgtcggaccgaacggggtccttaacccggttagggtacaaacgtttaaagtttctaacccaaaaccgtgaaactttaacggttccgttaaccgg

SEQ ID NO: 223623 - DNA, 768 bp, Homo sapiens
  misc_feature: GYAE6OF02IJ1HB.12.11.A11.1.454.CMB.1.raw
  modified_base (174)..(174): a, c, t, g, unknown or other
  misc_feature (174)..(174): n is a, c, g, or t
tcagatacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgngtctggtctcctggacagtcatcaccatcttcctgcacgtggaaccagcagtgatcgactcgggagtagtagttaagtttgtcctccgttcggtaccaacactccaccgtaggaccaaacgaccccagactactagtagtatttaagtaggaacggaacgaaaaacccggtccgtacgggtactttacgtaacgttcgtactttccgtcgtacgggtaccttacccgtaagtttccgacggtaacctaaaccggtacccgggtaccccttaccccgtacggtaaccttaacgttcgttaccggtaccggggtacccttaccgggacggtacgtcgggtaaacggtcgggtaacggtccgttagttaaccgttttacgttaacgtccggttaccttacggtccttaacgtagtttacgtacggtacgtaaggggttacgttcggtaacccttaccgtttccggaccttacgttacccgggttaccgggacggggttaacggtaaacccgtaggtcccgttaaccggtaccccgttaaccgttaccggaccggtaccggaacccgtaaccgggttcccgtcccggttaccccccgg

SEQ ID NO: 223624 - DNA, 800 bp, Homo sapiens
  misc_feature: GYAE6OF02I4TDK.12.11.A11.1.454.CMB.1.raw
tcagatacgacgtacacgaccggtgctcgatttagctacgactgcagggggaggtctcagagaggagccttagccctggactccaaggcctttccacttggtgatcagcactgagcacagaggactcacatggaagttggggctgagtcgttcgggtttttccttgttagtcttaagtttttaaggaaggttcgtcctagtggtaggtaggtgctagtcgtagggtggtacggtcggtaggggggaggtccgttcggtccgacggtccgggtacggggggtccctagggaacgtacgtccttccgtaggtaacctaacctcgtaggtacttactagtttgtttaacgtcgtacgtaagttggtaatacggtaacggttcgggtacccgtcggtaacggtccgtaaccgggagggggtaacgggtcggtaggggtacggttcgggggtaacgaaccgtaaacgtaagtaaaacggtacgaaacggtaggtaaggtaaaaccggtagaaacgtaaaagttaccgtaaagtcgggtaacgtactcgtaggtaaaggaccggtacttacgtaactaagtaacgtactcccggaaaggtacaaaccgaacgtaaccgaaacgaaaccttccggaaattccggtaatacgtaagaaacctaaagtaaaccacggactaaccggaaagtacccgaaggtaccaggttcctagttacgttattccgggataccggtaagttaccgggtagtccgtttaagacgtttaataaggttacctaaaccggaactaataaccgggttataccg

SEQ ID NO: 223625 - DNA, 889 bp, Homo sapiens
  misc_feature: GYAE6OF02GUDKL.12.11.A11.1.454.CMB.1.raw
  modified_base (692)..(692): a, c, t, g, unknown or other
  misc_feature (692)..(692): n is a, c, g, or t
tcagatacgacgtacacgaccggtgctcgattttagctacgactgcagggggtctcagagaggagccttagccctggactccaaggcctttccacttggtgatcagcactgagcacagaggactcaccatggaagttggggctgagcgttgggtttttccttgttgtcttattttagaggtgtccagtgtgaggtgcagcgtggtggagtcggtgggggacggcgttgggtccaggtccggttcggggggtcccttggacgtacgttcctcccgtagtaaccctaacccttcgtggtacttccagtttggttttaagtaacggttctaaggtttggattacggtaacggttccggggtcccgcccgtaacgggggtcccctaccggggtaaaggggggacggggtaccggttgggggaaggttcggggggtacgggaccctaaaaacgaacgtaaaacggtaccgtaaagggaaggtaaggggtaaacggttaaggaaaacggttaaaacgttaacgttaacgtttgggttaccgggtaaactttccgggttagggtaacgggaaccggggttcccgtaacgttttaccaaacgttaccttaccgtaccgaagggaaccgaaacccgaaaccgaaccgaaacgtaaccctcgtacgttaacgttacttactaacggaaacaaaataaaccgngtaacccgtaagaaaccggcggtaacgggaacctccgggtacgttaggtttcgtttaaccggttgtaacggttcggggaaccgtaccggggtttaacccgtaaccgggtttaacggtaaccgtttaaaagtttaacggtttaacttaaccggtaaaccgtaaacggaacccgtttaaacggtttccgtaaaccccgg

SEQ ID NO: 223626 - DNA, 729 bp, Homo sapiens
  misc_feature: GYAE6OF02GDYIE.12.11.A11.1.454.CMB.1.raw
  modified_base (511)..(511): a, c, t, g, unknown or other
  misc_feature (511)..(511): n is a, c, g, or t
tcagatacgacgtacacgaccggtgctcgatttagctacgactgcagggtggggtcacaagaggcagcgctctcgggacgtctccaccatggcctgggctctgctgctcctcactctcctcactcaggacacgacgggtcctgggcccagtctcgccctgacctcacgcctgcctccgtgtcgtcgggtctccgtggacagtcgactcaccatcctcctgcacgtacggaaccagcagtgagtgacgtgggagtagtagttagtttcgtcctccgtacggtaaccacactaccaccgacggaaccaacccgaccccgagtacctacacgttacgttaagtttagaacggaacgggaaaaccgtaaaacccggtcccggtaacgggttactttacgtaacgtccgttaccttcgtacgtcgtacctacgtacgtcgtacgacaccgtcccgtcccttaccgactaactactccgtcggtcggtcctacgcggtacgtacgggacggtaccgngtacgttagttaacttacgttcgtagtcgtacgtacctagttacgttaggttacggttagttactacgggttcgttaagggtttcgggttaccgggtacgggtaccgggtacggtaaccggttaccgggtaccggtaacccgttaccggtaacgtaccggtaaccgtacccggtaccggtaccccgtccccggttaccccggtacggttccctacccg

SEQ ID NO: 223627 - DNA, 929 bp, Homo sapiens
  misc_feature: GYAE6OF02I9S0D.12.11.A11.1.454.CMB.1.raw
  modified_base (182)..(182): a, c, t, g, unknown or other
  misc_feature (182)..(182): n is a, c, g, or t
  modified_base (224)..(224): a, c, t, g, unknown or other
  misc_feature (224)..(224): n is a, c, g, or t
tcagatacgacgtacacgaccggtgctcgatttagctacgactgcaggggaggtctcagagaggagccttagccctggactccaaggcctttccacttggtgatcagcactgagcacagtaggactcaccatggaattgggctgagcgtgggttttcctgttagctatttagaagtgtaccngtgtgaggtgcagctggtggagtcgtgggggagcgtggtccngccggtgggggtccctgagacgtctctgtacactcgtggtattctatgttagtgtctagttagatcgtaacgtcgggtccacgtaggtaccgtcgaagggacgggtcgtagggtacggtcggggtacgaccgtaacgtaaacgttaacgacggtaaaggtaacgtacgggtaaacggtaggttaaaagaaacgttaaacggttacgttaccgggttacggtaaccgtttacggtttaacgggaaacggggtaaccgggttaacccgtttaacgttaaaccgtaacccgtaaccgttttaacccggaaaccgggtaaacgtaaaccggaaaccccgttaaaccgtaaaccggttaaaccgtaaccccgtacttaaacccggggttaaccctttaaggtaaacccggttaaaccgtttaaaacgtaaaacccgtaaaacccggtaacggttaacccggtaaaggaaaaccccgggtaccccggggtaaaccggttaacccgggtaaaccgggttacccggtttaaaggtttcccggtttaaccgttttcgggtaaccgggtttcccgggtaaacccgggtccggggttttaacccccggtaagggtttaaacccggtaaccggtttaaaaccgttttaaacggtttaccggttaaaaccccgtaaacggttaaaccggttaaaccgttacccgggtttaaaccccgg

SEQ ID NO: 223628 - DNA, 818 bp, Homo sapiens
  misc_feature: GYAE6OF02G47NW.12.11.A11.1.454.CMB.1.raw
  modified_base (142)..(142): a, c, t, g, unknown or other
  misc_feature (142)..(142): n is a, c, g, or t
tcagatacgacgtacacgaccggtgctcgatttagctacgactgcagggggtctcagagaggagccttagccctggactccaaggcctttccacttggtgatcagcactgagcacagaggactcaccatggaattgggctgngctggttttccttgttgctagttttagaaggtgtccagtgtgaggtgcagcgtggtggacgtcgtgggggacggtcgttggtccacgtccggtgggggtccctggacgacgttcctaccgtgtaaccaacctcgttggtattcgtagttaggtttagtacgttacgtagttagtagtacggtaacgttccgggtacccgtaccggtacggtaccgtaaccggagggggtaacgggtcggttacgggtacgggttacggggtaccgaaccgtaaacgtaaacgtaaacggtaacgtaaacggtaggtaacggaacggtaacgaaaacgtaaactacgtaaggttacggtacgtacgttaggtaggtacgggacggtaccgttactacgtaactacgttaccaacggtaagaaaccgaaccgacctaacgaaacgtacctacgtacgttaacgtactacgtaacgaaaacctaaacgtaccgtacgtaacggtaacggaacccgggacgaaccggtacgtaacggttcgttacgttacgttacgtacggtacggtaccggtacggttaacccgggttaccgtaaccgggttaacgttaaacgttaaaccgtttaacttaaccccggtaaacgtaaaccggttaaccgtaaccgggttttaccggtaaccccgtaccgg

SEQ ID NO: 223629 - DNA, 759 bp, Homo sapiens
  misc_feature: GYAE6OF02JL6PE.12.11.A11.1.454.CMB.1.raw
  modified_base (148)..(148): a, c, t, g, unknown or other
  misc_feature (148)..(148): n is a, c, g, or t
  modified_base (194)..(194): a, c, t, g, unknown or other
  misc_feature (194)..(194): n is a, c, g, or t
  modified_base (592)..(592): a, c, t, g, unknown or other
  misc_feature (592)..(592): n is a, c, g, or t
  modified_base (650)..(650): a, c, t, g, unknown or other
  misc_feature (650)..(650): n is a, c, g, or t
tcagatacgacgtacacgaccggtgctcgatttagctacgactgcaggggaggtctcagagaggagccttagccctggactccaaggcctttccacttggtgatcagcactgagcacaggaggacctcaccatggaagttggggctgngcttgggtttccttgttgcttatttagaggtgtccagtgtgaggtncagcgtggtggagtcggtgggggagtcgtggtccaggtccgtagggggtccctaggacgtctccgtcctagtaacctaccgtgtaggtacttcagtttggtttaacggagttacgtagtttaggattacggtaacggttcgggtacccgtcccgaagggtccgtacccgggtagggggaacggggtcgtacgggtagggtcgggtacgggaaccctaaagacgttaaaacggcgtaaagggtaacgtcgggaaagggtacgaaagtaaacgttagttaggtggtaacgacgttcggttaggttacgggaaacggggtccctagttacgaaactaacctccgtacgtaacggaacgacgaaacgtacccgaaacgtctaccgagttactataccggtanaaacgtaaatacgacgttaccaacggaacgtcggaacgtacgacgtgttgtaacgttntcggttaggcgtaccgggtaaacggttcccggtaccggttaaggtaccgtttaaactaggttttaacccaaccggtaaacggtaaccggttaattacccggttacccgg

SEQ ID NO: 223630 - DNA, 778 bp, Homo sapiens
  misc_feature: GYAE6OF02FKT2H.12.11.A11.1.454.CMB.1.raw
tcagatacgacgtacacgaccggtgctcgatttagctacgactgcagggggtctcagagaggagccttagccctggactcccaaggcctttccacttggtgatcagcactgagcacaggaggactcaccatggaattggggctggagcgtgggttttccttgttgctattttagaaggtgtccagtgtgaggtgcagctggtggagtcgtgggggagtcgttcggtccagccgtggggactccctggagtactcctacctgtaccaaccttcgtggacttcatttggttttaagtacgttcgtagttggacttaggaaccgtcgggtcccgaccgacggtccgaccggaggggtaacgggtcgtaggggtacggtggggtacgaccctaaagaactaaaggacgaagtacggtaggtaaggtagtaaagtaacttagttaggtcggtacggtacttcgttggtaacgggacggttacccgtaacgttaccaaccgtaaactttcccgtacccgaaacggtaaccggaaacccgtaaaccgaacccgtaaacggtaaccctaccgtaaccgttaggtactacgtacgaaacctaaaattaaccgacgtaccgtaaggaaccggccggtaaacggaccgtacgtcgttacgttacgttacgtttcggtaggtaccggtacgggtaaccggacccgtttaaccggtacggttaaccgttaaacgttaacgttttaaccgtaaacccgaaccttaacggtaacccgttaacggtttacccgg

SEQ ID NO: 223631 - DNA, 700 bp, Homo sapiens
  misc_feature: GYAE6OF02FG1VI.12.11.A11.1.454.CMB.1.raw
  modified_base (195)..(195): a, c, t, g, unknown or other
  misc_feature (195)..(195): n is a, c, g, or t
  modified_base (537)..(537): a, c, t, g, unknown or other
  misc_feature (537)..(537): n is a, c, g, or t
tcagatacgacgtacacgaccggtgctcgatttagctacgactgcaggggtaggtctcagagaggagccttagccctggactccaaggcctttccacttggtgactcagcactgagcacagaggactcaccatcggaattggggctgacgcgttagggttttccttgttgctattttagaaggtgtccagtgtgnggtgcagctggtggagtcgtgggggagcgttggtccaggccggttgggggtcccctggagagttctcctgtacaccgtgtggacttcattgtttagagtctagttggatagtaacggttcggtcccacgtggcctacggaggggacggtcgtgggaggtggggtcgacccaaagtataaacggcaaaggtacgtaggaagtgaagtaactacgtagtcgtaggactcgtaggtaggaacggccgtattaccgacttaagtccctaagacggtacgaacccaaccgtacctaaaggccctacctaacgttagtacttactaccggaaactaaaaagtaacccnggtaacccgttaaacggaaacgtcccggggaaagtaacccggaacggggttcttacgggttagttttaaccttttcggagttcgggaccggtaacggtacccgggtacgttaacggtcgtaaaccttaggttactaaccaacgtactaacgttacgtttccgg

SEQ ID NO: 223632 - DNA, 240 bp, Homo sapiens
  misc_feature: GYAE6OF01BQL0T.51.52.E08.1.454.CMB.1.raw
  modified_base (122)..(122): a, c, t, g, unknown or other
  misc_feature (122)..(122): n is a, c, g, or t
  modified_base (176)..(176): a, c, t, g, unknown or other
  misc_feature (176)..(176): n is a, c, g, or t
  modified_base (201)..(240): a, c, t, g, unknown or other
  misc_feature (201)..(240): n is a, c, g, or t
tcagcgatcgtatacacgaccggtgctcgatttagtcgagctctcgtcgggcgggcacgaccggtgctcgatttacgtcgaggcctctctaccgcgggcacgaccggtgcctcgactttagngtgctacgagggaaggccagcgtcactctgttcccacctctctcgtagcactcngacgcggctggcaaggcgcatagcnnnnnnnnnnnnnnnnnnnnnnnnnnnnnnnnnnnnnnnn

SEQ ID NO: 223633 - DNA, 156 bp, Homo sapiens
  misc_feature: GYAE6OF01EQ5IQ.51.52.E08.1.454.CMB.1.raw
  modified_base (156)..(156): a, c, t, g, unknown or other
  misc_feature (156)..(156): n is a, c, g, or t
tcagcgatcgtatacacgaccggtgctcgatttagtcgagctctcccgcgggcacgaccggtgctcgatttagagtgctacgaagggaaagggcagcgtcactctgttcccaccctcctctcgtagcactctgagcgggctggcaaggcgcatagn

SEQ ID NO: 223634 - DNA, 162 bp, Homo sapiens
  misc_feature: GYAE6OF01C4GEN.51.52.E08.1.454.CMB.1.raw
  modified_base (162)..(162): a, c, t, g, unknown or other
  misc_feature (162)..(162): n is a, c, g, or t
tcagcgatcgtatacacgaccggtgctcgatttagtcgagctctctcggcgggcacgaccggtgctcgtatttagagtgctaacggaagggaaagggcagcgtcactctcgttcccgccctcctctcgtagcactctgagcgggctggacaaggcgcatagn

SEQ ID NO: 223635 - DNA, 156 bp, Homo sapiens
  misc_feature: GYAE6OF01BYE41.51.52.E08.1.454.CMB.1.raw
  modified_base (156)..(156): a, c, t, g, unknown or other
  misc_feature (156)..(156): n is a, c, g, or t
tcagcgatcgtatacacgaccggtgctcgatttagtcgagctctcccgcgggcacgaccggtgctcgatttagagtgctacgaagggaaagggcagcgtcactctgttcccgccctcctctcgtagcactctgagcgggctggcaaggcgcatagn

SEQ ID NO: 223636 - DNA, 255 bp, Homo sapiens
  misc_feature: GYAE6OF01CKX8C.51.52.E08.1.454.CMB.1.raw
  modified_base (201)..(255): a, c, t, g, unknown or other
  misc_feature (201)..(255): n is a, c, g, or t
tcagcgatcgtatacacgaccggtgctcgatttagtcgagctctctcggtcggggcacgaccggtgctcgatttagtcgagctctctcgcgggcacgaccggtgccgtccgatttagagtgctacgaagggaagggcagcgtcactctgttcccaccctcctctcgtagcactctgagcgggctggccaaggcgcatacgnnnnnnnnnnnnnnnnnnnnnnnnnnnnnnnnnnnnnnnnnnnnnnnnnnnnnnn

SEQ ID NO: 223637 - DNA, 168 bp, Homo sapiens
  misc_feature: GYAE6OF01AQCBM.51.52.E08.1.454.CMB.1.raw
  modified_base (155)..(168): a, c, t, g, unknown or other
  misc_feature (155)..(168): n is a, c, g, or t
tcagcgatcgtatacacgaccggtgctcgatttagtcgagctctctcggcgggcacgaccggtgctcgatttagtcacgcgagaaagggaaggcagcgtcactctgttcccgcctcctctcgtagcactctgagcgggctggcaaggcgcatagnnnnnnnnnnnnnn

SEQ ID NO: 223638 - DNA, 154 bp, Homo sapiens
  misc_feature: GYAE6OF01CHQFP.51.52.E08.1.454.CMB.1.raw
tcagcgatcgtatacacgaccggtgctcgatttagtcgagctctcccgcgggcacgaccggtgctcgatttagagtgctacgaagggaaagggcagcgtcactctgttcccaccctcctctcgtagcactcgagcgggctggcaaggcgcatag

SEQ ID NO: 223639 - DNA, 584 bp, Homo sapiens
  misc_feature: GYAE6OF01A0UOV.51.52.E08.1.454.CMB.1.raw
  modified_base (243)..(243): a, c, t, g, unknown or other
  misc_feature (243)..(243): n is a, c, g, or t
tcagcgatcgtatacacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtctccgggacagacagccaggatcacctgctcaggagatgtactagggaaaaaatntgctcgttggttccagcagaggcggccaggccctgtctgatgatttataaagacactgacgccggtccctacgagggactcccgtgacgcgtattccgtccggctccgagcctacgacgggtactacgacgtcaccttcgaccatcgacggccggggccctaggtttcgacgtagtggacggtctagtaacttattaccgttagttacctcgtggccgggtctaggaacctaacgtattcgtagggtacttaggttccgggacggggaacgggacccaaggtccgtacgggtacccgttacgttacgggtccaacggccccgaaagggtcccgttacccgg

SEQ ID NO: 223640 - DNA, 682 bp, Homo sapiens
  misc_feature: GYAE6OF01CNHCW.51.52.E08.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
tcagcgatcgtatacacgaccggtgctcgatttagtcgagctctcagagagaaagggggtaggctcaggaggcagagctctgattgtctcaccatggcctggatccctctcctgcctccccctctcattctctgcacagtctctgtggcctctatgagctgacacagccatactcagtgtcagtcgtcctccgggacagacagccaggatccacctgctcgagganagtagtacgtaagggaaaaaaatntgcttcgttggtccagcgagacggcggccacggccctgtctgatgtatttaanaagactacgtgacgccggtcctagacggggtacttcccgtagacggtctaacgttccgtccgggtacctcccgaacgtccgtacggaacggggtaacccttaacgtcggttaccctaacccgtttacgaaaccccgtacttcccggaaaccggggtcccgggggtaccccttaagggttttaccgaacggtaacgttcgggaacggtccttaacggtaacttacgtttacgtacggttttaactcgtacggtccgtacgtagtaacctaacgtagttaccgtagggtacttacggttcgggacgggtacggtaccaacggtccgtacggtacccgttacgttacgggacctacggtacccgacggtccgttaccccggg

SEQ ID NO: 223641 - DNA, 761 bp, Homo sapiens
  misc_feature: GYAE6OF01CPX1L.51.52.E08.1.454.CMB.1.raw
  modified_base (657)..(657): a, c, t, g, unknown or other
  misc_feature (657)..(657): n is a, c, g, or t
  modified_base (678)..(678): a, c, t, g, unknown or other
  misc_feature (678)..(678): n is a, c, g, or t
tcagcgatcgtatacacgaccggtgctcgatttagtcgagctctcagagagaaagggggtagcgtcaggaggcagagctctggattcgtctcaccatggcctgggactccctctcctgcctccccctcctctattctctgtcactagtctctgtcggcctctatgtagctgacctacacgccaattaccgtccaggtcgtacgaggtcgtaccgttaccgggaacaggaaccacggacccgaaggacttaccgaacccgttagaccttacgaaggtacgaagttaggtaaaccgttaaagggaaaaaaaaattaacgtccggtaccgttaccggtttaccgggtttaccctaggttaccgtaaagggttaaacggggcccggggacccgtaaccgggttcccccgttaggttcccggttacggtagttacggtaactttttaacgaaaagacgtaccgttaggtaccggtaccggcccgtacgacggggtacctccccggtaaggacggtcgtactttcccgtccggacctcgacgtctacggaacgggtacctaacggcgtaccgtacgtcgaacctagtcgacggtccgggtaccttaggttcgacgagtcggacgtctagtactatttacgtgttaccgtcggtacggtacgtntacgaactaacgtcgttacgngggtactagggttccggacggtaccggacacggtccgtacgtacccgttgttaccggtacaccggtaccacggtccgtacccg

SEQ ID NO: 223642 - DNA, 252 bp, Homo sapiens
  misc_feature: GYAE6OF01EL8TZ.51.52.E08.1.454.CMB.1.raw
  modified_base (198)..(252): a, c, t, g, unknown or other
  misc_feature (198)..(252): n is a, c, g, or t
tcagcgatcgtatacacgaccggtgctcgattttagtcgagctctctcggcgggcacgacccggtgctcgatttagctctacgctcagggcacggacccggtgctcgatttacgaggtgcctacgaagggaagggcagcgtcactctgttcccacctcctctcgtagcactctgacgcgggctggcaaggcgcatagnnnnnnnnnnnnnnnnnnnnnnnnnnnnnnnnnnnnnnnnnnnnnnnnnnnnnnn

SEQ ID NO: 223643 - DNA, 191 bp, Homo sapiens
  misc_feature: GYAE6OF01ETMDY.51.52.E08.1.454.CMB.1.raw
tcagcgatcgtatacacgaccggtgctcgatttagtcgagctctctctcgcgggcacgaccggtgctcgatttagcgagacgcgcagggcacgaccggtgctcgatttagagtgctacgaagggaagggcagcgtcactctgttcccaccctcctctcgtagcactctgagcgggctggcaaggcgcatag

SEQ ID NO: 223644 - DNA, 173 bp, Homo sapiens
  misc_feature: GYAE6OF01A7FLG.51.52.E08.1.454.CMB.1.raw
  modified_base (169)..(173): a, c, t, g, unknown or other
  misc_feature (169)..(173): n is a, c, g, or t
tcagcgatcgtatacacgaccggtgctcgatttagtcgagctctctcgcaggcacgaccggtgctcgatttagtcacgcgagaaagggaaggggctggcaaggcgcatagctgcctggtcaaggactacttcctcgtagcactctgagcgggctggcaaggcgcatagnnnnn

SEQ ID NO: 223645 - DNA, 591 bp, Homo sapiens
  misc_feature: GYAE6OF01BU23A.51.52.E08.1.454.CMB.1.raw
tcagcgatcgtatacacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtctccgggacagacagccaggatcacctgctcaggagatgtaactagggaaaaaatgtgctcgttcggttccagcgagacggcggccacggccctgtcttagatagtatttaacaaagactacgtgacgccggtcctacgacgggtactcccgtgacgcgacgtttcctcccggctccgacgcgtacgacgggtactacgacgtacctaccttgaacctatcgacggccggggtccctaaggtttcgacgtacgtggacgtcgtacgtacttattacgtacgtttactcgtcgccggtatacgaacaacgtattcggtaggtactacgttcgggacggacggtaccaacggtctacggacccgtttacgttacggaccaacggacccgaggtcccgtaccccgg

SEQ ID NO: 223646 - DNA, 676 bp, Homo sapiens
  misc_feature: GYAE6OF01ETS8F.51.52.E08.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
tcagcgatcgtatacacgaccggtgctcgatttagtcgagctctcagagagaaagggggtaggctcaggaggcagagctctgattgtctcaccatggcctggatcccctctcctgctccccctcctcattctctgcacagtctctgtgcctctatgagctgacacagccatactcagtgtcagtgtcctccggganagacagccaggatcacctgctcgagganatgtactaagggaaaaaatntgcttcgttgttccagcagaggcggccaggccctgtctgatgtatttanaagacacgtgacgccggccctcgagggtactcccgtagacgcgtacgtttcccgtcccgggtcctcccgaacgtccgttacggaacggggtaccttaaccgtacgttacctaacccgttttacgaacccctagttacccgggacgggtcccgggggtaccccttaagggttttacgaccggttagtgggaacggtcttaggtacctttaacgtttaaccgttggttaacctcggttggaccgtacgttacgaactaacgttagttaccggtagggtaactttacggttaccggggacgggaaccgggtaaccgacggtccgttacggtacccgttacggttacggaccgtaaccggccccggtaaaggtcccgttacccccgg

SEQ ID NO: 223647 - DNA, 581 bp, Homo sapiens
  misc_feature: GYAE6OF01B87A9.51.52.E08.1.454.CMB.1.raw
  modified_base (126)..(126): a, c, t, g, unknown or other
  misc_feature (126)..(126): n is a, c, g, or t
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
tcagcgatcgtatacacgaccggtgctcgatttagtcgagctctcagagagaaagggggtaggctcaggaggcagagctctgattgtctcaccatggcctggatccctctcctgcctccccctccncattctctgcacagtctctgtggcctcctatgagctgacacagccatactcagtgtcagtgtctccggganagacagccagatccacctgctcagganatgtaacgtaagggaaaaaatgtagcttcgttggttccagacacggaaggccggccacggccctgtctgatgtaattanaagcagtgacgcgccctagacggtactcccgtagacgccgtacgttccgtcccggtcctacccgagtccgtacggaccgggtacctacggtaccacgtagttccggactagtcgacggtcggacggtaccgaagggacgagggaacgggacgtaggacgtagtaacgttatttagtcgtaacaactacaacgtacgacctacgtattacggttacttacgtgttaccttacggactgaccacgtacgctaccgtcgtacgacaccgccgaaccgaccc

SEQ ID NO: 223648 - DNA, 633 bp, Homo sapiens
  misc_feature: GYAE6OF01CURRW.51.52.E08.1.454.CMB.1.raw
  modified_base (610)..(610): a, c, t, g, unknown or other
  misc_feature (610)..(610): n is a, c, g, or t
tcagcgatcgtatacacgaccggtgctcgatttagtcgagctctcagagagaaagggggtaggctcaggaggcagagctctgattgtctcaccatggcctggatccctctcctgctccccctcctcattctctgcacagtctctgtggcctctatgagctgacacagccatactcagtgtcagtgtcgtccgggacagacagccaggactccacctgctacgaggagtagtagtaacgtaaaggaaaaaattgtcgtacgttcggtttacgttaccgagacgaaggacgggccggtaccgacggtccccgttgtctgtatagttaatttaagaacgactacgtgacggccggacctacggacggtctaccgtaggacgtcgtacttccgtccggcctaccgacgtcgtacggacggtaacctacgtcgtacctaccgtcgacctagtaccggacggtcccgggacgttacggttcgacgtagtcggacgtctagtactttaacttacgttcgttaacctcgcggtacgtcttagaactaattacgtcgtacggtacgtcgtagggacggtaacgaccgtaaggtcgtacgtacggttacgtacggaaccncggaaccgtcgggtccgtccccg

SEQ ID NO: 223649 - DNA, 822 bp, Homo sapiens
  misc_feature: GYAE6OF01DVS7V.51.52.E08.1.454.CMB.1.raw
  modified_base (210)..(210): a, c, t, g, unknown or other
  misc_feature (210)..(210): n is a, c, g, or t
tcagcgatcgtatacacgaccggtgctcgatttagtcgagctctcagagaggaaagggggtagctcaggaggcagagctctgattgtctcaccatggcctggatccctctcctgcctccccctctcattctctgcacagtctctggtcgcctctatgagtctagacacacgccatacctcgagttgtcaggttcgtaccgtaccgggaanagacagccgagactccacgtgctagaggatatagtaacgtaaaggtaaaaatgtagtcgttcggttcgtacagacgaggacggcggaccgaccggtcctgttcgtagtattagttaatttaacaaacgtacgtacgtcgaccggtccggtacccgtacggaacgggtacctaccggtacggtacggtacgttaccgtttcccggtacccggtacctaccggtaccggtaccgtaacgggtaaccggtaaccgtaaccggttaccgtaccccgttaaccggtttaaccgacccgttaacggtacccgggtacccggggtacccgggtacccgtttaagggttaacccggaaccggttacggtacggtacggtaccgtttaacgttaacctttacgtttacgtttacgttccggttacgtacgggtaccgtaacgttaacgaaaccgtttaacgttacgggttaccggttaagggttacggtttacccgggtaccgggggaaccgggtaaaccggttaaccggtaccggttccggttacccgggttacccgtttaacggtaacccgggaaccggtacccggtaacccggtacggttccccggtaaccccccggg

SEQ ID NO: 223650 - DNA, 211 bp, Homo sapiens
  misc_feature: GYAE6OF02H546I.51.52.E08.1.454.CMB.1.raw
  modified_base (197)..(211): a, c, t, g, unknown or other
  misc_feature (197)..(211): n is a, c, g, or t
tcagcgatcgtatacacgaccggtgctcgatttagtcgagctctcgtcggcgggcacgaccggtgctcgactttagtcgagctctctcgcggcacgaccggtgctcgactttacgagtgctacgaagggaaggcagcgtcactcgtgttaccacctcctctcgtagcactctgagcgggctggcaaggcgcagtagnnnnnnnnnnnnnnn

SEQ ID NO: 223651 - DNA, 258 bp, Homo sapiens
  misc_feature: GYAE6OF02GESOK.51.52.E08.1.454.CMB.1.raw
  modified_base (201)..(202): a, c, t, g, unknown or other
  misc_feature (201)..(202): n is a, c, g, or t
  modified_base (205)..(258): a, c, t, g, unknown or other
  misc_feature (205)..(258): n is a, c, g, or t
tcagcgatcgtatacacgaccggtgctcgatttagtcgagctctctcggtcggggcacgaccggtgctcgatttacgtagtggtagattccgcgggccacgaccggtgctcgatttagctacgctctaagggaaagggcagcgtcactctgttcccgccctcctctcgtagcactctgagcgggctggcaaggcgcatagnngannnnnnnnnnnnnnnnnnnnnnnnnnnnnnnnnnnnnnnnnnnnnnnnnnnnnn

SEQ ID NO: 223652 - DNA, 194 bp, Homo sapiens
  misc_feature: GYAE6OF02IW0PR.51.52.E08.1.454.CMB.1.raw
  modified_base (193)..(194): a, c, t, g, unknown or other
  misc_feature (193)..(194): n is a, c, g, or t
tcagcgatcgtatacacgaccggtgctcgatttagtcgagctctctctcgcgggcacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnn

SEQ ID NO: 223653 - DNA, 192 bp, Homo sapiens
  misc_feature: GYAE6OF02HC33U.51.52.E08.1.454.CMB.1.raw
  modified_base (160)..(192): a, c, t, g, unknown or other
  misc_feature (160)..(192): n is a, c, g, or t
tcagcgatcgtatacacgaccggtgctcgatttagtcgagctctctcggtcggggcacgaccggtgctcgatttagagtgctacgaagggaaagggcacgcgtcactctgttcccgaccctcctctcgtagcactctgagcgggctggcaggcgcatagnnnnnnnnnnnnnnnnnnnnnnnnnnnnnnnnn

SEQ ID NO: 223654 - DNA, 156 bp, Homo sapiens
  misc_feature: GYAE6OF02GGJ0Z.51.52.E08.1.454.CMB.1.raw
  modified_base (155)..(156): a, c, t, g, unknown or other
  misc_feature (155)..(156): n is a, c, g, or t
tcagcgatcgtatacacgaccggtgctcgatttagtcgagctctctccgggcacgaccggtgctcgatttagagtgctacgaagggaaagggcagcgtcactctgttcccgccctcctctcgtagcactctgagcgggctggcaaggcgcatagnn

SEQ ID NO: 223655 - DNA, 168 bp, Homo sapiens
  misc_feature: GYAE6OF02GW8VJ.51.52.E08.1.454.CMB.1.raw
  modified_base (158)..(168): a, c, t, g, unknown or other
  misc_feature (158)..(168): n is a, c, g, or t
tcagcgatcgtatacacgaccggtgctcgatttagtcgagctctcgtcgcgggcacgaccggtgctcgatttagtcgatagtgaagggaaagggcagcgtcactctgttcccaccctcctctcgtagcactctgagcgggctgggcaaggcgcatagnnnnnnnnnnn

SEQ ID NO: 223656 - DNA, 395 bp, Homo sapiens
  misc_feature: GYAE6OF02GSLJB.51.52.E08.1.454.CMB.1.raw
  modified_base (46)..(46): a, c, t, g, unknown or other
  misc_feature (46)..(46): n is a, c, g, or t
  modified_base (340)..(340): a, c, t, g, unknown or other
  misc_feature (340)..(340): n is a, c, g, or t
  modified_base (365)..(395): a, c, t, g, unknown or other
  misc_feature (365)..(395): n is a, c, g, or t
tcagcgatcgtatacacgaccggtgctcgatttagtcgagctctcncgcgggcacgaccggtgctcgatttagtcgagctctctcgcgggcacgaccggtgctcgatttagtcgagctcgtctacggcgggcacgaccggtgctcgatttagcgagcttcgctacggcggcacgaccggtgctcgatttagcgagctcgtctagcggctacgaccggtgctcgatttagcgagctctctcgcgggctacgaccggtgctcgatttagcgagcctcgtctcggcgggctggccaaggccgcattagcgtggcctggtcaagggctacttcgcgtagcactntgagcggctggcaaggcgcagtcgnnnnnnnnnnnnnnnnnnnnnnnnnnnnnnn

SEQ ID NO: 223657 - DNA, 155 bp, Homo sapiens
  misc_feature: GYAE6OF02HIQSV.51.52.E08.1.454.CMB.1.raw
tcagcgatcgtatacacgaccggtgctcgatttagtcgagctctctacgcgggcacgaccggtgctcgatttagagtgctacgaagggaaagggcagcgtcactctgttcccaccctcctctcgtagactctgagcgggctggcaaggcgcatag

SEQ ID NO: 223658 - DNA, 158 bp, Homo sapiens
  misc_feature: GYAE6OF02FLE0K.51.52.E08.1.454.CMB.1.raw
  modified_base (157)..(158): a, c, t, g, unknown or other
  misc_feature (157)..(158): n is a, c, g, or t
tcagcgatcgtatacacgaccggtgctcgatttagtcgagctctctcggcgggcacgaccggtgctcgatttagagtgctacgaagggaaagggcagcgtcactctgttcccaccctcctctcgtagcactctgagcgggctggcaaggcgcatagnn

SEQ ID NO: 223659 - DNA, 208 bp, Homo sapiens
  misc_feature: GYAE6OF02HKHLK.51.52.E08.1.454.CMB.1.raw
  modified_base (174)..(208): a, c, t, g, unknown or other
  misc_feature (174)..(208): n is a, c, g, or t
tcagcgatcgtatacacgaccggtgctcgatttagtcgagctctctcggcgggcgacgaccggtgctcgatttagtcgagctctctcgcgggctggcaaggcgcatagctgcctggtcaaggactacttcctcgtagctcgtagcactctgagcgggctggcaaggcgcatagnnnnnnnnnnnnnnnnnnnnnnnnnnnnnnnnnnn

SEQ ID NO: 223660 - DNA, 202 bp, Homo sapiens
  misc_feature: GYAE6OF02HI8SM.51.52.E08.1.454.CMB.1.raw
  modified_base (195)..(202): a, c, t, g, unknown or other
  misc_feature (195)..(202): n is a, c, g, or t
tcagcgatcgtatacacgaccggtgctcgatttagtcgagctctctcggcgggcacgaccggtgctcgatttagtcgagctctctcgcgggcacgaccggtgctcgatttagagtgctacgaagggaaagggcagcgtcactctgttcccgccctcctctcgtagcactctgagcgggctggcaaggcgcatagnnnnnnnn

SEQ ID NO: 223661 - DNA, 692 bp, Homo sapiens
  misc_feature: GYAE6OF02JBSUU.51.52.E08.1.454.CMB.1.raw
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagcgatcgtatacacgaccggtgctcgatttagtcgagctctcagagagaaagggggtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactgggaaaaaaatntgctcgttgttccagcagaggcggccaggccctgtcttgatgatttanaagacactgagcggccctnagggatcccgtgagcgattctcggctccagctcgagggactacgacgtaccacccgtttcgacccgtataccgacgggcccgggggtacccctaaggttttaccggaaccggtaagttacgggacgggtaccttacgggtaacctttaaccgttttaaccgttacggtttaaccttccgttacggtacccggggtccttaaccggaaacccgtaaaaccgttaaaccgttttccgtagggggttaacttacggtttaccggggaccggggtaacgggggtaaaccccgtaaagggtcccgttaccgggttaaccccggttaccggttttaacgggttacccgtaccgggtacccccgtaaggggtcccctttaacccccgggg

SEQ ID NO: 223662 - DNA, 170 bp, Homo sapiens
  misc_feature: GYAE6OF02GUZ9F.51.52.E08.1.454.CMB.1.raw
  modified_base (156)..(170): a, c, t, g, unknown or other
  misc_feature (156)..(170): n is a, c, g, or t
tcagcgatcgtatacacgaccggtgctcgatttagtcgagctctctcggcgggcacgaccggtgctcgatttagagtgctacgaagggaaaggcagcgtcactctgttcccaccctcctctcgtagcactctgagcgggctggcaaggcgcatagnnnnnnnnnnnnnnn

SEQ ID NO: 223663 - DNA, 340 bp, Homo sapiens
  misc_feature: GYAE6OF02IEEC5.51.52.E08.1.454.CMB.1.raw
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
  modified_base (310)..(310): a, c, t, g, unknown or other
  misc_feature (310)..(310): n is a, c, g, or t
  modified_base (317)..(340): a, c, t, g, unknown or other
  misc_feature (317)..(340): n is a, c, g, or t
tcagcgatcgtatacacgaccggtgctcgatttagtcgagctctcgcgcgggcacgaccggtgctcgatttagtcgagctctctcgcgggcacgaccggtgctcgatttagtcgagctctctcgcgggcacggccggtgctcgattttagcgagctcactcggcgggcacggaccggtgctcgattttagcgagctctctcggcgggcacgccggtnctcgatttagcgagctctcgtggccgggcacggaccggtncttcgtattttacggcgagtcttctacgtcggcggggtctgggaccaagggcncaagtgnnnnnnnnnnnnnnnnnnnnnnnn

SEQ ID NO: 223664 - DNA, 615 bp, Homo sapiens
  misc_feature: GYAE6OF02F6OB7.51.52.E08.1.454.CMB.1.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
tcagcgatcgtatacacgaccggtgctcgatttagtcgagctctcagagagaaagggggtaggctcaggaggcagagctctgattgtctcaccatggcctggatccctctcctgctccccctcctcattctctgcacagtctctgtggcctcctatgagctgacacagccatactcagtgtcagtgtcgtccgggacagacngccaggatcacctgctcagganatgtacgtaggaaaaaatntgctcgttgtccagnaggaggcggaccacggcccgtgtcgtgatgtaattaagtaagactactgacgccggccctcgaggctcccgtgacgcgtatccgtccggtcctcgacgctacgacggtactactcgtacctaccgttcgaacctacgtcgaccgggtaccgggtacccgttaaggttacggaacgtagtacgacggtccgttagtaactttacgtttacgttacgtttaaccgttcgtcggtacggttctaacgtaaacctaagttagttccggtagggttattacgttaccgggacgggtaacggaacgacgtacgtacgtacccgttagttacggtaccgaccgtaccgtacggtccgtacccgg

SEQ ID NO: 223665 - DNA, 550 bp, Homo sapiens
  misc_feature: GYAE6OF01BVZQ8.38.2.A02.1.454.CMB.1.raw
  modified_base (255)..(255): a, c, t, g, unknown or other
  misc_feature (255)..(255): n is a, c, g, or t
  modified_base (545)..(547): a, c, t, g, unknown or other
  misc_feature (545)..(547): n is a, c, g, or t
  modified_base (549)..(550): a, c, t, g, unknown or other
  misc_feature (549)..(550): n is a, c, g, or t
tcagtcgatcacgtcacgaccggtgctcgatttagactcatctacagggaggctggagactgggtcatctggatgtgacatccagatgacccagtctccagactccctgtcagcatctgtaggggacagggtcaccatcacttgccgggcaagtcagagaattagcacctatttaaattggtatcagcagaaagcagggaaagcccctaaaactcctgatctatgctgcatccaatttgcaaagtgggtcccttnaaggttcagtggcagtggatctgggacagatttcagtctcacatcagcagtctgacaacctgaagtattttgactaaacttactactgtacaacagtacgttacacgttaccttctacactttcggacggacgggacctaagggtggaagtatacgaaaacgtacgtaggtggactgaccacctatccttgtccttacacttccttccccgacctacttctcgtaacgtcgtactcgtactcggacggtccgggtcgttacgggccgaaagggtcccgacgtacgtacgnnngnn

SEQ ID NO: 223666 - DNA, 651 bp, Homo sapiens
  misc_feature: GYAE6OF01ASJDT.38.2.A02.1.454.CMB.1.raw
  modified_base (287)..(287): a, c, t, g, unknown or other
  misc_feature (287)..(287): n is a, c, g, or t
  modified_base (641)..(641): a, c, t, g, unknown or other
  misc_feature (641)..(641): n is a, c, g, or t
  modified_base (647)..(647): a, c, t, g, unknown or other
  misc_feature (647)..(647): n is a, c, g, or t
tcagtcgatcacgtcacgaccggtgctcgatttagactcatctacagggaggctggagactgggtcatctggatgtgacatccagatgacccagtctccagactccctgtcagcatctgtaggggacagggtcaccatcacttgccgggcaagtcagagaattagcacctatttaaattggtatcagcagaaagcgagggaaacgcccctaaaactcctgatctatgctgcatccaatttgcaagtcgggtcccttcaaggttcagtgcagtggatcgtggacagtntttcagtctcaccatcagctagtctagctaaccgtgtaagtattttcgactaaacttactactgtacaacgtagtacgtttaacgtacgttacccgttctaccgtacgtttccgggacgggtaacgggaccgtaagggtcggaacgtaacgtaaccgaaaaccggtacgttaggtacgggtctacggaccctaaccgtacgttccgttcggttaccttttaccacctttcccgttacccccgtaccttaacgttccgttacggtaaccggttctaacgttccggtaacgttacgggaaccgggtccggggtaccttacggggacccgtaaacgggcccgtaacgtacgtacggnacgtgngacg

SEQ ID NO: 223667 - DNA, 697 bp, Homo sapiens
  misc_feature: GYAE6OF01DEWWI.38.2.A02.1.454.CMB.1.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
tcagtcgatcacgtcacgaccggtgctcgatttagactcatctacagggaggcgtggagactgggtcatctggatgtgacatccagatcgacccagtctccagactccctgtcagcatctgtaggggacagggtcaccatcacttgccgggcagtcagagaatgcacctatttaaatggtatcagcaagaagcgagggtaacncccctaatcctgatctangctgactatcctaatttcgacgtaaagttgggggtacccttacgtaaggttcaaggttggcctaggtggtaactcgtggtactaggtacttacgaggttcctcgaccacgtcgacgtcgtagtccgtgtaccaccgtagtaagtgtttcgactaacttactacttacggactaaccgtacgtacgttacgtacgttaaccgtttccttaccgttaccggtttacggcccggggtaacgggtaacccgtaaggggtacgggtaaagggtaccttaacgtaaaaccggtaacttacggggtaggttaccgtagaccgttaccgtacgtacgttacgtcttacctacgttacccgttcccgtaccgtacgttacgttaacggacggttaacgacggttaccggacgggtacgtacggggtccgggtaccgtggtacccggtaacggcgtaaccggtacgtaacggactcgacgttcgcg

SEQ ID NO: 223668 - DNA, 844 bp, Homo sapiens
  misc_feature: GYAE6OF01BWILR.38.2.A02.1.454.CMB.1.raw
  modified_base (839)..(839): a, c, t, g, unknown or other
  misc_feature (839)..(839): n is a, c, g, or t
tcagtcgatcacgtcacgaccggtgctcgatttagactcatctacagggaggctggagactgggtcatctggatgtgacatccagatgacccagtctccagactccctgtcagcatcgtggtaggggacagggtcaccatcacttgccgggcaagtcagagaattagctacctatttaaatggtatcgagcagaaagcgaagggaaacgacccctaaactcctagactctaagtgactcgactactcctatttagacgtaaaggtcgggtacccagtacgtaaggttcaggccggtacaaggtcggtaatccggtaggggtaactaggttactttccaccttccgtaccaacctataccgaacgccgaacgtcccgtaggtaccgaacgttccggtaacggtaaaggtttacgttttacgtaaccgtttaaaccgtttttaacgtttaacccgttaacgtaaccgtaaaacgtttaccgtttaaaccgttttaaacgtttaacggttttacgttacccgtttaaccggttaaccgggtttttacccggggggaacgggggtaaaaccccggggttaaacgttaaacgggggttaaccgtaaaccggttaaaacggtttaaaccggaaaaacccgggttacggtttaacggggaaccgttacggtaacccggttactaaccgtaaccgttttcggttaccgttttacccttacgttaacccgttccccttacccgtaaccgtacgtttacggtaccggttaaacggttcgtaaaccgttccggtaggtaccgggaccgggtaccggtcggtacggtaacggacgggtacacgtagtacgncggta

SEQ ID NO: 223669 - DNA, 634 bp, Homo sapiens
  misc_feature: GYAE6OF01BPQFY.38.2.A02.1.454.CMB.1.raw
  modified_base (205)..(205): a, c, t, g, unknown or other
  misc_feature (205)..(205): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
tcagtcgatcacgtcacgaccggtgctcgatttagactcatctacagggaggctggagactgggtcatctggatgtgacatccagatgacccagtctccagactccctgtcagcatctgtaggggacagggtcaccatcacttgccgggcaagtcagagaattagcacctatttaaattggtatcagcagaaagcaagggaaacncccctaaatcctgatctatgctgcatccaatttgacaaagtcggggtcccttcgaaggttcagtggacagtggatcgtgggactagatttcagtctcaccatcagtcagtctagaccaacctgaagtattttagacttaacttactactgtacaacgtagtaactttaccaagttacccgttctctaacgtttcggacgggtacgggacctaagggtacggaagtataaccgaaacggtaacgtgtaggaccttacgaccgtaacctaacgttcctacggttccttactaacttccccgtttaccccgaccctaacgtttccgtaacggtaacggttaccgtacttacccggaaccgttacggacgggtcccggggtacgtaccggggtaccgaacggggccgaccgtaacgttagggacctagngngn

SEQ ID NO: 223670 - DNA, 752 bp, Homo sapiens
  misc_feature: GYAE6OF01D9GQP.38.2.A02.1.454.CMB.1.raw
  modified_base (164)..(164): a, c, t, g, unknown or other
  misc_feature (164)..(164): n is a, c, g, or t
  modified_base (748)..(748): a, c, t, g, unknown or other
  misc_feature (748)..(748): n is a, c, g, or t
  modified_base (750)..(750): a, c, t, g, unknown or other
  misc_feature (750)..(750): n is a, c, g, or t
  modified_base (752)..(752): a, c, t, g, unknown or other
  misc_feature (752)..(752): n is a, c, g, or t
tcagtcgatcacgtcacgaccggtgctcgatttagactcatctacagggaggctggagactgggtcatctggatgtgacatccagatgacccagtcctccagacctccctgtcagcatctggtaggggacagggtccaccatcacgttgccgggcaagtcaganaattagctacttaatttaaatggtatcagcaagaaaggcgaagggaaacctacccctaaacttcctagtattactactgctgcacttacctaattcgacgtaaaggtcggggttcccctttagaacggtttcaggttggacgaggtaggtacttcgagggtaacctagtagtttacgtacggtcctaccgacctaacgttcgacgtacggtaacgtttaccgtacggaccctaaaccggttaaggtaaacgtttaagttttaccgtaccgtaaaacccttttacctaacgttaacggttaactaaccggtaacgtaacttacgttaaccggttaccctttcgttaccgttaccgggtttacgggacgggtacgggaacgtaacgggtacgggtaagaaccgtaaacgaaacgtaaccggttggtaacggtcgtaccgacctaaccgtattacccgttgtttaccctacgttaacctacccgttaccccgacttaccgttacgtaacgtaccggtaacgtacgtaccggttacgtgggaccggtacgggtagtacgggacgaacgcgtaccgtaggttcagtcgngngn

SEQ ID NO: 223671 - DNA, 481 bp, Homo sapiens
  misc_feature: GYAE6OF02FQH6H.38.2.A02.1.454.CMB.1.raw
  modified_base (477)..(481): a, c, t, g, unknown or other
  misc_feature (477)..(481): n is a, c, g, or t
tcagtcgatcacgtcacgaccggtgctcgatttagactcatctacagggaggctggagactgggtcatctggatgtgacatccagatgacccagtctccagcctccctgtcagcatctgtaggggacagggtcaccatcacttgccgggcaagtcagagaattagcacctatttaaattggtatcagcagaaagcagggaaagcccctaaaactcctgatctatgctgcatccaatttgcaaaagtggggtcccttcaaggttcaagttggcagtggatctgggacagatttcagtctcaccatcagcagtctgcaacctgaagattttgcaacttactactgtcaacagagttacagtaccgttctcactttcggcgagggaccaaggtgagatcaaacgaactgtggctgcaccatctgtctcatcttccgccatctgaacgtgatcgactgagcgggctggcaaggcgcatagnnnnn

SEQ ID NO: 223672 - DNA, 783 bp, Homo sapiens
  misc_feature: GYAE6OF02JZ81A.38.2.A02.1.454.CMB.1.raw
  modified_base (198)..(198): a, c, t, g, unknown or other
  misc_feature (198)..(198): n is a, c, g, or t
tcagtcgatcacgtcacgaccggtgctcgatttagactcatctacagggaggctggagactgggtcatctggatgtgacatccagatgacccagtctccagactccctgtcagcatctgtaggggacagggtcaccatcacttgccgggcaagtcagagaattagcactattaaatggtatcagcagaagcagggaancccctaaagtaccgtgactctagtacgctgacataccgtaatttggactaaaggttcggggtcccttacgaaacggttccaggttagccgtaaggttcggaattccggtagggactaggtaacttttccgacggttcaccgtaccattccgaaggcctaacggtctggacctaaccgtggtaacgtactttttcggaaccttaactttacgtacctaggttacctaaaacgtacggttaaacgtttaacctaacgggtttaccccttttacgtaaccgtttacgtttttaccggaccgggggttaacggtaaacccgtacggggtacgggtaaacgtacgttaaccgaaaaccgttaaccgtggtttacgggtaccctagttacccgtaaacgtcgttaaccttcgggttaaccgttccgtaaactttaccccgtttccccggtaaccttaacgtttacccggtaaaggttaccccggttagtaacgttaccccggagtttaccgggaagtccggggttaaccgttagggaacccgttaacgggttccggaaactaccgggtaatcccgggtacgtacgtatacg

SEQ ID NO: 223673 - DNA, 619 bp, Homo sapiens
  misc_feature: GYAE6OF02FRB37.38.2.A02.1.454.CMB.1.raw
  modified_base (287)..(287): a, c, t, g, unknown or other
  misc_feature (287)..(287): n is a, c, g, or t
  modified_base (607)..(607): a, c, t, g, unknown or other
  misc_feature (607)..(607): n is a, c, g, or t
tcagtcgatcacgtcacgaccggtgctcgatttagactcatctacagggaggctggagactgggtcatctggatgtgacatccagatgacccagtctccagactccctgtcagcatctgtaggggacagggtcaccatcacttgccgggcaagtcagagaattagcacctatttaaattggtatcagcagaaagcagggaaagcccctaaactcctgatctatgctgcatccaattttgcaaaggtggggtcccttagaaggttcagtggcaggtgatctggacagntttcagtctcaccatcagctagtctcgacaacctgaagttatttagactaacttactactacgtacaaactagtacgttaacgtacgttaccgtttacctacgttaccgtttcggggacggtaacggggtaacccgaaggggttacgggaaacgtacgttaaccgaaaacgttaaccgtggttacgggcctaggacctaccgtattacttcggttcttacaacttcccgttcccgtcctaacttcgttacggaacgttcgacttccggagtggacggtccgggtactcggggaacgtaccgggcgaacgtacgtaacggntaagcgtagtac

SEQ ID NO: 223674 - DNA, 751 bp, Homo sapiens
  misc_feature: GYAE6OF02FWHHD.38.2.A02.1.454.CMB.1.raw
tcagtcgatcacgtcacgaccggtgctcgatttagactcatctacagggaggctggagactgggtcatctggatgtgacatccagatgacccagtctccagactccctgtcagcatctgtaggggacagggtcaccatcacttgccggcaagtcagagaattacgctaccttatttaaattggtaatcagcagaaagcgaaggaacgtcccctaaactccgagtattacctaagtgccgtagacctattacccgtaaatttcgaacgtaaacggttccggggtaccctttacgaaacggtttcgaggttacggactaagggtcggtaattccgtaggggaactaggtactttcgacgttcctacaccacttacgacgtacctgttacacgtaccaaacggttacgtacgttagttttaccgactaacgttacttacgtacgtaacgaacgacgttaacgttactaaccggtaccgttcctacgtaccggtttacggacgggtacggaaccgtagggtacggtaatacgtaacgtaaccgaacgtagtacggcgtaacgacctacgtacttacggttcgttacgttaccaccgtttacccgtaccccggttctaaccggttttaccaaccggtttaacgtaaccggttagttacccggttacggacggttaaccgggggtccggtaaccggttcgggtaaaccggaccggtcggttaaacccggttagaaccgtagtaccgacgtagtacgg

SEQ ID NO: 223675 - DNA, 529 bp, Homo sapiens
  misc_feature: GYAE6OF01AL1K3.33.3.A03.1.454.CMB.1.raw
  modified_base (517)..(517): a, c, t, g, unknown or other
  misc_feature (517)..(517): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtcccctcacctgcacagtctctggtgactccatcaggaattactactggagctggatccggcagcccccagggaggggactggagtggattggttatgtctttcacaatggcaataccgactacaacccctcctcaagagtcgagtcaccacatcagtagacacgtccaagaaccagttcctccctgaatctgacctctgtgacccgctgccggacaccgggcccgttctattactgtgcgagagccgtcagcaggtgggttgttctactttgactcgtgggccagggactcccgtggtcacccgtctcctctgccctccnccgagggtcccc

SEQ ID NO: 223676 - DNA, 518 bp, Homo sapiens
  misc_feature: GYAE6OF01BENC5.33.3.A03.1.454.CMB.1.raw
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
tcagtacacacactcacgaccggtgctcgatttagagagcgtcacaggggtccttaaattcagggtccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactggagctggatccggcagcccccagggaggggactggagtggattggttatgtctttcacaatggcaataccgactacaacccctccctcaagagtcgagtcaccacatcagtagacacgtccaagaaccagttctccctgaatctgacctctgtgaccgctgcggacacggccgtctattactgtgcgagagccgtcagcaggtgggtggttctactttgactactggggccngggntcccg

SEQ ID NO: 223677 - DNA, 630 bp, Homo sapiens
  misc_feature: GYAE6OF01BFTG1.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattacactggagctggatccggcacgcccccgagggagggactggagtggattggttatgtctttcactaatggacaataccgactacaacccctcctacaagagtcgagtcaccacatcagtacgacacgtaccaaagaacctagttcctccctagtaactcctagtacccttctgtacgacccgtcgtacggaccgacgaccgggtcccgttacttaacgtttacgtgtacgccggtagacgtcccgtacacggcgtaaggttggggttacgtttccttaacgtttcggacgttaccggtcgggggtaccctaggggacttccccggtgggtccctaccccggttcttaccccgttcgtccgtcccgtccccgaaaccggtaccgggtacccccg

SEQ ID NO: 223678 - DNA, 605 bp, Homo sapiens
  misc_feature: GYAE6OF01A0XA7.33.3.A03.1.454.CMB.1.raw
  modified_base (469)..(469): a, c, t, g, unknown or other
  misc_feature (469)..(469): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactgggtgaagccttcggcgaccctgtccctcacctgcacagtctctggtgactccatcaggaattactactggagctggatccggcacgcccccgagggacggggactggagtggattggttatgtctttcacatggcaataccgactaccacccctcctcaagagtcgagtcaccacatcagtagacacgtaccaaagaaccacgttcctaccctagaactctacgaccctctcgtacgaccgctggaccggacgaccggtccgtactacgttactgtcgccgagtacgcccgtanacggtcgtagggttcgggttcgtttaccgttacgtttcggacttacggtcggggtacccgtaggggtaccttcccggtagggtcccaccggttccttcccgtccgtcggaccctcccgacccgaaccgggtccccg

SEQ ID NO: 223679 - DNA, 528 bp, Homo sapiens
  misc_feature: GYAE6OF01C7PW1.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactggagctggatccggcacgcccccgagggaggggactggagtggattggttatgtctttcacaatggcaataccgactaccaacccctccctcaagagtcgagtcaccacatcagtagacacgtaccaagaccagttctccctagaactctagacctctgtcgaccgctgcggacacggcctctattactgtgcgagacgccgtcagcgagtgggtgttctacgttgactcgtggggccagggtctcccgtggtccaccgtctcctctcgccctccacgacggtccc

SEQ ID NO: 223680 - DNA, 875 bp, Homo sapiens
  misc_feature: GYAE6OF01DOG4X.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggtaattactactggagctggatccggcacgccccgagggacgggactggagtggattggttatgttcttcacagtggacaataccgactaaccgtaaccccctccctacgaaagacgtcgagtccaaccaacatacgaagtagaacctacgtacccgaaacgtaccctaacggtttaccctaccccgttaaggtaacttaccgtaccggtaaccctttaccggttacggttacccgggaaccccggttccgttaaccggggacccgggtaaccccggtacggggttacccccgttaccgtttaaaccgttttaacccgtgggtttcggaccgggtaacggtaaccggtccccggttacgaacggtaccggttaggggtttacggggtttaccgggttttaaccgtttaaccggtttttacgggtaaaccccggtttaaccgggtacccgggggggttacccccgtaaacggggggggtttaaccccctttccccccggggttttaggggttacccccccgtttaacccccggggtttacccccgtttcccccggttttaaccccgttaccccggggttacccccccctttaaacccccgggaaaacccccggggttaaccccggggggttaaacccccccccgg

SEQ ID NO: 223681 - DNA, 943 bp, Homo sapiens
  misc_feature: GYAE6OF01DY1WQ.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcgaggagtcggcccaggactggtgaacgccgttcggccgtaccctgtcccctcaccgtgccacagtctcgtggtcgacctccatcaaggtaacttacgacgtggagcgtggactccggcaccgccccgaggggacgggactggagtggtattggttactgttcttacgaactagtcggactaaacgtaccgaacctaacccctaacccccgtacctacgaaacgtacggttaccgaacgttacccaaaccctaactaccgttaaccgtaacggttaaccgaaacccgtaaccggttaaccgaaaacgttaaaccgttaccggtaaccgttttaccccgttaccccgtaagtaaccttcccggtacgtaaccccttcgtaccggttacggaccccgtcgttacgggaccccggtaacccgtacccgggttacccgttaccgtttaagtttacccggttagggtacgaccccgggtaaggtaaccccgggtcccggtaaccggtaacgggtacccggtttaagggggttttaccggggttttaccgtttttacccgtttaaaccgggtttttaccgggtaaaacccgggttttacccgggggtacccgggggttaaaccccgggttaacgggggtttacccccgtttacccccccggggttttagggtttaaccccccccggttaaaccccggttttcccccgtttccccgggtttacccccggtttaacccccgggttaaccccccctttaacccccgggaaacccggggtttaaaaccccccccggggg

SEQ ID NO: 223682 - DNA, 771 bp, Homo sapiens
  misc_feature: GYAE6OF01DOU4Z.33.3.A03.1.454.CMB.1.raw
tcagtacacacactcacgaccggtgctcgatttagagagcgtcacaggggtccttaaattcagggtccagctcacatgggaaatactttctgagagtcctggacctcctgtgcaagaacatgaaacatctgtgttcttccttctcctggtggcagcctccagagtgggtcctgtcccgaggtgcagctgcgaggacgtccgggccaggacgtggtgaacgtccgttcggccgtaccctcgtcccctcacctgccacacgtctcgtaggtgtacctccatacgaaggtaattactacgtggacgtcgtaggtacgtccggaccgtaccggacccccggaaggggacggggtacgtgggtacggttaggtagtttaggttacgttcggttcttacgaacgtaagtacggaactaaacgtaacccgtaaccctaacccgtaaccccctacccgtacgaacggtacgtaccgacgtaccaaccacgtactacgaacgtaacgaccgtaaccgtaacctaaaccgtaaacccgttacgttaccctaccgttacgtaaccttccgttacgtacccgttacgttaccgacgtaccgtacgtaccgggaccggaaccgtacccggtacccgttacgttaccgtttaacgtcggtacggacggacggtaccggacccgtcgacggttccggtagggttcgggtttccgttacgtttaccggtttacggttaaccggttaccgggtacggggtacccggtacgggttcccgttacccgggg

SEQ ID NO: 223683 - DNA, 965 bp, Homo sapiens
  misc_feature: GYAE6OF01EB4C1.33.3.A03.1.454.CMB.1.raw
tcagtacacacactcacgaccggtgctcgatttagagagcgtcacaggggtccttaaattcagggtccagctcacatgggaaatactttctgagagtcctggacctcctgtgcaagaacatagaaacatctgtggttcttccttctcctggtgcagctccagatgggtcctcgtcccgaggtgcagctgcgaggaggtccgggaccaggacgtggtagaacgtccgttcggccgtaccctccgtccctcacctcgaccactacgtcctcgtcggtacgtacctaccgtaactaccgtaaacggtaaactttaaccgttaccggtaggtaacggtccggttaggtaaccggtcccgggaccgaacccggggaccccccggggaaagggggggtaaccgggggtacggtcggggtaagggttacggggtttaacggttttagggtttacgtttccggtttaccgtttttaaccgaaaccggttaacgtacgggtaacctaaaaccgttaaaccccggtaaacccttaaacccccgtaaacccccgtttaccccgttaaacggtaaaccggttaaccgtaaccggtaaccggttaaaccctaaacccgtaacttaacccgtaaccgttaacggtaaacccgttaaccccgtaaaccccggtaaccgtaaaacccggttaaaccccgttaccccgtttaacccgtaaccccgttaaattaaccccgttacccgtaaccccggtttaccgtacccggttaccggtacccggaaccggttaccgtacggggaaccccgtacccggtaccgttacccgttaacgtttacgttaccggtggtaccggaccggagaccccggtacgacggtacggtacgggtttagggttcggtttaccgttaccgtttacggtaacccggttacgggtaccgggtacccggggtacgtaaacccgggttcccggttacccggg

SEQ ID NO: 223684 - DNA, 757 bp, Homo sapiens
  misc_feature: GYAE6OF01BUFRF.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgacctccatcaggtaattactacgtggagcgtcggactcccggcaccggcccccgaaggggaggggactgggaggtggtagttggttatgttctttcgactaagtggacaacgtacccgacctaaccctaaccccctaccctacgaaacgtacgtacgacgtaccaacccgaactagtaccaagtaacgaacctaaccgtacccgtaaaaccgaaccgtacgtttaccctacccgttagtaaccttacgtacgtacccttcgttacggttaccggaacccggtcgtacgggtacccgggaaccgtacccggggtaccctttaccgttaacgtttaccgtcggttccggaacgtaccggacgtacccgtacgaacggtcggtagggtttcggggttcgtttacccttacggtttacgtaccggttaaccggttcggggacccgtagggtacccgtttccgtaccgggttccctaccccggttcccttcccgttaccgttcccgtacccttacccccggaaccggtaacccgggtcccc

SEQ ID NO: 223685 - DNA, 737 bp, Homo sapiens
  misc_feature: GYAE6OF01AHTO0.33.3.A03.1.454.CMB.1.raw
tcagtacacacactcacgaccggtgctcgatttagagagcgtcacaggggtccttaaattcagggtccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactggagctggactccggcacgcccccgagggacgggactgggacgtggacgtttgggttatcgttctttacgaacgtaagtcggactaaacgttacccgaacctaacccgtaaccccctcccttacaaacggtacggtaccgtaacgttacccaacccactacgtaccgaagttacgaacctaaccgttacccgaaagtaaacccctacggtttaccctacccgttaagtaaaccttccgttaccgtaacccttcgttacggtacggtacccgtacgtacgggaccggtaaccgacccgggtcccgttaccttaacgtttaccgtcggtacggaccggtaacggaccggtacccgtacaacgggtacgtaaggggtttcggggttccggttttaccgttaacgttttacggtaaccggtttaccggtacgggggacccgttaggggtaacctttcccccgggg

SEQ ID NO: 223686 - DNA, 755 bp, Homo sapiens
  misc_feature: GYAE6OF01CGPWE.33.3.A03.1.454.CMB.1.raw
tcagtacacacactcacgaccggtgctcgatttagagagcgtcacaggggtccttaaattcagggtccagctcacatgggaaatactttctgagagtcctggacctcctgtgcaagaacatgaaacatctgttgttcttccttctcctggtggcagctcccagatgggtcctgtcccgaggtgcagctgcgaggacggtccgggcccaggactgggtagaacgtccgttcggccgtacccttcgtcccctcaccgtcgaccacgacgttctcgtgggtcacctaccagtacgtaaggtaactttaccgtacgtgggacgtcgtacggaccgtcccggaccgacccggacccccggaggggtacgggacgtgggacggtaggtagtttcggttagttcggttacttacgaacgtaggtacgaactaaaccgtacccgtaacccgtaaacccctaaccccgtacccgtaacaaacggtacgtaccgtaacgtacccaacctactacgttacgaacgtaacgtaccctaaccgtaccaaacgaacccttcgtaccctacctagtacctcgtaccgacctttgtacgtaccgaccgtacgtacggacccggtaccgcccggtaccttacgttacgttcgtagtaccgaacggtacggaccgtccggaacgcggtcggttaagggttcggttaccggtttaccttacccgttaggtaacccgttacgggtacggggaacgtccgggtcccgttaccccgg

SEQ ID NO: 223687 - DNA, 732 bp, Homo sapiens
  misc_feature: GYAE6OF01DC7SA.33.3.A03.1.454.CMB.1.raw
tcagtacacacactcacgaccggtgctcgatttagagagcgtcacaggggactttctgagagtcctggacctcctgtgcaagaacatagaaacatctgtggttcttccttctcctggtggcagctccagatgggtcctgtcccaggtgcagctgcaggagtcgggcccaggactggtgaagccttcggccgaccctgtccctcacctgcacagtctctggtcgactccatacaggtaattactaacgtggatcgtaggacgtccggcaccggacccccggaaggggacggggactggaggtggtagttggttatgttacctttagactaagtggtacaacttacccgacctaacccgaaccccctacctacaaacgtacgtcgacgtccaaccaactactactacggtaacgacctaaccgtaaccaaacggtaaaccctacgttacctccctagtaactccttacgacccttcgttacgaccgtacccgtcgtcggaacccggacggtacccggtccttaaccgtttagtaccgttggtaccggacggtacgacggtacccgtcgaacggtcgtaggggttgggtttacgttttacttacggtttacggaccgttaaccggggtcggggtaccggacggtaccgtccccggttgggttccccgtaaccgttcccttaccccgttccgttacccgtaccccgtaccccgtaaaccgggtaacccggtccccg

SEQ ID NO: 223688 - DNA, 683 bp, Homo sapiens
  misc_feature: GYAE6OF01BH6BM.33.3.A03.1.454.CMB.1.raw
tcagtacacacactcacgaccggtgctcgatttagagagcgtcacaggggtccttaaattcagggtccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtagaacgccgttcggccgaccctgtccctcacctgcacagtctcgtggtgacctccatcaaggtaactttactactggagcgtggactccggcaccggcccccgaggggacggggacgtggaggtggtagtttggttatcgttcttacactaagtcgacaacgtaccgaactaaccctaacccctcccgtacaaggtactacggacgtaccacccaactactacaagtacgaaccgtaccgtaccaaacgaaccctaacgttccctacccgtagtaacctctacgtaccctcgtcgtcgacccgtcgtcggaccggaaccgccggtaccgttacgttaacgttacgtcggtacgacggtacggtaccgtcccggtacgtacggtaccggtagggttcggggtttcggtttaccgttacgtttacggtaccgttacgggtcggggtacccgtaacggggttccgttaccccggg

SEQ ID NO: 223689 - DNA, 937 bp, Homo sapiens
  misc_feature: GYAE6OF01CJ2AS.33.3.A03.1.454.CMB.1.raw
tcagtacacacactcacgaccggtgctcgatttagagagcgtcacaggggtccttaaattcagggtccagctcacatgggaaatactttctgagagtcctggacctcctgtgcaagaacatgaaacatctgtgttcttccttctcctggtggcagctcccagatgggtcctgtcccaggtgcagctgcaggacgtcgggcccaggactggtagaacgtcccttcggaccgtaccctcgtcccctcacccgttgaccactacggttcctcgtcggtacgaccttaccagtaccgaaggtaaactttaaccgtacgtcggaacgtccgtaggaccgtcccggaccgacccggaccccggagggggaccggggtacgtcggggtaacggttaggttacggttttagggtttaacttcgggtttaccttttaaccgaaacggtaacggttaccggggtaaccttaaaacccggttaaccccggttaaaccccttaaaaccccccgttaacccccccgtttaaccccgttaaacggaaaccggttaaccggttaccggtaaaccggttacccaaaacccgtaactaacgttaaccggtaacgtaacccgtaaaccgtaaccccgtaaacccgaaaaccgttaacccgtttaaccgtttacccgtaacccggttaacgttaacccttaccgttaaccgttaaccccgttcgtttaaccggtcccggtaacccgttccgggaccgggtaacccgggtaacccgtacccgggtacccgttttaaccttaacgtttaaccggttcggtaccggaaccggtacggtaccccgtaccggtacgaacggtcggttacggggttccgggtttacgtttacccgtttacggttacggttaaccggttaccggggtagggttacccggtaaccgggttccgttaccccgggg

SEQ ID NO: 223690 - DNA, 728 bp, Homo sapiens
  misc_feature: GYAE6OF01DLKYN.33.3.A03.1.454.CMB.1.raw
  modified_base (443)..(443): a, c, t, g, unknown or other
  misc_feature (443)..(443): n is a, c, g, or t
  modified_base (701)..(701): a, c, t, g, unknown or other
  misc_feature (701)..(701): n is a, c, g, or t
tcagtacacacactcacgaccggtgctcgatttagagagcgtcacaggggtccttaaattcagggtccagctcacatgggaaatactttctgagagtcctggacctcctgtgcaagaacatgaaacatctggtggttcttccttctccgtgggtggcagcctccagtatgggtcctgtcccgaggtgacagctgcgaggacggtccgggccaggacgtggtcgaacgtcccgttacggccgtaccctcgtacccctcaccgtcgactactagttctcgtggtactacctccatacgtaaggtaacttacctacgtggacgtcgtaggaccgtccggaccgtaccggcccggggtgggggacgggtacgtgggtaggtggtatttaggtattcgtcttacgactagcgtactaacgtaccgtaactaccctaaccctccgtaanaacggtacgttacggacctaccgtaacctcaacgttacaacggtaactaccccgtaaacggttacccaaaaggtaaccctttcgtaacccgtacgtaacctacgttccgtacttacctcgtacgtaccggtactccggtaacggaccggaaccggtacccggtcctttaacgttacgtcggttacgtacgacggtaaccgtcggccgtaaggacggtacggttagggttcggtagttacccttaggtacgtacccggngggtccgggactacggttcctacccgg

SEQ ID NO: 223691 - DNA, 678 bp, Homo sapiens
  misc_feature: GYAE6OF01CTJBK.33.3.A03.1.454.CMB.1.raw
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (386)..(386): a, c, t, g, unknown or other
  misc_feature (386)..(386): n is a, c, g, or t
tcagtacacacactcacgaccggtgctcgatttagagagcgtcacaggggactttctgagagtcctggacctcctgtgcaagaacatgaaacatctgtgttcttccttctctggtgcagcctccagatgggtcctgtcccaggtgcagctgcaggacgtcggcccaggactggtnaacgccttcggccgaccctgtcccctcgactgccangtcctntggtnacctccatcgaaggtaaacttccgacgtggacgtcgtaggacgtccggcaccggcccccgaaggggtacgggaacgtgggagtggagtttggttagtcgttcttacgacgaagtcgacaacgtacgacctacccaacccctctacagtacgtcgagtccacacntacgactacgacaccgtaacaaccgtaactacgttcctaccgacgtaactccgtactacctacgtgtaccgtacgtcgtacggacccggtactacccgggtaccttacttaccgttacgtccgtacgaccggtaagtccgaaccgtccgaagtcgtagggttcggttagtttcctagttcgtaccgtacgggtcgggaaccgtacgggtaccgttcccgtacggttcccgacccgggttcttccccgttcgtaccgtaccccgtaccctaacccgggtacggttaccccccg

SEQ ID NO: 223692 - DNA, 775 bp, Homo sapiens
  misc_feature: GYAE6OF01EAG1N.33.3.A03.1.454.CMB.1.raw
tcagtacacacactcacgaccggtgctcgatttagagagcgtcacaggggactttctgagagtcctggacctcctgtgcaagaacatgaaacatctgtggttcttcccttctcctggtggcagctcccagatgggtcctgtcccaggtgcagctgcgaggacgtccgggcccaggtacgtggtagaacgtccgttcggaccgacccttcgtcccctcgacctgacctacgacgttctcgttcggtacgtacctaccaatacgaaggttaaacttacgtaacggttggaacgtcgtacggaccgtcccggaccgacccggaccccggaaggggacgggtacgtaggtaggtaggttacgtttaggtttacgttcggtttaccttaacgtaacgtaacgtacggtaaccgtaaaccgtaacccgtaaccctaaccccgtaaccccttaccgtaacgaagtaccgtacgtaccgtacccaaccgtacgtaactaccgtaacgtaacgtaacccgtaaccgtaccgaaaaccgtacccgttacgttaccttaccgtaagtacctacccgtacgtaccgttacgtcggtaccgaccgtcgaccggaccgtaccgtaccgtacgttacgtacgttacgtgacgacgacgtcctcggtacgacggtacggttcggttcgttcgttaccttacgtaccgtacgtacgggtacgacggtacgtccgtccgttccggtccctccgtcctaccgttccgtacccgtaccacccgacgtccgtcccg

SEQ ID NO: 223693 - DNA, 1102 bp, Homo sapiens
  misc_feature: GYAE6OF01CQX3K.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctccagatgggtcctcgtcccagggtgcagctgcgagggacgtccgggcccaggtaccgtgggtacgaacggtcccgtttccgggcccgtaccccgttcggttccccctcctaacccgttcgacctaaccgtacgtttccgttaccgttggggttacgtaccccttcccgaacgttacgtaaacgggttaaacttttaaccgtaacggtagggtacgtaccggttacggggaaccgttcccgggaccgaacccgggacccccccgggtaaaggggggtaccggggggtacgtggggtaagggtttacggggtagtttttacgggggttttaacgtttcgggtttacctttttaaccgaaacggtaaacggtcgggtaaccttaaaccggtaaccccggttaaaccttaaaccccctaacccccggttaccctaaccggtaaaggtaaccggtaccggtaaccggtccaaacccgttaacgaacgttaaccgtaaacggttaaccggtaacccgaacccggtttaaaccccgaaaccgggttaaaacccgtacccggtttttaccccctaacccggttaacgtaacccgtttaaccgtaccggttaaccctttaccggtacggttaacccgggaacccgttcccgggtacgggtaaccccgggtacccggtaaccccggggttacccgtttaccgttttaaacggttaccggttacccggggtccggggttaccggggaaccggttcccgtaacgggtacgggtcggtttacgggggttcgggttttaccgtttaccggttttacggttaccggttaaccggggtttaccggggtacgggtaccgggttaccgggtacccggtttcccggggttacccggttaacccggttccccgtttcccgttaccccggtttccggtcccccggtaaccccgttaacccggaaaccccggggttcccgggtccccggtttaccccggg

SEQ ID NO: 223694 - DNA, 767 bp, Homo sapiens
  misc_feature: GYAE6OF01EWKXT.33.3.A03.1.454.CMB.1.raw
  modified_base (184)..(184): a, c, t, g, unknown or other
  misc_feature (184)..(184): n is a, c, g, or t
tcagtacacacactcacgaccggtgctcgatttagagagcgtcacaggggtccttaaattcagggtccagctcacatgggaaatacttttctgagagtcctggacctcctgtgcaaagaacatgaaacatctgtgttcttccttctcctggtggcagcctcccagatgggtcctgtcccaggtncagctgcaggacgtccggcccaggtactggtagaacgtccgttcggccgacccttcgttcccctacaccgtcgaccactaggttcctcgttcggtacgtacccttcctaacgttaccgaaagggttaaaactttaccgtaacgttacgggaacgtccgttagggtaaccgttcccgggaccgaacccggaccccccgggaagggggaacgggggtaccgttaggggaacggttacgggttaacgttttgggtttaacgttcgtttacccttttacgaacgtaacgtacggaacctaaacgtaacccgtaacttaaccccaaccccgtccctaacgaagtacgtacgactaccacgtaacatacgtaagtaaccaacgtaaccgttaacgaaacgtaaccctacgttcctaccgttacgaactccgttactacctcgtacgtacgacccgtgacgccgaaccgtaccgtaccgttacttattacgcgtacgacggacgaccgttccgagtacgcgttagggtcgggtttcttaccgtaacggtttcgaacgttacggtacgggaccgtaggtcccttacccggg

SEQ ID NO: 223695 - DNA, 781 bp, Homo sapiens
  misc_feature: GYAE6OF01EBZMK.33.3.A03.1.454.CMB.1.raw
  modified_base (127)..(127): a, c, t, g, unknown or other
  misc_feature (127)..(127): n is a, c, g, or t
  modified_base (249)..(249): a, c, t, g, unknown or other
  misc_feature (249)..(249): n is a, c, g, or t
tcagtacacacactcacgaccggtgctcgatttagagagcgtcacaggggtccttaaattcagggtccagctcacatgggaaatactttctgagagtcctggacctcctgtgcaagaacatgaaacntctggtggttcttccttctcctggtggcagcctcccagatgggtcctgtcccaggtgcagctgcaggacgtcggcccaggacctgggtgaacgcccgtttcggaccgaccccgttgtccccncaccttcgccacgacgtctcttggtagcctaccatcaggtaattacgtactaggactcgtaggacctccggctaaccggcccccggaagggggacgggtacgtaggggaaggttacgggtagttttggttaacgttcgttccgttttaacgaacccgtaaggtacgggtaactaaacgttaacccggtaaccttaaaccccgtaacccccttaccccgtaaaccggtaacgtacggtaccgtaacggttaccccaaacccgtaacctataccgaaggtaaccgtaacccgtaaccgttaacccgaaaccgtaaacccgttaccgggtttaccccttaaccgtaacggtaacttaccgttccgtaacccgttccgttacggtacccgacccgtcggtaccgggacccggtacgtacccggtcccgttacgttaacttaccgtggtacgcggacgacgtccgacgtacgtgtacgttcgggtcgttccgttaactttcggtaacgtacggtacgggccggtacggccgtaccgg

SEQ ID NO: 223696 - DNA, 1195 bp, Homo sapiens
  misc_feature: GYAE6OF01DX27B.33.3.A03.1.454.CMB.1.raw
tcagtacacacactcacgaccggtgctcgatttagagagcgtcacaggggactttctgagagtcctggacctcctgtgcaaagaacatagaaacatctgtggttcttccttctcctggtggcagctccagatcgggtcctgtcccgaggtgcagctgcagggacgtccgggcccaggtacgtgggtacgaacgtcccgttcggacctacccttcggtcccctacaccgtgaccaacgtacgttccttcgttagggtcgtaacctccaacgttacgtaaacggtaaacttacgttaccggtaggacggtacgttacggaccggtcccgggacccgaacccgggacccccgggaaggggggtaacgggtaccggtaaggggtaacgggttgggttaaggttttagggtttaacgtttacgtttaccgtttaaccgaacgttaagtacggtaccgtaaaccggtaacccggtaacccttaaaccccgtaacccccgttacctaaccgtaaacggtacggtaccggtaaccgttaaccaaaccgtaacgtactaaccgtaaggtaaccgaacctaacccggtaaccctaaaccgtaaaccgtttaacccgttacccgtacccgttaagtaaaccgttcccgttaacccgttaacccgtttcggtaaccgggttacccggtaaaccccgtccggttaaccgggtacccggtaaacccgggttaacccgggttaacccggtttaacccttttaaacggtttacccggttacgggtacgggttaaccggtaaccggtaaccccgggttacggtaacccggtaacgggtttacccgggttaacgggggttttaccgggggtttacccgtttttaacccggggttttaaacgtttaccccggggtttaaaacccgggtttcccggggggttaaaacccggggggtaaaacccggggttttacccggggggtttaaaccccccgggttttacccccggggggttttaaacccccgggggttttaaaccccccccggttttttaccccccccggggtttaaacccccgggtttttccccccccgggttttaaccccgggtttaacccccccccggggttttaaacccccccccggggtttaaaccccccccgggtttaaaaaaaaccccccccgggggggttaccccccccggggggtttttaaaa

SEQ ID NO: 223697 - DNA, 694 bp, Homo sapiens
  misc_feature: GYAE6OF01DVDUZ.33.3.A03.1.454.CMB.1.raw
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggacgtcggacccaggactggtagaacgtccgttcggccgaccctgtcccctnacctgcacagtctcgtggtnactccatcaggtaattactagtgagcgtaggtagtccggacacggcccccgaggggacgggactggaggtcggtagttggttacgtcgttactttacacgtaagtcggaactaacgttacccgaccgtaaccctaacccctccgtacgaacgtacgtacgacgtacaacctacacgtacgagtaacgaaccgtacgtacgaaacgactacgttcctactagtactccgtcacctctagtacgaccgtcgtacgacggaaccgtccggtaccgttacttacgttacgttcggacgtacgacgtcgccgttaacgacgtacggtggtttacgggttcgttaccgttacgttaggtaccgtacgggtaccgggacgttaaccggggtccttaccccgggtcggtaccctacccggttacctcccgttaccgacccgttacccgccctaaacccgggtccgtaacccgg

SEQ ID NO: 223698 - DNA, 860 bp, Homo sapiens
  misc_feature: GYAE6OF01ASLRP.33.3.A03.1.454.CMB.1.raw
  modified_base (130)..(130): a, c, t, g, unknown or other
  misc_feature (130)..(130): n is a, c, g, or t
tcagtacacacactcacgaccggtgctcgatttagagagcgtcacagggtccttaaattcagggtccagctcacagtgggaaatactttctgagagtccgtggacctcctgtgacaacgaacatgaaacntctgtgttcttccttctctggtgcagctccagagtcggtcctgtccctaggtgcagctgccgaagggcggtccgggacccagggacctggggtacaacggtcccgtttcgggccgtaaccccttcggtacccctcgaaccgttcgacctacggtacggtttccttcggttacgggtcgtaacctacccgttaacgtacggtaacgggttaaaccttttaacgtaaccgttaggggtaacggttaccggttacgggtaacggttcccgggacccggtaaccccggggacccccgggtaaggggggtaccggggtacggttacggggaggtttagggttagttttaggggtttacttcggttactttacgtacgaacgtcggacctaacggttaaccctaaccgttaccccgacccccttacccgtaacgtaacggtacggttaccggtaacgttaccccgacctaaccgtacgttacgaacgttacgaaacccgtacggaacccgtaaacggaacccttacggtttacccaccgtactacgttccaccgtactcgtcgacgtccgcggtcgacgtaaccgccggtaactcgttactccgtaaggtcggacggtaacgtcggtaccaacgtcgggtaccggttgggttacgggttggttttacccttagggtttttaccggaaacccggtttcggggtacgggacccggtttaacggggtcccgtttcccgg

SEQ ID NO: 223699 - DNA, 239 bp, Homo sapiens
  misc_feature: GYAE6OF02I2Y75.33.3.A03.1.454.CMB.1.raw
  modified_base (235)..(239): a, c, t, g, unknown or other
  misc_feature (235)..(239): n is a, c, g, or t
tcagtacacacactcacgaccggtgctcgatttagagagcgtcacaggggtggttctactttgactactggggccagggatccctggtcaccgtctcctctgcctccaccaagggcccatcggtcttcccctggcaccctcctccaagagcacctctggggcacagcggccctgggctgcctggtcaaggactacttccagtgtgtgtactgagcgggctggcaaggcgcatagnnnnn

SEQ ID NO: 223700 - DNA, 541 bp, Homo sapiens
  misc_feature: GYAE6OF02GWC3U.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactggagctggatccggcagcccccagggaggggactggagtggattggttatgtctttcacaatggcaataccgactacaacccctccctcaagagtcgagtcaccacatcagtacgacacgtccaagaaccagttcctccctagaactctgaccctctgtgacccgctcgcggaccacggccgtctattactgtgcgagacgccgtcagcaggtgggtgttctacgtttgactacgtggggaccagggctcccgtggtccacccgttctcctcgtcgccctccgacccgacgggtccccg

SEQ ID NO: 223701 - DNA, 529 bp, Homo sapiens
  misc_feature: GYAE6OF02H3BMB.33.3.A03.1.454.CMB.1.raw
  modified_base (246)..(246): a, c, t, g, unknown or other
  misc_feature (246)..(246): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactgganctggatccggcagcccccagggagggactggagtggattggttatgtctttcacaatggcaataccgactacaaccctcctcaagagtcgagtcaccacatcagtagacacgtccaagaaccagttcctcctgaatctgacctctgtcgacgctgcgacacggccttctattactgtgcgagcgccgtacagcaggtgggtcgttctactttgactacgtgggcccagggacttcccgtggtcctaccgtctcctacgtcgccctaccacccgaaggtccccg

SEQ ID NO: 223702 - DNA, 246 bp, Homo sapiens
  misc_feature: GYAE6OF02GQMWG.33.3.A03.1.454.CMB.1.raw
  modified_base (238)..(246): a, c, t, g, unknown or other
  misc_feature (238)..(246): n is a, c, g, or t
tcagtacacacactcacgaccggtgctcgatttagagagcgtcacagggggtggttctactttgactactggggccagggatccctggtcaccgtctcctctgcctccaccaagggcccatcggtcttccccctggcaccctcctccaagagcacctctgggggcacagcggccctgggctgcctggtcaaggactacttccagtgtgtgtactgagcgggctggcaaggcgcatagnnnnnnnnn

SEQ ID NO: 223703 - DNA, 532 bp, Homo sapiens
  misc_feature: GYAE6OF02H1L8Q.33.3.A03.1.454.CMB.1.raw
  modified_base (503)..(503): a, c, t, g, unknown or other
  misc_feature (503)..(503): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactggagctggatccggcagcccccagggaggggactggagtggattggttatgtctttcacaatggcaataccgactaccaacccctcctcaagagtcgagtcaccacatcagtagacacgtccaagaaccagttctcctgaatctgacctctgtcgaccgctgcggacaccggtccgtctattactgtgcgggacgccgtcagcagtgggtgttcttacgttgactacgtcgggccagggtactcccgtggtccaccgttcnccttctcgccctccaccgacggccctacg

SEQ ID NO: 223704 - DNA, 712 bp, Homo sapiens
  misc_feature: GYAE6OF02ID4PU.33.3.A03.1.454.CMB.1.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (349)..(349): a, c, t, g, unknown or other
  misc_feature (349)..(349): n is a, c, g, or t
tcagtacacacactcacgaccggtgctcgatttagagagcgtcacagggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtnactccatcaggaattactactgganctggactccggcacgcccccgagggacgggactggagtggtagttggttagtgttctttcaactaagtggacaagtaccgactacctaacccctcctacgaagngtcgagtccaccacgactacgagtagaacgaaccgtaccaaacgaaaccctacgttacctcccgtagaaacttcgtacgtaacccgttcttacgtccgtaaccgccgttacgggacccggtaccgacccgggtcccgttacctttaactttaccgtcgttacggaccgtaacggtacgtcccggtacgaaccggtacgtaacgggtttcggggtttacgtttaccgtttaacgttttacgaaccgtttaacggtcgggggacccgtacggggtacccgtttaccccggttggtacccgtacccgttaccgttcccgtccgttccgttaccccctacccggtacccggtaaccggttacccccg

SEQ ID NO: 223705 - DNA, 530 bp, Homo sapiens
  misc_feature: GYAE6OF02IHTTL.33.3.A03.1.454.CMB.1.raw
  modified_base (442)..(442): a, c, t, g, unknown or other
  misc_feature (442)..(442): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
tcagtacacacactcacgaccggtgctcgatttagagagcgtcacagggggtccttaaattcagggtccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactaactggagctggatccggcacgcccccgaggggaggggactggagtggattggttatgtctttcacaatggcaataccgactaacaacccctcctacaacgagtcgagtcaccacatcagtagacacgtaccaagaaccagttctaccctgaactctgtacctctgtnaccgctcgcgacacggccgttctacttactgtgcgagngccgtacngcaggtggtggttctagtttgactcgtgggctaggatcccgg

SEQ ID NO: 223706 - DNA, 680 bp, Homo sapiens
  misc_feature: GYAE6OF02GZNFL.33.3.A03.1.454.CMB.1.raw
tcagtacacacactcacgaccggtgctcgatttagagagcgtcacaggggtccttaaattcagggtccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactggagctggatccggcacgcccccgaggggacggggactgggacgtgggatttcgggttaatgttctttacacgtaagtggactaagtaccgactaaccaacccctccctacaacgtacgtacgagtaccaccacactcgagtacgactacgtaccaaacgaacctacgttcctacctacgtaacttccgtacgtacccttccgtcgtacgacccgtcgttacggaccggtaccgaccgggtcccgttacttaacgtttaccgtcggtacggccggtaaggtaccgtacccggtacgtaacggccggtaagggtttccgggggttacggtttacccttaacggttttacggtaacccgtttaccggtacgggggtacccggtaaggggttacccgttaccccggg

SEQ ID NO: 223707 - DNA, 673 bp, Homo sapiens
  misc_feature: GYAE6OF02JBEUI.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactggagctggatccggcagcccccagggaggggctggagtggattggttatgtcttcacaatggacaataccgactaccaacccctccctcaagagtcgagtcaccacatcagtagacacgtaccaagaaccagttcctcccgtagaacttctacgacccttctcggtacgaccgcgttacggccgggaaccaccgggtcccgttaccttacttaccgttgtcgaccggtaggtacgttccggtacaggccgtaagggttgggggttacggttttcccgttccgttttacgaaccgtttaccggttcgggggtacccggtaagggggttaacccttcccccggttaggggttcccctaaccccgggtttccctttaccccgttcgtttcccggcccccgttacccgtaaccccggaaccggggttaccccccg

SEQ ID NO: 223708 - DNA, 567 bp, Homo sapiens
  misc_feature: GYAE6OF02IYFVI.33.3.A03.1.454.CMB.1.raw
  modified_base (280)..(280): a, c, t, g, unknown or other
  misc_feature (280)..(280): n is a, c, g, or t
  modified_base (504)..(504): a, c, t, g, unknown or other
  misc_feature (504)..(504): n is a, c, g, or t
tcagtacacacactcacgaccggtgctcgatttagagagcgtcacaggggtccttaaattcagggtccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactgganctggatccgcagcccccgagggaggggactggaggtggattggttatgtctttcactaatggcaataccgactaccaccctcctacaagagtcgagtcaccacatacagtacgacacgtaccaagaacctagttacctaccctagaacttctacgaccttctcgttcgtacccggcttcgccggacgaccggccgttctacttactggtgacgagacgtccganaggctaggtgggttacggttcttacgtttcggacttacggtcggggaccgtagggcttcccgg

SEQ ID NO: 223709 - DNA, 724 bp, Homo sapiens
  misc_feature: GYAE6OF02JUFR7.33.3.A03.1.454.CMB.1.raw
  modified_base (194)..(194): a, c, t, g, unknown or other
  misc_feature (194)..(194): n is a, c, g, or t
  modified_base (258)..(258): a, c, t, g, unknown or other
  misc_feature (258)..(258): n is a, c, g, or t
tcagtacacacactcacgaccggtgctcgatttagagagcgtcacaggggtccttaaattcagggtccagctcacatgggaaatactttctgagagtcctggacctcctgtgcaagaacatgaaacatctgtggttcttccttctcctggtggcagcctcccagatgggtcctgtcccaggtgcagctgcaggngtccgggcccaggactggtgaagccttcggcgaccctgtccctcacctgcacagtctcgtggtnactccatcgaggtaacttactagtggagctggactccggcaccggcccccgaggggacgggacgtggacggtggtagtttggttagtcgttactttcgaacgtaagtcggaccgtaacgtacccggtaactaaacccgtaacccccttcccgtacgaaacgtacgtccgaacgttacccgaacctacgtactacgaacgttaacgaacgtaaccggtaacccgaaacggtaaccctacgttaccctacccgtaagtaactcctacggtacccttcgttcggtaccgacccgcgtacggaccgaccgtacccggtccgtacgttaacgttaccgtcggttacggacgtacggtaccggtccggtacgtacggtccggtagggttcgggggttaccgtttaccgtttacggtttaccggtacggttaccgggttacggggacccggtacggggtaccctttacccggg

SEQ ID NO: 223710 - DNA, 837 bp, Homo sapiens
  misc_feature: GYAE6OF02H30WG.33.3.A03.1.454.CMB.1.raw
  modified_base (836)..(836): a, c, t, g, unknown or other
  misc_feature (836)..(836): n is a, c, g, or t
tcagtacacacactcacgaccggtgctcgatttagagagcgtcacaggggtcagattcagggagaactggttcttggacgtgtctactgatgtggtgactcgcgctctcgtgtggtggaggtggaggtaggtggtaggtgttcgttgttacgttgtacgtagtacgtacgtaactaccgtacctaccaccgtaccctaccgaccgtacgacgtaccgcacgtacacgactacgactaacgactaaccgacgtaacctacgtacctaccgtataccgtacgtaccgtcgttacgtaccggtctaccggtacgtccggtcgaccggtacgtaccgtacgtacgtttacgcggtaccgtggtaccgacgtaccgacgtacggtacggtcggttcggtttacggttaccgacggtttttaccggacgttacggaccgggttacggtacgtacccgggttccgttaccggtaccgttcccggttccgtacccgttcccgttacccggtctaacccggtccccggttaaaccccgtccggttaaccccgtttccccccggttacgtccccggttcccccgtacccgacccgtttacccccgacgtacccgtacccgtacccggtacccggtaccggtacccggtaccggtaccggtacccggtaccgggtccggtacccgggtccggtacccggttaccggtaccggttaccggttaccggtaccgtaccggttcgtaccggttacgtacggtacggtcggtacggtacggtcggtacggtacggtacggtaccggacgtacggtacggcgtacggcgtacgtcgtcgcgagcgactgcgcng

SEQ ID NO: 223711 - DNA, 536 bp, Homo sapiens
  misc_feature: GYAE6OF02HC1LY.33.3.A03.1.454.CMB.1.raw
  modified_base (301)..(301): a, c, t, g, unknown or other
  misc_feature (301)..(301): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctgttgactccatcaggaattactactggagctggatccggcagcccccagggaggggactggagtggattggttatgtctttcanaatggcaataccgactacaacccctcctcaagacgtcgagtcaccacatcagtagacacgtaccaaagaaccagttcctacctagaactctgacctctcgtcgaccgctgccggacacggccttctacttacgtgtcgcgagcgccgtcagcgagtgggtcgttcgtacttgacttcgtcggggcacgggtactccgtggtccaccgtctccgtctcgcctccaccgaggtcccg

SEQ ID NO: 223712 - DNA, 650 bp, Homo sapiens
  misc_feature: GYAE6OF02GA9KM.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactggagctggatccggcacgcccccgaggggagggactgggagtggattggttatgttctttcactaagtggacaactaccgactaaccgaacccctccctacaacgacgtcgagtccaccacatcagtacgacacgtaccaagaacctagttcctaccctagaactctacgtacccttcgtcgtacgaccgtcgtcggaccggaccgaccgggtcccgttacttaacgttaccgtggttcggacgacggacgtcccggtacacggtcgtaacgggttggggttacgtttaccttaacgtttcggaaccgttaccggtcggggtaccgaggggtccctcccggttcggtaccgtacccgttccgttacccttcgtccgtacccgtacccgaacccggtacgggtaccccg

SEQ ID NO: 223713 - DNA, 681 bp, Homo sapiens
  misc_feature: GYAE6OF02JKDD4.33.3.A03.1.454.CMB.1.raw
  modified_base (292)..(292): a, c, t, g, unknown or other
  misc_feature (292)..(292): n is a, c, g, or t
tcagtacacacactcacgaccggtgctcgatttagagagcgtcacaggggtccgttaaattcagggtccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtcccctcacctgcacagtctctggtgactccatcaggaattactactggagctgatccggnacgcccccagggagggactggagtgagttggttatgtctttcacagtcgtcgaataccgactaccaacccctaccgtaccaacgaacgtcgacgttacgaccctacgactactagtaacgacaaccgtaccgaaacggtaaaccctagttacccgtacccgttaacggaacttaccgttccgtaccttacgtcgtacgtaccgtaccctgggtacccggaccgtaccgtacccggtttaccgtactttaccgtagttcggaccgttagaacggtcccgtaccggaggtaccggtaacggtttcggggtaccggttttacgtttaaccgtttacggttaaccggtacggttaccggggtacccggtagggggttacccttaccccggggg

SEQ ID NO: 223714 - DNA, 677 bp, Homo sapiens
  misc_feature: GYAE6OF02H0HBD.33.3.A03.1.454.CMB.1.raw
tcagtacacacactcacgaccggtgctcgatttagagagcgtcacaggggtccttaaattcagggtccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttggccgaccctgtccctcacctgcacagtcctctggtgactccatacaggtaattactactggagctggactccggacacgacccccgagggggacggggacgtgggaggtcggtagtttagggtttagtcgttctttacgaacgtaagtggtacaaacgtacccgtaacctaccctaaccccttcccgtacaaacggacgtacgacgtccaccaacacttacacggtacgtaaccaccggttaaccaacgtaaacccgtacgtttaccctccctaggtaacttacccgtaggtacccttccgtgtaccgtacccgaccgtcggaccggaccgtaccggtacccgttcttaacgtttcgtcgtgacggacgaccgtcccgtacgaggcgtacgggttcgggtacggtttccttacgtttcgaacgttaccggtggggtaccgtagggaccgttacccgg

SEQ ID NO: 223715 - DNA, 703 bp, Homo sapiens
  misc_feature: GYAE6OF02GXBP9.33.3.A03.1.454.CMB.1.raw
tcagtacacacactcacgaccggtgctcgatttagagagcgtcacaggggtccttaaattcagggtccagctcacattgtaaatactttctgagagtcctggacctcctgttcaagaacatgaaacatctgtggttcttccttctcctggtggcagctcccagatgggtcctgtcccaggtgcagctgcgaggagtccgggcccaggactgggtgaacgtccgttcggccgaccctgtcccctcacctgcacagtcctcgtggtcgacctccatccaaaggtaactttaacctacgtgggacgtcgtaggactcccggaccacccggaccccccggagggggacggggacgtggggaacgtgggtacgtttggttaatcgttcgtttacaactaagtcggactaaacgtaacccgtaactaacccaacccccttccaacgtaacggacgtaccgaacgtacccaaccactaataccgaagtacaaccgtaccgtaaccgaaacgtaacccttacgttccctacccgtacgtaacccgtgtaacgttcgtcggtaccgacccggcccgaccggaccaccggcctagttcgtactttcgtcgtcgacggtaggttcggttcggttccggaccgtcccggacggacggtacgggtcggtacggttacggttacggactcgtaccgtaccgacgtacggcggaccgg

SEQ ID NO: 223716 - DNA, 614 bp, Homo sapiens
  misc_feature: GYAE6OF02GM69A.33.3.A03.1.454.CMB.1.raw
  modified_base (495)..(495): a, c, t, g, unknown or other
  misc_feature (495)..(495): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccgggactggtgaagccttcggagaccctgtccctcacctgcactgtctctggtgctccatcagcagtaagtctttactacgtggggctggactccgccacgcccccgagggacgggctggagtggagttgggaatatacgtattagtaggtgggagcagctactaccaccccgtcctacgaagagtcgagtacacctatactacctagaccacgtaccaaacgaacctagttcctacccgtagaacgtctacgacccttcgtcgtacgaccgccgacacgaccacggtactagttactattacgtgcgacgagacacggtaaccgggngtacggagttaggtaggttcgggaccgtaacgggtacccgtggtaccgtaccgtcctccgtacgaccgtccctaccgaccgtaccggacccctacggttcccgtccccgttacccccgg

SEQ ID NO: 223717 - DNA, 636 bp, Homo sapiens
  misc_feature: GYAE6OF02IM42V.33.3.A03.1.454.CMB.1.raw
  modified_base (353)..(353): a, c, t, g, unknown or other
  misc_feature (353)..(353): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggattactactgagctggatccggcacgcccccgagggacgggactgggagtggattggttattgtcgttcacaatggacaataccgactaccgaacccctcctacacgagtcgagtcaccanatcagtagacacgtacaacgaacacgtacctaccctagtaactcctacgaccttcgtcgacgtacccgtctacggccggacgaacccgggtccgttacttaacgtttacgtcggtcgacggacgtacggtccgttacgagccgtaaggttcggggttcgtttaccgttaccgttttaggaccgtacgggttacggggacccgtaaggggtcctttacccgtagggtccctaacccggttctcccgttgtacccgtccctacccgaaccggaccggttaccccg

SEQ ID NO: 223718 - DNA, 722 bp, Homo sapiens
  misc_feature: GYAE6OF02G3856.33.3.A03.1.454.CMB.1.raw
tcagtacacacactcacgaccggtgctcgatttagagagcgtcacaggggacttttctgagagtcctggacctcctgtgcaagaacatgaaacatctgtggttcttccttctcctggtggcagctcccagatgggtcctgtcccaggtgcagctgcaggagtcgggcccagggactgggtgaagccttcggcgaccctgtcccctcacctacacagtctcgtggtgactccatacgaggtaacttactacgtggagcgtaggacgtccggccgaccgcccccggaggggacggggacgtaggaggtgggtagtttggttattgttacctttacacgtaagtcggactaaaccgtaaccgtaactaaccctaaccccctccctacgaacgtacgtacgacgtaccaaccacactacagtacacacgtacaacgaacctagttacctacccgtagtaactcgtacgtacccttcgtcgtacgacccgtcgtacgaccggaccgtacccgggtaccgttacgttaacgttaccgttcgtcgacggaacggtcgacccgtagaccgtacgtacgggttgggttacggtttaccgtttacgtttacggtaaccgttcgggtaccggggaccgtaacgggtacccgtttcccggtacggttacctacccggttccttcccggttactccggtaccccgttaccgacccggttacccggcccttaccgg

SEQ ID NO: 223719 - DNA, 670 bp, Homo sapiens
  misc_feature: GYAE6OF02HKJG1.33.3.A03.1.454.CMB.1.raw
  modified_base (221)..(221): a, c, t, g, unknown or other
  misc_feature (221)..(221): n is a, c, g, or t
  modified_base (278)..(278): a, c, t, g, unknown or other
  misc_feature (278)..(278): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcggcccaggactgggtgaagccttcggcgaccctgtccctcacctgcacagtctctggtnactccatcaggtacttactacgtggatctggactcggcacgcccccgagggagacgngacgtggtagtacggtttagtagttcgttctacgtaatagtacgtactaaccgtacctaaccgtaaccctaccccgttacaacgtacgtacgtacgaccgtacaaccgtactactaacgtacgaactaaccgtaacgtaaccgaaaccgaacttaccgtaccctaccgtaacgtaccgtacgtaacctaccttacgtacggtacctaccgtcgtaccggtacgaccgtccggttacctacttacgtcgttagccgaggacgtaccggtaccgtagaccgtaggttacgggttcggttacgttacttacgtacgtaccgtacgggtcggacggtacgtccgttacggtccgtaccgtccttcgtcctcgacctaccgtaccgaccggtacccg

SEQ ID NO: 223720 - DNA, 704 bp, Homo sapiens
  misc_feature: GYAE6OF02FVVTW.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggtaattactactggagctggactccggcaccggcccccgaggggacggggaccgtggacggtggtagtttgggttattggttcttttaccaactaagtcggactaaataacccgaactaaccctaaaccccctccctacgaacgtacgtcgacgtcaaccacatacagtacgacacgtaccaaagaacctacgttacctaccctagtaactctacgacccttctacgtcgaccgtccgtacggtaccgaccgaccgggtccttacgttaacgtttacgtagttacgacggtaacggacgtacccggtacgacggtaccgtaagggttccggggtttagtttcccgttccgtttagaccgttacgggtccggggaccgtacggggtaccgtacccggttacgggtacccgttaacccgtttccgtcccgttcgttcccgtacccgtacccgtacccggtacccgggtacccccg

SEQ ID NO: 223721 - DNA, 778 bp, Homo sapiens
  misc_feature: GYAE6OF02G1ION.33.3.A03.1.454.CMB.1.raw
tcagtacacacactcacgaccggtgctcgatttagagagcgtcacaggggtccttaaattcagggtccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctcgtccctcaccgtgcacgacgtcctcgtggtcgacctccatcgaagtaacttactacgtggacgtcgtaggtactcccggacgaccgccccggaaggggacgggacgtggacggtaggtagttggttagtcgttacttacgaactagtcgaacaacgtaccgaactacccaccctacacgaagtacgtcgtactaccaaccacactacgtaagtaacgacctaaccgtacaaacgtaaccctcggttaccctacccgtaagtaaccttccgtacctaacccgtttcgtacggtaccctaacccgcgttaccgggacccggtaaccggtacccggggttacccgttacgtttaaccgttaccgggttcgtacccggtaacgggtaccggtaccggtaccccggttagaaccgggttaccgggttacggggttttacggggtttacccggttttaacccgtttttaacggttacccgggttaaacccggtttttaaccgggggacccgggggtaaccgggttaaccgggttacccccgtttaccccggggg

SEQ ID NO: 223722 - DNA, 679 bp, Homo sapiens
  misc_feature: GYAE6OF02FGJZI.33.3.A03.1.454.CMB.1.raw
  modified_base (225)..(225): a, c, t, g, unknown or other
  misc_feature (225)..(225): n is a, c, g, or t
  modified_base (545)..(545): a, c, t, g, unknown or other
  misc_feature (545)..(545): n is a, c, g, or t
  modified_base (647)..(647): a, c, t, g, unknown or other
  misc_feature (647)..(647): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagactgggtcctgtcccaggtgcagctgcaggacgtcggcccaggtactggtgaacgtccttacggccgtaccctgtcccctacaccgtgacaaccgngtccttcgtcggtcgacctccaatcgaggtaactttaccgacgtggacgcgtacggacgtccggcaccgccccgagggacggacgtggagtcggtacgttgtacttcgtacttcaactaagcgtacaataccgactaccgaacccctcctacgaaacgtacgtaccgtaacgtccgtaaacccacacttacgaacggtacgacgtaaccgtaccaaaaccggtaacctacgtttccctaccgtagtaactcccgtagacccttcgtacgtaccgtaccgacttccgggccgaaccgtaccggacctttatacgtttacgnggtccgacggtacgaccgtccgacgagtcgtaagggtcgtttacgtaccttcgttcgaccgtacgtcgggaccaggggtccctccgtacgtcctacccgtcncccgttcgtccgccaccgtacgcccgtacccg

SEQ ID NO: 223723 - DNA, 774 bp, Homo sapiens
  misc_feature: GYAE6OF02IBO10.33.3.A03.1.454.CMB.1.raw
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgacctcgtccctcacctgccactagtctctggtgacctcatcgaaggtaattacctacgtggagtcgtggactccggcaccgccccggaggggagggacgtggagtggtacgttggttatcggttcctttacaacgtagtcggtaactaacgtaaccgacgttaaccccaaccccgttaccctacgaagtacgtcgaactaccaaccgacactacgaacgtaacgaccaacgtaccaaacgtaaccctaacggttccctacccgtagaacttcgtacgtaacccttctacgggtaccgacccgtcggtacggacccggccgtaccggtacccggttaatttacgtttaaccgtggtacggacggtaaccggtacgtaccggtacaaggtaccggttaaggggtttcgggtttaacgggtttacctttaacggtttaccggttacgttaaccggggttccgggggtaacccggtacggggttcccgttcccgggtttacggtcccggtttaacccccgttccgttcccgttaccggtccccgttacccccggtaccgtaaaccccgggtaccggttaccccccggg

SEQ ID NO: 223724 - DNA, 604 bp, Homo sapiens
  misc_feature: GYAE6OF02GR7V0.33.3.A03.1.454.CMB.1.raw
  modified_base (278)..(278): a, c, t, g, unknown or other
  misc_feature (278)..(278): n is a, c, g, or t
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccggatggtgaagccttcggagaccctgtccctcacctgcactgtctcgtggtgctccatcagcagagtcttacacgtgggctggatccgccacgcccccgagggaagggcnggagtggattgggaatagtctaagtagtaggtgggacgnacgtactactaccgtaacccgtcctacgaacgngtcgagtccacatactcctagacacgtccaagtaccagttctcccgtagaacgactgacccttcgtcggtacgacccgccgaccaggaccgacggtactgtatagttacgtgtagccgtaaggtactacggtaaccggggagttaccgggagtgtaggttacggggaccgagggtacccgtgggtcctaaccggtactccgtacgaaccgtccttacccgacgaaccgggccctacgtcccggtcgttcccccg

SEQ ID NO: 223725 - DNA, 833 bp, Homo sapiens
  misc_feature: GYAE6OF02JGR6L.33.3.A03.1.454.CMB.1.raw
  modified_base (183)..(183): a, c, t, g, unknown or other
  misc_feature (183)..(183): n is a, c, g, or t
tcagtacacacactcacgaccggtgctcgatttagagagcgtcacagggggtccttaaattcagggtccagctcacatgggaaatactttctgagagtcctggacctcctgtgcaagaacatgaaacatctgtggttcttccttctcctggtgcagctcccagagtgggtcctgtcccaggtncagctgcaggacgtccgggccagggactggtagaacgccgttaccgggaccgtacccctcggttcccctaccgtaccgtacggaccctaacgtacgttaccgttccgttaggggtccggtaaccttaccccgtagttaccgtaaggggttaaaactttacccgttaacggttcggaacggtaccggttagggtaacccgttacccgggcccgaacccggacccccccgggtaaagggggggaccgggggtaacggtcggggtaacggttacgggggttaacgttttaggggtttacttcggttaaccgtttacgaaccgtaagtcggggtaacctaaccgtaacccggtaaacccttaacccgaacccccttccgtaaccgaacggacggttaaccgaccgtaaccaaacccgtacaactacgacgtaacgaccaaccgtaaccgaaacgtaacctaccgttcctaaccgactactcgttacgtaaccttcgtagtaccgtaccgtccgacgacggaacctccgggtacctacgtacgttacgttcgacggtacgtacgaccggtaccgtacggacgtcggtaacggttcgggttcgttaacgttacgttacggtacgttacgggacggtaccggtaggttccctacggg

SEQ ID NO: 223726 - DNA, 704 bp, Homo sapiens
  misc_feature: GYAE6OF02HKJGQ.33.3.A03.1.454.CMB.1.raw
  modified_base (221)..(221): a, c, t, g, unknown or other
  misc_feature (221)..(221): n is a, c, g, or t
tcagtacacacactcacgaccggtgctcgatttagagagcgtcacaggggactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtnactccatcgaggtaattactacgtggagctggactccggcacggcccccggaggggacggggacgtgggaggtggtagttggttactgttctttacacgtaagtggacaactaccgactaaccaacccctcctacgaacgtacgtacgacgtaccaacctacactacaagtaacgactaaccgtaccaaacgaaacccgtacgttccctacccgtagtaacctccgtacgtacccttcgtcggtaccgtacccgtcgtcggaccggaccgaccgggtaccgttaccttagttaccgtcggtacgacgacggtaccgcccgtacgacgtcggtaggttcggggttcgtttaccgtttacgtttaggaccgttacgggtcggggtaccgtacgggtacccttcccggttcggtacccgttacccgttcccgttacccgttaccggtccgtaccccttacccggtacccggtacccgggtaccccg

SEQ ID NO: 223727 - DNA, 881 bp, Homo sapiens
  misc_feature: GYAE6OF02JGUCU.33.3.A03.1.454.CMB.1.raw
  modified_base (148)..(148): a, c, t, g, unknown or other
  misc_feature (148)..(148): n is a, c, g, or t
  modified_base (717)..(717): a, c, t, g, unknown or other
  misc_feature (717)..(717): n is a, c, g, or t
tcagtacacacactcacgaccggtgctcgatttagagagcgtcacaggggactttctgagagtcctggacctcctgtgcaagaacatgaaacatctgtggttcttccttctctggtggcagctccagatgggtcctgtcccaggtgcngctgcaggtaggtccgggccaggactgggtagaacgccgttccggcctacccgtcggtccccttaccacgtcgaccgtactacggtccttcgttacggtacgaccgttacctagtaccaagggtaacttaccgtaaccgtgggactcgtacggtataccgacgaccgtacccggacccccggaagggggaacgggggacgttagggtaacggttggtaagttttaggggtttaattcggtttacttttaccgaacgtaaacggttcggggtaactaaaccggtacccgtaacctaaccccgtaacccccgttacctaacgtaacggttaccggtacggtaccgtaacccttaacccggaactaacttaccgtaacggtaaacggtacctaacccgggtaaactaaacccggaaaccgttaccggtttacccgtttacccggtttaacggtaaaacctttccgggtttaaccgtaacccctttcggtacccggttaaaccggtaccccgttacgtaccgggaccccgggttaaccgacccggggtttacccttaacggttacttaccggngtacgacggtacgtccgaaccggcgtaacgtacgtaggttcgggttaccgttaggttacctttacggtaacggttcggacgggtacccgtcgggtaacctttcccggtcgtaacccgtctttccgtccccggttatccggttccccacccggttaggaccccgg

SEQ ID NO: 223728 - DNA, 147 bp, Homo sapiens
  misc_feature: GYAE6OF01BOY1B.17.20.B09.1.454.CMB.1.raw
  modified_base (147)..(147): a, c, t, g, unknown or other
  misc_feature (147)..(147): n is a, c, g, or t
tcagcgtagactagcacgaccggtgctcgatttagtgtagtgtgaagggaccaaggtggagatcagacgaactgtggctgcaccatctgtcttcatcttcccgccatctgactagtctacgctgagcgggctggcaaggcgcatagn

SEQ ID NO: 223729 - DNA, 563 bp, Homo sapiens
  misc_feature: GYAE6OF01A1MOE.17.20.B09.1.454.CMB.1.raw
  modified_base (543)..(543): a, c, t, g, unknown or other
  misc_feature (543)..(543): n is a, c, g, or t
tcagcgtagactagcacgaccggtgctcgatttagtgtagtgtgaagggggggagaggagcccagcactacaagtcggcggtgtttccattcggtgatcaacactgaacacagaggactcaccatggagtttcggctgcgctgggtttttctcgttgctcttttaagaggtgtccagtgtcaggtgcagctggtggagtcgtgggggaggcgtggtccagcctgggaggtccctgagactttcttgtgaagcgtctggattcaccttcagtgcctatggcatgcacgtgggtcccgccagggcctccgaggcgaagggggctgggaggtgggtggcacttatagtggtatgataggaaataataaattctatgacagactccgtagaacggccattcaccgtctccagacgacaattccaaggacacggtgtatactaacaaatgaacagctagagagtacgaagacgacggactacttattacgtgtgacgagagagtcggtagggtcgctagttaagttaggttacggttacggttttaancggttcccggttggtcccgg

SEQ ID NO: 223730 - DNA, 620 bp, Homo sapiens
  misc_feature: GYAE6OF01C7PA9.17.20.B09.1.454.CMB.1.raw
  modified_base (300)..(300): a, c, t, g, unknown or other
  misc_feature (300)..(300): n is a, c, g, or t
  modified_base (445)..(445): a, c, t, g, unknown or other
  misc_feature (445)..(445): n is a, c, g, or t
  modified_base (464)..(464): a, c, t, g, unknown or other
  misc_feature (464)..(464): n is a, c, g, or t
tcagcgtagactagcacgaccggtgctcgatttagtgtagtgtgaagggggggagaggagcccagcactacaagtcggcggtgtttccattcggtgatcaacactgaacacagaggactcaccatggagtttcggctgcgctgggtttttctcgttgctcttttaagaggtgtccagtgtcaggtgcagctggtggagtcgtgggggaggcgtggtccagccgtggggaggtccctgagtactttcttgtgaagcgtctggattcacctttcagtgcctatggcatgcacgtgggtcccncaggcctccgaggcgaaggggctgggagtgggtgctacgttatagtggtatggaataggaaaataataaattctatgacagtactccggtaggaacgggcctatccgaccgtctaccagacgacaattaccgaagacgtacggtntactactaacaaatgaacngcctagagaacgtacgaaacgacgacggacgtaactttaacgttacgtggtacgacgaaggtacgagttccggtaggggttacgtactaagttaacgttaacgggttacgggtttaaacggttttttaagtccggttcccggtttgggtaccccgg

SEQ ID NO: 223731 - DNA, 151 bp, Homo sapiens
  misc_feature: GYAE6OF02FYHRK.17.20.B09.1.454.CMB.1.raw
  modified_base (147)..(151): a, c, t, g, unknown or other
  misc_feature (147)..(151): n is a, c, g, or t
tcagcgtagactagcacgaccggtgctcgatttagtgtagtgtgaagggaccaaggtggagatcagacgaactgtggctgcaccatctgtcttcatcttcccgccatctgactagtctacgctgagcgggctggcaaggcgcatagnnnnn

SEQ ID NO: 223732 - DNA, 175 bp, Homo sapiens
  misc_feature: GYAE6OF02FHYBU.17.20.B09.1.454.CMB.1.raw
  modified_base (143)..(143): a, c, t, g, unknown or other
  misc_feature (143)..(143): n is a, c, g, or t
  modified_base (149)..(175): a, c, t, g, unknown or other
  misc_feature (149)..(175): n is a, c, g, or t
tcagcgtagactagcacgaccggtgctcgatttagtgtagtgtgaagggaccaaggtggagatcagacgaactgtggctgcaccatctgtcttcatccttcccgccatctgactagtctacgctgagcgggctggacaaggcncatagnnnnnnnnnnnnnnnnnnnnnnnnnnn

SEQ ID NO: 223733 - DNA, 131 bp, Homo sapiens
  misc_feature: GYAE6OF01CGSZT.12.28.C06.1.454.CMB.1.raw
  modified_base (130)..(131): a, c, t, g, unknown or other
  misc_feature (130)..(131): n is a, c, g, or t
tcagatacgacgtacacgaccggtgctcgatttagagctcacgtattgggtttgggcacagcggccctgggctgcctggtcaaggactacttcctacgtcgtatctgagcgggctggcaaggcgcatagnn

SEQ ID NO: 223734 - DNA, 205 bp, Homo sapiens
  misc_feature: GYAE6OF01A005K.12.28.C06.1.454.CMB.1.raw
  modified_base (202)..(205): a, c, t, g, unknown or other
  misc_feature (202)..(205): n is a, c, g, or t
tcagatacgacgtacacgaccggtgctcgatttagagctcacgtattgggtttggggaggggaaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagnnnn

SEQ ID NO: 223735 - DNA, 130 bp, Homo sapiens
  misc_feature: GYAE6OF01AFFDI.12.28.C06.1.454.CMB.1.raw
  modified_base (130)..(130): a, c, t, g, unknown or other
  misc_feature (130)..(130): n is a, c, g, or t
tcagatacgacgtacacgaccggtgctcgatttagagctcacgtattgggtttgggcacagcggccctgggctgcctggtcaaggactacttcctacgtcgtatctgagcgggctggcaaggcgcatagn

SEQ ID NO: 223736 - DNA, 208 bp, Homo sapiens
  misc_feature: GYAE6OF01AL7ED.12.28.C06.1.454.CMB.1.raw
  modified_base (203)..(208): a, c, t, g, unknown or other
  misc_feature (203)..(208): n is a, c, g, or t
tcagatacgacgtacacgaccggtgctcgatttagagctcacgtattgggtttgggggaggggaaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagnnnnnn

SEQ ID NO: 223737 - DNA, 203 bp, Homo sapiens
  misc_feature: GYAE6OF01CG4QE.12.28.C06.1.454.CMB.1.raw
  modified_base (202)..(203): a, c, t, g, unknown or other
  misc_feature (202)..(203): n is a, c, g, or t
tcagatacgacgtacacgaccggtgctcgatttagagctcacgtattgggtttggggaggggaaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagnn

SEQ ID NO: 223738 - DNA, 204 bp, Homo sapiens
  misc_feature: GYAE6OF01DXVCR.12.28.C06.1.454.CMB.1.raw
  modified_base (203)..(204): a, c, t, g, unknown or other
  misc_feature (203)..(204): n is a, c, g, or t
tcagatacgacgtacacgaccggtgctcgatttagagctcacgtattgggtttgggggaggggaaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagnn

SEQ ID NO: 223739 - DNA, 218 bp, Homo sapiens
  misc_feature: GYAE6OF01BUG62.12.28.C06.1.454.CMB.1.raw
  modified_base (205)..(205): a, c, t, g, unknown or other
  misc_feature (205)..(205): n is a, c, g, or t
  modified_base (208)..(218): a, c, t, g, unknown or other
  misc_feature (208)..(218): n is a, c, g, or t
tcagatacgacgtacacgaccggtgctcgatttagagctcacgtattggggtttggggggaggggaaagggtgagatccctcactgtggctcacgtttcggcggagggaccaagggtggagatacaaacgaactgtggctgcacatctgtcttcatcctcccgcatctgatacgtcgtatcgagcgggctggcaagggccataanagnnnnnnnnnnn

SEQ ID NO: 223740 - DNA, 220 bp, Homo sapiens
  misc_feature: GYAE6OF01EAE58.12.28.C06.1.454.CMB.1.raw
  modified_base (203)..(220): a, c, t, g, unknown or other
  misc_feature (203)..(220): n is a, c, g, or t
tcagatacgacgtacacgaccggtgctcgatttagagctcacgtattgggtttgggggaggggaaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagnnnnnnnnnnnnnnnnnn

SEQ ID NO: 223741 - DNA, 203 bp, Homo sapiens
  misc_feature: GYAE6OF02GJNS1.12.28.C06.1.454.CMB.1.raw
  modified_base (203)..(203): a, c, t, g, unknown or other
  misc_feature (203)..(203): n is a, c, g, or t
tcagatacgacgtacacgaccggtgctcgatttagagctcacgtattgggtttgggggaggggaaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagn

SEQ ID NO: 223742 - DNA, 201 bp, Homo sapiens
  misc_feature: GYAE6OF02HIZP6.12.28.C06.1.454.CMB.1.raw
  modified_base (200)..(201): a, c, t, g, unknown or other
  misc_feature (200)..(201): n is a, c, g, or t
tcagatacgacgtacacgaccggtgctcgatttagagctcacgtattgggtttggggagggaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagnn

SEQ ID NO: 223743 - DNA, 204 bp, Homo sapiens
  misc_feature: GYAE6OF02IEB4J.12.28.C06.1.454.CMB.1.raw
  modified_base (201)..(204): a, c, t, g, unknown or other
  misc_feature (201)..(204): n is a, c, g, or t
tcagatacgacgtacacgaccggtgctcgatttagagctcacgtattgggtttggggagggaaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagnnnn

SEQ ID NO: 223744 - DNA, 201 bp, Homo sapiens
  misc_feature: GYAE6OF02GYD5Y.12.28.C06.1.454.CMB.1.raw
  modified_base (201)..(201): a, c, t, g, unknown or other
  misc_feature (201)..(201): n is a, c, g, or t
tcagatacgacgtacacgaccggtgctcgatttagagctcacgtattgggtttggggagggaaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagn

SEQ ID NO: 223745 - DNA, 130 bp, Homo sapiens
  misc_feature: GYAE6OF02ICG3D.12.28.C06.1.454.CMB.1.raw
tcagatacgacgtacacgaccggtgctcgatttagagctcacgtattgggtttgggcacagcggccctgggctgcctggtcaaggactacttcctacgtcgtatcctgagcgggctggcaaggcgcatag

SEQ ID NO: 223746 - DNA, 206 bp, Homo sapiens
  misc_feature: GYAE6OF02GQ4H1.12.28.C06.1.454.CMB.1.raw
  modified_base (203)..(206): a, c, t, g, unknown or other
  misc_feature (203)..(206): n is a, c, g, or t
tcagatacgacgtacacgaccggtgctcgatttagagctcacgtattgggtttgggggaggggaaagggtgagatccctcactgtggctcactttcggcggagggaccaaggtggagatcaaacgaactgtggctgcaccatctgtcttcatcttcccgccatctgatacgtcgtatctgagcgggctggcaaggcgcatagnnnn

SEQ ID NO: 223747 - DNA, 227 bp, Homo sapiens
  misc_feature: GYAE6OF02GHLSQ.12.28.C06.1.454.CMB.1.raw
  modified_base (207)..(227): a, c, t, g, unknown or other
  misc_feature (207)..(227): n is a, c, g, or t
tcagatacgacgtacacgaccggtgctcgatttagagctcacgtattggggtttgggggaggggaaagggtgagatccctcactgtggctcactttcggcggagggaccaagggtcggagatcaaacgaactggtggctgcaccatctgtcttcatcttcccgccatctgatacgtcgtatctgagcgggctggcaaggcgcatagnnnnnnnnnnnnnnnnnnnnn

SEQ ID NO: 223748 - DNA, 131 bp, Homo sapiens
  misc_feature: GYAE6OF01DRF5I.49.13.B02.1.454.CMB.1.raw
  modified_base (131)..(131): a, c, t, g, unknown or other
  misc_feature (131)..(131): n is a, c, g, or t
tcagagtcgagagacacgaccggtgctcgatttagtctagcgacttccgcgggcacgacgtgctcgatttagtctagcgacttcccgccatctgatctctcgactctgagcgggctggcaaggcgcatagn

SEQ ID NO: 223749 - DNA, 154 bp, Homo sapiens
  misc_feature: GYAE6OF01BLBTB.49.13.B02.1.454.CMB.1.raw
  modified_base (126)..(126): a, c, t, g, unknown or other
  misc_feature (126)..(126): n is a, c, g, or t
  modified_base (132)..(154): a, c, t, g, unknown or other
  misc_feature (132)..(154): n is a, c, g, or t
tcagagtcgagagacacgaccggtgctcgatttagtctagcgacttccgcgggcgacgacgtgctcgatttagtctagcgacttccgccatcctgatctctcgactctgagcgggctggcaaggcncatagnnnnnnnnnnnnnnnnnnnnnnn

SEQ ID NO: 223750 - DNA, 158 bp, Homo sapiens
  misc_feature: GYAE6OF01AFO2I.49.13.B02.1.454.CMB.1.raw
  modified_base (132)..(158): a, c, t, g, unknown or other
  misc_feature (132)..(158): n is a, c, g, or t
tcagagtcgagagacacgaccggtgctcgatttagtctagcgacttccgcgggcgacgacgtgctcgatttagtctagcgacttccgccatcctgatctctcgactctgagcgggctggcaaggcgcatagnnnnnnnnnnnnnnnnnnnnnnnnnnn

SEQ ID NO: 223751 - DNA, 161 bp, Homo sapiens
  misc_feature: GYAE6OF01BRWC1.49.13.B02.1.454.CMB.1.raw
  modified_base (130)..(161): a, c, t, g, unknown or other
  misc_feature (130)..(161): n is a, c, g, or t
tcagagtcgagagacacgaccggtgctcgatttagtctagcgacttccgcgggcgacgacgtgctcgatttagtctagcgacttccgcatctgatctctcgactctgagcgggctggcaaggcgcatagnnnnnnnnnnnnnnnnnnnnnnnnnnnnnnnn

SEQ ID NO: 223752 - DNA, 278 bp, Homo sapiens
  misc_feature: GYAE6OF01BOR2Z.49.13.B02.1.454.CMB.1.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (247)..(278): a, c, t, g, unknown or other
  misc_feature (247)..(278): n is a, c, g, or t
tcagagtcgagagacacgaccggtgctcgatttagtctagcgacttccgcgggcacgaccggtgctcgatttagtctagcgacttccgcgggcacgaccggtgctcgatttagctaacgcgacttccgacgggacgacgaccggtgctacggattttagcttacgaacctgcaaaggaaggggctgcctgacgtgtttctgttcccacctctctgtctgactngagcggntggacaaggnctatagnnnnnnnnnnnnnnnnnnnnnnnnnnnnnnnn

SEQ ID NO: 223753 - DNA, 551 bp, Homo sapiens
  misc_feature: GYAE6OF02HP7CU.49.13.B02.1.454.CMB.1.raw
  modified_base (437)..(437): a, c, t, g, unknown or other
  misc_feature (437)..(437): n is a, c, g, or t
  modified_base (486)..(486): a, c, t, g, unknown or other
  misc_feature (486)..(486): n is a, c, g, or t
tcagagtcgagagacacgaccggtgctcgatttagtctagcgactttagggtttagggggctctgggaaaggagccccagcccctcgacgattcccaggtgtttccattcggtgagtcagcaacgtgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttagcagttttgccatgggctgggtccgccaggctccagggaaggggctggagtgggtctcaactattagcggtattggtactaccacatactacgcagactccgtgaagggccgcttcaccatctccagagacaattccaaagaacatggtntttctgcaaatgagcagcctgagagccgaggacacggccgtatattacngtgcgaagttcgcgtgctaggtacatttgacttacgtggggtcccaaggggtaacctggtacccg

SEQ ID NO: 223754 - DNA, 255 bp, Homo sapiens
  misc_feature: GYAE6OF02HJVX2.49.13.B02.1.454.CMB.1.raw
  modified_base (249)..(255): a, c, t, g, unknown or other
  misc_feature (249)..(255): n is a, c, g, or t
tcagagtcgagagacacgaccggtgctcgatttagtctagcgacttccgcgggcacgaccggtgctcgatttagtctagcgacttccgcgggcacgaccggtgctcgatttagtctacgcgacttccgacgggacgacgaccggtcgctcgagtttagctaccgacctgcaagggaagggctggccctgacgtggttctgttcccacctcctctctctcgactctgagcgggctggcaaggcgcatagnnnnnnn

SEQ ID NO: 223755 - DNA, 852 bp, Homo sapiens
  misc_feature: GYAE6OF02G90U2.49.13.B02.1.454.CMB.1.raw
  modified_base (308)..(308): a, c, t, g, unknown or other
  misc_feature (308)..(308): n is a, c, g, or t
tcagagtcgagagacacgaccggtgctcgatttagtctagcgactttagggtttaggggtgggcctacgaggtaggccagacgctcctgggaatctcaccatggcctggacccctcgtccctggctcccccgtcctacaccttttcgtgccacacgtctcctgacggcctcctatcgagcgtgaccacacgcccacccctacggttggtccggtcgttaccccaggaccaaacgggcccagggaactaaccctcgacctcccgtagggaaggattggacgtagtttcgaacccgtaaaaaaaaagttntttcgactttggttaggttaaccgaacgaaacgtaaacgttacgaacgggcccgtaacgggccccccggttgttacgccgttaccgaagttcctaactaggtaaccgtaaccgaaaggaaaaacccgaccccgtacccgggaactaccccgtaggtacgacgtacgttacctctcggacctccacctcgaccgggaccagtcggaccgtacggttcgaacttatacgacgggtccgggacccgagggtacggaacggtagtagggtaaaggttcgaaccttacgttacgttaccgttaacgtaccgtaaccgaggtaaccaaccggtagggtaaaccgaaaacgtccgaacgaaggtaacgtaaacgttaccggttccgggaccgggaacgggaaccctaacgaccgtaaccggacccgttaccgtaccgggttaccctacccggacccggtaaccgggcccgttaccggccccccgttaccggtccgtaacccgttcccgttacccgttaccccccgaacccgttcccgttacccttccccgg

SEQ ID NO: 223756 - DNA, 545 bp, Homo sapiens
  misc_feature: GYAE6OF02GGFWO.49.13.B02.1.454.CMB.1.raw
  modified_base (242)..(242): a, c, t, g, unknown or other
  misc_feature (242)..(242): n is a, c, g, or t
  modified_base (446)..(446): a, c, t, g, unknown or other
  misc_feature (446)..(446): n is a, c, g, or t
tcagagtcgagagacacgaccggtgctcgatttagtctagcgactttagggtttggggtgggctcaggaggcagagctctgggaatctcaccatggcctgggacccctctcctgctcccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgaccctccgggatccctgacgagattctctggctccacctcagggaccatcggcctacgttgactatcaggtccgggcccagggtggaggatggaaggtgacgtactattgttactcacctagacacagtagaaatcanagagaatagttcggacggaggaccaagctcgaccgtctaggtcacgacccgaaggcctcgccccctcggtccactcgtccgttcccacccttcctctcc

SEQ ID NO: 223757 - DNA, 652 bp, Homo sapiens
  misc_feature: GYAE6OF02FYCM0.49.13.B02.1.454.CMB.1.raw
  modified_base (253)..(253): a, c, t, g, unknown or other
  misc_feature (253)..(253): n is a, c, g, or t
  modified_base (635)..(635): a, c, t, g, unknown or other
  misc_feature (635)..(635): n is a, c, g, or t
tcagagtcgagagacacgaccggtgctcgatttagtctagcgactttgggtttagggggtgggctcaggaggcagagctctgggaatctcaccatggcctgggacccctcgtcctgctccccctcctcacctttctgccacacgtctctgaggcctcctatgagctgacacagccaccctcggtgtcggtgtccccaggacaacggccaggataacctgctcgtgggagatgctagttcgaaccaaaaaattnttagtactttaggttacggtaccgaagaaacgtaagtacgaagggccgacggcccccggttgttacgctcatctatgacgacaagaaaaccgacccgaccggactacccgtgacacgtattcgtctcggcctccacctcgacggaccagtcggacctacgttagactagtcgaggccggggaccgaggtcggaggtagtaggaaggtcgtactacttacgttcgttaactacgaccgacgaccacgaggtaacgaaacgtcaacgaaggaagtaactacgtcggacggacggaaccgacgacgtacgaccgtacgtacggtcaccggcccgaacggtcccgtaccgccccgtacgtcctaccgtcccgttaccgttaccccncccgttccctcctcccg

SEQ ID NO: 223758 - DNA, 743 bp, Homo sapiens
  misc_feature: GYAE6OF01CNS9M.4.45.E01.1.454.CMB.1.raw
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctccactctactcgtcgcgagggtccggtcgggtccgagtacgtcgtcgctaggactcagccacctcagcgtctcggggacccccggnaggtacggtccacctattcttcttgttacgtaggaacnccaacctccaactagtacgtaaactttattagtacgtactacgtacggtaccagtacgtacgtacccgaacggaacccgtacccctaactcctacactactaataagtaactactcgacgccgcccgtacggtaccgggtcctacggtaccgtacttcgtccgtcggtacctacccgtaacggtcccggtacctacccgtcgaccggtcccttccgtacggtccctacgtcgtacgggtccgggtccgtacccgggtacggtacggtacgtcggtacggtacgtagtaactttacgtacgtcggtacgtacgtaacgtggtacgggtacgtacggtaccggtccgtacggtcggttacggtacgttccggttaccgttccgggtaccggtacgggtacccgtacggtacccgtaccggttccggttacggtacccggaccggtaaccccggtaacggtacccccaacccgttcgtccgtacccg

SEQ ID NO: 223759 - DNA, 523 bp, Homo sapiens
  misc_feature: GYAE6OF01DGIAD.4.45.E01.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (517)..(517): a, c, t, g, unknown or other
  misc_feature (517)..(517): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggaccccgggnaggagggtcaccatctcttgtctggaancaactccaacatcgaaacttattatgtatactggtaccagcagttcccaggaaccgccccaaactcctcatctaataagaataatcagccggccctgacggggtccctgaccgattctctggctccaagtccggcacctcagccctccctggccatcagtcgggctccggtccgaggactgaggctagattatactgtgcgacagtgggatggacgtcctgcgtggtatcgtctcggacctgggaccaggtcaccgtctaggtcacgccaacggcccaacccntgtacc

SEQ ID NO: 223760 - DNA, 658 bp, Homo sapiens
  misc_feature: GYAE6OF01D1G9T.4.45.E01.1.454.CMB.1.raw
  modified_base (207)..(207): a, c, t, g, unknown or other
  misc_feature (207)..(207): n is a, c, g, or t
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcggggacccccggnagagggtcaccatctcttgttctggaagcaactccaacatcgaaacttattatgtatactggtacagctacgtcccaaggaccgccccaactcctcatctanaaagaataactcaggccgccctgacgggtcccngaccgtattcncgtcggcctaccgaacggtcccgcctaccctcgacgccccttcccgtggaccctataccgtaggtcgggtccgttcccgggtccggaaggagtggacggtctagttaattattacgtggtcgaccgactaggtcgggatcgggaccgtccgtaggtcgggttagggtacttcggttacccggttaccgggtacccggtacggggtaacccgtaacggggtaccctacccccggttccggtaacggtcccgaacccggtaaccccggaaccggaaccccccaacccccgtacgttccggtaacccc

SEQ ID NO: 223761 - DNA, 545 bp, Homo sapiens
  misc_feature: GYAE6OF01A7C6T.4.45.E01.1.454.CMB.1.raw
  modified_base (304)..(304): a, c, t, g, unknown or other
  misc_feature (304)..(304): n is a, c, g, or t
  modified_base (539)..(539): a, c, t, g, unknown or other
  misc_feature (539)..(539): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggacccccggcagagggtcaccatctcttgttctggaagcaactccaacatcgaaacttattatgtatactggtaccagcagttccaggacgccccaaatcctcatctanaagaataatcagcgcctcacgggtccctgaccgattctcgtggctccgaagtcccggcaccctcacgccctccctggccatcgaggtcgggcctcccgggtccgaggtactgacggtctagtatttattactggtcgcgaacagtgggactcggacggtcctggcgttgggtatcggtcgttcggacctgggacctaggtccaccggtctaggtcacgcccaaggccccaacccntgtacc

SEQ ID NO: 223762 - DNA, 537 bp, Homo sapiens
  misc_feature: GYAE6OF01EQ509.4.45.E01.1.454.CMB.1.raw
  modified_base (208)..(208): a, c, t, g, unknown or other
  misc_feature (208)..(208): n is a, c, g, or t
  modified_base (531)..(531): a, c, t, g, unknown or other
  misc_feature (531)..(531): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcggggacccccgggnagagggtcaccatctcttgttctggaagcaactccaacatcgaaacttattatgtatactggtaccagcagttcccaggaaccggcccccaaactcctcatctataagaataatcagcggccctcgacggggtccctgaccgattctctggctccaagtccggcacctcacgcctccctggcctatcaggtgggctccgggtcgaggatggaggctgatttattactgtgcgacagtgggatggacggtcctggcggtgggtatgtcgttcggaccgtgggaccgaggtcaccgtctaggtcacgtcccaaggacccaacccntgtacc

SEQ ID NO: 223763 - DNA, 542 bp, Homo sapiens
  misc_feature: GYAE6OF01BBLPF.4.45.E01.1.454.CMB.1.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (534)..(534): a, c, t, g, unknown or other
  misc_feature (534)..(534): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggacccccgggnagagggtcaccatctcttgtctggaancaactccaacatcgaaacttattatgtatactggtaccagcagtcccaggaaccgaccccaaactcctcactctaataagaataatcagcggaccctcgagggtccctagaccgtattcctctcggctaccgaaggtcccgacacctcacgtcccctccgtggccatcaggtgggcctccggtacgaggactgagtctagtattattactgtagcgacagtggactgaccggtctgcgtggtatgtcgttcgacgtgggacctaggtcaccgtctaggcagtcccaaggaccccaacccngtcgtacc

SEQ ID NO: 223764 - DNA, 532 bp, Homo sapiens
  misc_feature: GYAE6OF01BZYGT.4.45.E01.1.454.CMB.1.raw
  modified_base (205)..(205): a, c, t, g, unknown or other
  misc_feature (205)..(205): n is a, c, g, or t
  modified_base (334)..(334): a, c, t, g, unknown or other
  misc_feature (334)..(334): n is a, c, g, or t
tcagagcactgtagcacgaccggtgctcgatttagtgagtcagtaagggaaaagggcagcttcagctgtgctagagaagacaggattcaggacaatctccagcatggccggcttccctctcctcctcaccctcctcactcactgtgcagggtcctgggtccagtctgtgctgactcagccaccctcagcgtctgggacccccggnagagggtcaccatctcttgttctggaagcaactccaacatcgaaacttattatgtatactggtaccagcagttcccaggaaccgccccaaatcctcatctataagataatcagcgccctcagggtcccngaccgatctctggctcaagtccgcacctcacgccctcctgccatcagtcggctccgggtcgaggatgaggctgtattatactgtcgcgacagtgggatcgacggtcctggcgttgggtatcggtcgttcggaccgttgggacctaagggtccacccggtctaggtccacgtcccaaaggcccaaacccctgtcgtacc

SEQ ID NO: 223765 - DNA, 617 bp, Homo sapiens
  misc_feature: GYAE6OF01C3844.4.45.E01.1.454.CMB.1.raw
  modified_base (205)..(205): a, c, t, g, unknown or other
  misc_feature (205)..(205): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (607)..(607): a, c, t, g, unknown or other
  misc_feature (607)..(607): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggaccccggnagagggtcaccatctcttgttctggaagcaactccaacatacgaaacttattatgtatactgtaccagcagttccaggaaccgacccccaaactcctcatactaataagtaataactcagccggccctacgacggggtcctacgaccgtacttcgtcgtcggcctaccgaacgtccggcacctcacgccctccgngccatcgaggtcgggtctccgggtcgaggntggagtctagtatttagtacgtgtacgacgtacgtaggtcgggagttcggaccggtacccgttggtccgggttaggggttacttcggttaccgttccgggaccgttacggggaacccgtagggtaaccctccggtaccgtacgggtaccacgtaccccgaaacggccccaaaccccngttcgtaccc

SEQ ID NO: 223766 - DNA, 624 bp, Homo sapiens
  misc_feature: GYAE6OF01D0KTZ.4.45.E01.1.454.CMB.1.raw
  modified_base (207)..(207): a, c, t, g, unknown or other
  misc_feature (207)..(207): n is a, c, g, or t
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggacccccgggnagagggtcaccatctcttgttctggaagcaactccaacatacgaaacttattatgtatactggtaccagcagtcccaggaaccgccccaaactcctcatctanaagaataatcagccgccctcgacgggtccctgacctnttctcgcggctaccgaacgtccggcacctcacgtccctcccgtgccatcgacggtcgggtcctcccgggtacgaggagtggacgtctagtactttacttagttcggtgcgaacgtaggtagggtacgtacggaccggtccgtcggtcgggttagggtagtcggttccgttaccgggtaccgtacggggtaaccgtaacgggttcccgtaccggttcccggtacgggtacccgaaccggtccccgaaacgggcccccaaaccccgtcgttcgtacccg

SEQ ID NO: 223767 - DNA, 702 bp, Homo sapiens
  misc_feature: GYAE6OF01DSU9T.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcggggaccccccggagagggtccaccatctcttgttctggaagcaactccaacatacgtaaacttattatgtatactgtaccagctacgttcccacggaaccggacccccaaactccgtacacttacctaataagaataactcgaacgccggccctacggacgggtccctgacccgtattcgtctcggcctaccaacggttcccggaccacccttcgaccgtccccttcccgtggcccatccgaggtcgggcccgttcccggggtaccgaggacgtggacggtctagtaactttattacgtggtacgaccgaacgtggtacggggtacttacgggacccgggtccgttacgggcgggttagggtttacgttccggtttcccgttaccgggtacccggttacggggaacccgtaaccgggttcccgtaacccggtttcccggtaacggtcccgaacccggtaccccgaaacccgggaccccctaaacccccggtcgttcccggtacccg

SEQ ID NO: 223768 - DNA, 680 bp, Homo sapiens
  misc_feature: GYAE6OF01C7UID.4.45.E01.1.454.CMB.1.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctctcaccctcctcactcactgtgcagggtcctgggtccagtctgtgctgactcagccaccctcagcgtcgtcgggacccccggnagagggtcaccatctnttgtctaggaagcaactcaacatacgtaaacttattatagttaatactaggtaaccagactacgttaccccaacgggtaacccgacccccaaactcctcaatctaataagtaataatcaagccgcctacgacgggtcctacgaccgtattcctcgtcgtcctaccgaacggtcccggaccacctccgaacgtccccttcccgcggtacccacgttaccgacggttccgggtccgttacccgggtaccggtaacgggtaacgtacgggtacggtcgtagttaactttaacgtacttggtcgtacggactacggtagggacgttacggaccgggtcctaggtccggttagggttactcgttccgttaccggaccggttacgggacccgtaacggtccgtacccggttccgtacggtaccaccggtacccgtaaccggacccaaccccctgtccgtacccg

SEQ ID NO: 223769 - DNA, 511 bp, Homo sapiens
  misc_feature: GYAE6OF01DIOPI.4.45.E01.1.454.CMB.1.raw
  modified_base (206)..(206): a, c, t, g, unknown or other
  misc_feature (206)..(206): n is a, c, g, or t
  modified_base (320)..(320): a, c, t, g, unknown or other
  misc_feature (320)..(320): n is a, c, g, or t
  modified_base (506)..(506): a, c, t, g, unknown or other
  misc_feature (506)..(506): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggaccccccggnagagggtcaccatctcttgtctggaagcaactccaacatcgaaacttattatgtatactggtaccagcagttcccaggacgccccaactctcatctataagaatatcagcgccncagggtccctgacgattctctggctaccaagtcccggcacctcacgtccctccctggcccatccgagtcgggcctccgggtccgaggatgaggctgtatttagttactgtgcgacagtgggatcggacgtctgcgtggtatgtctcggctggacaaggtcaccgtcagcacgccaagcccaacccntgtcc

SEQ ID NO: 223770 - DNA, 701 bp, Homo sapiens
  misc_feature: GYAE6OF01DBX03.4.45.E01.1.454.CMB.1.raw
  modified_base (379)..(379): a, c, t, g, unknown or other
  misc_feature (379)..(379): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcacgccaccctcacgcgtcgtcggggacccccgggcaggacgggtcacctattcttcttgttcgtaggaacgcaactccaacataccgaaactttattatgtatacgtcggtaccagctacgttcccaaggaacccgacccctaaactcctacatactaataagaataatcacggtccgccctcggacgggtccctagaccgtnttcgtctggcctaccgaacgtccggctaccctcgacgccctccgtcggaccactcgaggtcggggacctccgggtacggaggtacgtcggaggtctaggtaactttacgtttacgtgggtacgaccgtaaccgtaagggttcggggtactacgggtaccgggtccgttagggtccggggttagggttacgttcggtttcccgttaccgggacccggtacggggaaacccgttacgggtacctacccccggttcggtaacgggtcccgaaacccggaccccgtaaaccgggacccccaaaccccgttccgtcggttaaccccg

SEQ ID NO: 223771 - DNA, 598 bp, Homo sapiens
  misc_feature: GYAE6OF01EKBNW.4.45.E01.1.454.CMB.1.raw
  modified_base (208)..(208): a, c, t, g, unknown or other
  misc_feature (208)..(208): n is a, c, g, or t
  modified_base (317)..(317): a, c, t, g, unknown or other
  misc_feature (317)..(317): n is a, c, g, or t
  modified_base (343)..(343): a, c, t, g, unknown or other
  misc_feature (343)..(343): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggacccccgggnagagggtcaccatctcttgttctggaagcaactccaacatacgaaacttattatgtatactggtaccagcagttcccaggaaccggcccccaaactcctcatctataanaataatcagcgccctcgagggtcccngaccgattctctggctcaacgtccgcacctcacgccctccctggccatcagtcgggcctccgggtcccgaggatggacggctgtattattactgtgcgacagtgggatcggaccggtccgtggtcggttagggtacgttcggtccgttcgggacccgttcggggaacccgtaaacgggttcccgaacccggttcccgttaagggtcccaaccgggtacccccaaacggacccccaaaccccctaccgttcgtccc

SEQ ID NO: 223772 - DNA, 583 bp, Homo sapiens
  misc_feature: GYAE6OF01DY2QF.4.45.E01.1.454.CMB.1.raw
  modified_base (313)..(313): a, c, t, g, unknown or other
  misc_feature (313)..(313): n is a, c, g, or t
  modified_base (342)..(342): a, c, t, g, unknown or other
  misc_feature (342)..(342): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggacccccgggcagagggtcaccatctcttgttctggaagcaactccaacatacgaaacttattatgtatactggtaccagcagttcccaggaacgacccccaaactcctcatctaanaagaataatcagcgccctcgacgggtccngaccgattctctggcctaccaagtcccggacaccctcacgccctccctggccatccgaggtcgggcttccgggtccgaggtatcgaggctagtattattacgtgttcgcgacagtgggaatcggacggtcgtggcggttcgggtatcgtcgttcggaccgtagggacctaacgggtccaccggttcccgtaaggtccgaacggtccccaaacgggtacccccaaccccgagttccgtaccc

SEQ ID NO: 223773 - DNA, 670 bp, Homo sapiens
  misc_feature: GYAE6OF01AQE6I.4.45.E01.1.454.CMB.1.raw
tcagagcactgtagcacgaccggtgctcgatttagtgagtcagtaagggaaaggggcagcttcagctgtgctagagaagacaggattcgggacaatctccagcatggccggcttccctctcctcctcaccctcctcactcactgtgcagggtcctgggtccagtctgtgctgactcagccaccctcagcgtctcggggacccccggcaggagggtcaccatctcttgttctggaagcaactccaacatacgaaacttattatgtatactggtaccagctacgttcccaacggaaccggacccccaaactcctacatacctaataagaataactcagccggccctcgacggggtccctagaccgtattcctctcggcctccgaacggtcccggactaccgtcacgtccctccgcggccactcgaggtcggccgtcccgggtaccgaggtacgtaggacggtctggttaactttacgttaccgtggacgtaccgaacgtaggttgggaacgttcgggaaccggtcccgttgggtaccgggtttagggtacttcggttccggttacgggacccgttcggggaaccgttaacggtcccggaacccggtttccggtacgggtaccaacggaccccgtaaaccggaccccaaaccccgtagtccgttacctacccg

SEQ ID NO: 223774 - DNA, 702 bp, Homo sapiens
  misc_feature: GYAE6OF01A9MJD.4.45.E01.1.454.CMB.1.raw
  modified_base (208)..(208): a, c, t, g, unknown or other
  misc_feature (208)..(208): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcacgccaccctcagcgtcgtcggggaccccggnagagggtcaccatctcttgttctggaagcaactccaacatcgaaactttattatagtatactggtaccagctacgttcccaagggaacccggacccccaaactcctacaatctaataagaataactcacgccgccctcgacgggtccctagaccgtattcctacgtcggcctaccgaacggtcccggacctacccgtcgaccgtcccctcccgtcggacctacgtccgacggtcgggtacccgtacccggggtacccgaagggtacgtcgggacggtccgttaggtaattttacgttaaccggttggtacggtacgtaacgtaggttcggggaacttcgggaccggtccgttgggtacgggttacgggttacttcggttccggtttaccgggacccggttacggggaacccgtaacgggttccgtaccccggttccgtacgggtcccgaacggtaccccgaacgggacccccaaacccccgtgttccgtacccg

SEQ ID NO: 223775 - DNA, 671 bp, Homo sapiens
  misc_feature: GYAE6OF01BDZBX.4.45.E01.1.454.CMB.1.raw
  modified_base (209)..(209): a, c, t, g, unknown or other
  misc_feature (209)..(209): n is a, c, g, or t
  modified_base (407)..(407): a, c, t, g, unknown or other
  misc_feature (407)..(407): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccacccttagcgtcgtcggggacccccgggnagaggtcaccatctcttgttctggaagcaactccgaacatacgtaaacttattatgtatactggtaccagctacgttacccaggaacccgccccaaactcctcgtatctaataagaataactcagccgcctcgacggggtcccacgaccgtattccgctggacctaccgaacgtccggacaccgtcacgccctcccgnggcctactacgtaggtcggccgtccggtaccgaggtactcgggagtcgtagtactttaactcgttagtcggtacgtaaccaggttagggtacgtacggaaccgggtccgtacgggtaccgggtttgggtaacgtttcggttccggtaccgggttacccggtaccggggtaacccggtaacggtcccgtaacccgggttaccgttaacggccgtaacggaccccgtaacggacccccaaacccgtccgtacgtccgttaaccccg

SEQ ID NO: 223776 - DNA, 630 bp, Homo sapiens
  misc_feature: GYAE6OF01BLQN9.4.45.E01.1.454.CMB.1.raw
  modified_base (206)..(206): a, c, t, g, unknown or other
  misc_feature (206)..(206): n is a, c, g, or t
  modified_base (476)..(476): a, c, t, g, unknown or other
  misc_feature (476)..(476): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggacccccggnagacggtcaccatctcttgttctggaagcaactccaaacatacgaaacttattatgtatactggtaccagcacgttcccaaggaacccggacccccaaactcctacatactaataaagaataatcgagccggccctcgacgggtccctgaccgattcctcgtcggcctccgaacggtccgctaccctcacgtccccttcccgtcggccctagtcgacggtcgggtccgtcccgggtaccgagggtatcggacggtctgtattatttacgngtgacgactgtggacgtcggaccggtccgttggtccggttgggtactcggttaccgttcgggacccgtaggggaccgtaacgggttcccaacccggttccgtaacgggtccaacggtaccccgaaacggacccctaacccccgtcgtcgtaccc

SEQ ID NO: 223777 - DNA, 769 bp, Homo sapiens
  misc_feature: GYAE6OF01B0KED.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctccaccctcctcactcactgtgcaggtcctgggtccagtctgtgctgactcacgccaccctcacgcgtcgcgggaccccggcgaggacggtccaccactccttcgttcgtcgtaggaacgcctaaacctcccaaacacgtaccgtaaaactttattatagtaactacgtacggtaccagacctacggttacccgacgggaacccgaccccctaaactcctacactactaataaagtaataactcgacgccggtaccctacggtaccggggtccctacggaccgtacttccgtccgtcgcctacccgtaacggtcccggacctacccgtccgaaccgtccccctcccggtcgacccgtacgtcccggacgggttccgggtacccggttacccgggtacccggtaacggacggttacggacgggtcttaacgggttacttttaagttaccggttcggtacggtaccgtacggtaggttccggggaacgtcgggtacccggtccggttacgggtccgggttagggttacgttccggttaccggttaccgggtaccgtaaccgggtaaccggtcggtacccgtacccggttccgtacggtacccacggtaaccccggaacccgacccaaccccgtacgtccgtacccg

SEQ ID NO: 223778 - DNA, 577 bp, Homo sapiens
  misc_feature: GYAE6OF01EXRGV.4.45.E01.1.454.CMB.1.raw
  modified_base (207)..(207): a, c, t, g, unknown or other
  misc_feature (207)..(207): n is a, c, g, or t
  modified_base (396)..(396): a, c, t, g, unknown or other
  misc_feature (396)..(396): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcggggacccccggnaggagggtccaccatctcttgttctggaagcaactccaaacatacgaaacttattatgtatactggtaccagctacgttcccaaggaacccgaccccccaaactccctacactctaataagaataatcgagcgccctcgacgggtccctgaccgtattctcgtggcctccgaacgtccgcacctcgacnccctccgtgccatccgaggtcggccttccggccggaggcgtgacggcttagtatttacgtacttggtcgcgagagtgggatcggacgcgtggtcggtgggtattggtcgttcggaccgtagggaccctaggtccaccggttctaggtccacgtacccaacggaccccaaccctctcgtacc

SEQ ID NO: 223779 - DNA, 651 bp, Homo sapiens
  misc_feature: GYAE6OF01DHYXY.4.45.E01.1.454.CMB.1.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtccgtcgggacccccggnaggacgggtcaccatctcttgtctggaancaactcaacatacgaacttattatagtatactggtaccagccagttccccaggaacccggcccccaaaactcctacactactaataagaactaatccagccggccctcgacgggtcccagaccgtattctcgtcggcctaccgaacggtcccgacctcctcacgtccctcccgtcggccacgtcgacggtcgggtccgtcccgggtacccggaggagttacgacggtctgtaactttacttacgtggtacgacgacgtaggtggagttcggaccggtcgttggccggttagggtcttcggttccgtaccgggtaccgttggggaaccccgtaagggttccctacccggtttcccgaacgggttccgaaccggtaccccaaaccgggacccccaaaccccgtgttcccggtaccc

SEQ ID NO: 223780 - DNA, 629 bp, Homo sapiens
  misc_feature: GYAE6OF01CK34D.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcggggaccccgggcaggacgggtccaccatcttcttgttctggaagcaactccaacatacgaaacttattatgtaatactggtaccagctacgttcccgaggaacccggcccccaaactcctcatctaataagaatatcacgcgccctgacgggtccacgaccgtattcgtctcggctacgaacgtcccgcacctcacgtcccctcccgtcggccctacgtccgtaggtccgggccgttcccgggtaccggaaggtacgtaggacggtccgtaggtaactttacgtttacgtggtacggcgaacgtaggtacgggtacgtacgggaccggtccgttaggtcggttagggtacttcggttcgtcggaccggtcggaccgtacggtcgaccggttcgtacggtcaccggtaccaccgacccaacccctgtcgtaccc

SEQ ID NO: 223781 - DNA, 812 bp, Homo sapiens
  misc_feature: GYAE6OF01BY5DS.4.45.E01.1.454.CMB.1.raw
  modified_base (207)..(207): a, c, t, g, unknown or other
  misc_feature (207)..(207): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggacccccggnagagggtcaccatctcttgttctggagcaactccaacatacgaaacttattatgtatactggtaccagcagttcccaggaaccgccccaaactcctacatctataagaataatcagccgccctcgacggggtccctagaccgtattctctggctaccgaagtcccggcacctcacggtccctacccgtggaccctagtccgtaaggtccggggtcccgttaccccggggttacccggaacgggtacggttacggtaacgggtccgtttagggtaaactttttaaacgtttacccgttaggttacggaccggtaaccgtaagggttacgggggtaagtttaccgggaacccggggttcccgtttacggggacccggggttttagggggtttaaccgtttcggggtttaccccgggttttacccgggtaaaccccgggtttaccgggggtaaaccccggtaaaccggggtttacccccggtaaacccccggggtttccccggttaaacggggtttccccgaaaacccggggttacccccccggaaaaccggggtaccccccccctaaaaccccccggtaacccggtttccccgggtttaaacccccg

SEQ ID NO: 223782 - DNA, 918 bp, Homo sapiens
  misc_feature: GYAE6OF01CJ5EQ.4.45.E01.1.454.CMB.1.raw
  modified_base (219)..(219): a, c, t, g, unknown or other
  misc_feature (219)..(219): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctccaccctcctcactcactgtgcacgggtccgtgggtccagtctgtgctgactcacgcccaccctcacggtccgtccgtccggggacccccggntacggacggtaccaacctacttccttcgtttacggttcgtacgggaaacacctaaacctaccaaactaacgttaaccgtaaaaacttttaattaagttacgttaacttaaccgttacggtaaacccacgtacccgttaaaccggtttaacccccgaaccggggtaaaacccccggtaaccccccctaaaaccgtttcccctaccttaacttaaccttaaaagtaaaacttaaactaaacgtaccgaaccggcccggtaccccgttaccgggacccgggttaccctaccggtaacccgttactttccgtaccgttcggacctaccgtaaccggtccggaccctaccgtcgacccgtccctaccgttacggcctaacgtccggtacggtccggggtaccccgttacccggggaccggtaagggtacgtaacgggtacggttaccgttagttaactttaacgtttacgtacgggttacggaaccgtacggttacggtagggtaccgtaccgggtaccgggtccgttacggggttacggttagggttctttacccggggttccgttaccgggtaaccggttaccgggtaaccccggtaacgggtaccccctttaaccgggtacccgtaaccggtaacccggaaaccccggtaccccgtaaaacccgggccccccttaaaacccgcccggttacgttaaccccg

SEQ ID NO: 223783 - DNA, 729 bp, Homo sapiens
  misc_feature: GYAE6OF01A369K.4.45.E01.1.454.CMB.1.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagcccaccctcagcgtctcggggacccccggnagacgggtcaccatctcttgtctggaacncaactccaacatacgaacttattatagtatactggtaccagcagttaccccaggaaccggaccccaaactccctacactctaataacgaataactcacgcgccctacgacggggtccctcggaccgtatttcctcgtcggtacctaccgtaacggtcccggacctaacccgttcgaccggtcccctccccggtagggacccctaacttccgaaccgggttcggggtacccgttcccggggttacccgggaggtaacggtacggtacggacgtacgtaactttacgtttaacgttcggtacgtaccggtaccgtaggtcgggtaacggtaggacccgggtcgttcgggtacgggttcgggttacgttcggttccggttaccgggtacggtaccggggtaaaccgtaccggtcccgttaacccgggttccgtacgggtcccaacccggtaccccgaaccggtaacccccaaccccgtaccgttccggtaacccc

SEQ ID NO: 223784 - DNA, 700 bp, Homo sapiens
  misc_feature: GYAE6OF01CCPU4.4.45.E01.1.454.CMB.1.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
tcagagcactgtagcacgaccggtgctcgatttagtgagtcagtaagggaaaggggcagcttcagctgtgctagagaagacaggattcaggacaatctccagcatggccggcttccctctccctcctcaccctcctcactcactgtgcagggtcctgggtccagtctgtgctgactcagccaccctnagcgtctcgggacccccggnagacgggtcaccagtctcttgttctggaagcaactccaaacatacgaaacttagttactgtatacgtggtaccagtcacgttcccgaaggaacccggaccccctaaacttccctacactctaataaagaataatcagccgccctcgacgggtccctacggaccgtattcctcgtcggtcctaccgaacggtcccggacacccgtcgacgtccctcccgtcggaccctacgtccgtacggtcgggtccgttacccggggtcccggtaaggacgttcggacggtccttaggtaactttaacgttaccgttaggtcggacgtaacggtaggtaggggtaagtaccgggacgggtcccgttggtccggttagggttacgttcggttcgttacccgggaccgttacggggtaaccctaacgggtcccgtaacccggttccgtacgggtacccgacccggtaccccaaacgggacccccaaaccccgtgtccggtaccc

SEQ ID NO: 223785 - DNA, 664 bp, Homo sapiens
  misc_feature: GYAE6OF01EDW0W.4.45.E01.1.454.CMB.1.raw
  modified_base (206)..(206): a, c, t, g, unknown or other
  misc_feature (206)..(206): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggaccccggnagaggtcaccatctcttgttctggaagcaactccaaacatacgaaacttattatgtatactgtaccagcacgttcccaggaaccgcccccaaactcctcatctaataagaataatcagccgccctcgacggggtccctggaccattctctggcctaccgaagtcccggcacctcgacgtcccttccctcgggccactccgacgggtcggggtcccgttacccggggtcccgaagggtactacgggacgggtccttaggttatttaacgtttacgtggtcggacggaacgtaggtggggtaacgtcggaaccgggtccgttcggcgggttacgggtagttcggttccggttacgggtacccgtacggggtaacccgtaacgggttcccaacccgggttcccgtaacgggtcccaaccgggaccccaaacgggacccccaaaccccgtcgttcgtacccg

SEQ ID NO: 223786 - DNA, 765 bp, Homo sapiens
  misc_feature: GYAE6OF01BMROC.4.45.E01.1.454.CMB.1.raw
  modified_base (214)..(214): a, c, t, g, unknown or other
  misc_feature (214)..(214): n is a, c, g, or t
tcagagcactgtagcacgaccggtgctcgatttagtgagtcagtaagggaaagggggcagcttcagctgtgctagagaagacaggattcaggacaatctccagcatggccggcttccctctcctcctcaccctcctcactcactgtgcagggtcctgggtccagtctgtgctgactcacgcccaccctcagcgtccgtccggggacccccgggnaggacgggtccacctatccttcttgttcgtggaacgcaactccaaacatacgtaaactttattatagtaatacgtacggtacagactacgttacccgaaggaacccgaccccctaaaactccctactaacttaccttaaataaagtaactaactcgaacggtcccggtaccctacggtacggggttcccctacggtaccgtactttaccgtcgtacggtcctaccgtaacggtcccggacctacccgtcaccggtccctcccggtacggacctacgttccggtacgggttccgggtacccgttcccgggttaccggaagggtacgttacgggacgggttcttaaggttaacttttaacgtttaccgtagtacggacgtacgtagggtacgggtagttaccgggaccggtccgttggtcgggttaggttacgtccggttaccgggttaccggaccggttacgggaaccgtaaccggttacccgtacccggttaccggtaccggtaccgaccggtaccccgaaccggtacccccaacccgttcgtccgtaccc

SEQ ID NO: 223787 - DNA, 744 bp, Homo sapiens
  misc_feature: GYAE6OF01CR1LM.4.45.E01.1.454.CMB.1.raw
  modified_base (333)..(333): a, c, t, g, unknown or other
  misc_feature (333)..(333): n is a, c, g, or t
tcagagcactgtagcacgaccggtgctcgatttagtgagtcagtaagggaaaggggcagcttcagctgtgctagagaagacaggattcaggacaatctccagcatggccgcttccctctcctcctcaccctcctcactcactgtgcgagggtcctgggtccagtctgtgctgacctacgacgtcccaccctcaacgccggtccgtacccgggggaccccccgggcgaacggacgggttaccaccgtaacttccttctttacggttaccgtaggaaagccaaacctaccaaacataaccgtaaactttaattatagtaatacgttaggtaaccngactacgtacccaaggacccgacccccaaactcctacattaccgtaataaagataactcaacggtccgccctacggaccgggtcccagacctattactcgacggtcctaaccgaacgtccgaccgtacctcgacccggtccctccgtacgccgtaagtccgaaggttcgggccgtacccgggttacggacgtaaggtacggtacggtacgtagtaatttacgttacgtacgtacgtacgtacgtaggtacggtacgttacggaccggtccgtaggttcggtagggttcgtacgttccgttaccggaccggttacgggaacccgtaaagggttccccgtaaccggttaccggttacggtacccggaaccggaccccgaaacggacccccaaacccgtcgttaccgtaacccg

SEQ ID NO: 223788 - DNA, 761 bp, Homo sapiens
  misc_feature: GYAE6OF01DP0I5.4.45.E01.1.454.CMB.1.raw
  modified_base (216)..(216): a, c, t, g, unknown or other
  misc_feature (216)..(216): n is a, c, g, or t
tcagagcactgtagcacgaccggtgctcgatttagtgagtcagtaagggaaaggggcgagcttctagcttgtgctagagaagtacaggattcaggacaagtctccagcatggccggcttcccgtctcctcgtcaccctcctcgactcactggtgcagggtcctgggtccagtctgtgctgactcaggccaccctcgagcgtcgtcgggaccccggnaggagggtcaccgatctcttgtctaggaacacgaactcaacatacgtaaactttatatgtaatacgtggtaacagcagttccccaaggaacccgaccccctaaacgtcctcactactaataaacgtaataatcgacggtccggaccctcggaccgggtcctacggtaccgtattcgtacgtcggaccttacccgaaacggtcccggtactacccctacgaacgtccccgttacccgtaggaccctaacgtcgaacgggtcggggtaccgttcccggggtaccggagggtacgtgggtacggtcgttaggttaactttacgttaacgtggttacgacgtaacgtaacggttacgggtaactacgggtaacccgggttcgttacggggtacgggtttacgggttagggttcggtttacccgggtttacgggaacccggttacggggtaaacccgtacgggttacccgttaacccggtccggtaacgggtaccaacccgggtaccccggaaacggtaccccgtaacccccgtagtcccgttaaccccg

SEQ ID NO: 223789 - DNA, 625 bp, Homo sapiens
  misc_feature: GYAE6OF01A92G8.4.45.E01.1.454.CMB.1.raw
  modified_base (345)..(345): a, c, t, g, unknown or other
  misc_feature (345)..(345): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcggggacccccggcgaggacgggtcaccatctcttgttctaggaagcaactccaacatacgtaaacttattatgtatacgtcggacagcagttcccaggaccgccccaaactcctcatctataagaataatcagcgccctcgacgggtccngacgtattcgtctcggctcgaacgtccgactacctcacgtccctaccgtgaccctagttccgacgggttcgggacccgttcccgggtacccggaagggtacgtcggacgggtcttaggtaactttaactacgtcggtgaaccggtactaggtcgggtaacgtcggaccgtcgtgcggggttagtacgtcggttccgtacggtaccgtaacgggtacgtacggtacccgacgttccggacgtaccgacccgtaccgacccgaccctaccgtcgtgtacccg

SEQ ID NO: 223790 - DNA, 768 bp, Homo sapiens
  misc_feature: GYAE6OF01D03AA.4.45.E01.1.454.CMB.1.raw
  modified_base (211)..(211): a, c, t, g, unknown or other
  misc_feature (211)..(211): n is a, c, g, or t
  modified_base (753)..(753): a, c, t, g, unknown or other
  misc_feature (753)..(753): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcacgccacccctcagccgtcgtcggggacccccggnagacgggtccaccagtctcttgttctggaagcaactccaaacatacgaaacttatatgtatactaggtaccagcacgttccccgaaggtaacccggaccccctaaactccctactaacttacctaaagtaaacgtaactaaactccaacggcccggtccccttacggaccgggggttaccctacggaacccggttaactttccgtcggtccggtaccttaacccgaaacggttccccggacctaaccccttccggaaccgtccccgtccccgttacgggaccctagtaccggtacgggtccggggaccctttcccggggtacccgaagggtacgttacggaacggggtctaagtttaactttaacgttaccgttaggttccgacgtaccgtaggtcggggtaatcgggaccggtcgtagggtccggttagggttattcggttaccgttccgggtaacccggtagggtaacccgtaacgggttacccacccggtttcgtaccgggtaccaccggtaaccccgaaccggacccctaaaccccgngttacccgtaccccg

SEQ ID NO: 223791 - DNA, 1051 bp, Homo sapiens
  misc_feature: GYAE6OF01A7POD.4.45.E01.1.454.CMB.1.raw
  modified_base (295)..(295): a, c, t, g, unknown or other
  misc_feature (295)..(295): n is a, c, g, or t
tcagagcactgtagcacgaccggtgctcgattttagtgagtcagtaagggaaaggggcacgcttcagcctgtgcgtagagaagacgaggtattctaggacaatcctccagcatgggccgccttccctctcctcctccaccctcctcactcactgtgcagggtcctgggtccagtctggtgctgactcgacgcccgaccgtcgacggccgtacgtccggggaaccccccgggtcgtaaccgggaagggttccaacccgtactttccgttacgtttcgggtttaccgtagggaaacnccgtaaaacccttcccgaaaaccgtacgttaaccggtaaaaacctttttaagtttaagttacggttaaacgttaaccggtttaacgggtaaacccgaacgggtaccttaaccggtttacccccgaaacggggaaaccccggtaccccccctaaaaacctttcccgttaaccgaacgtttacccttaaagtaaaacggtaaactttaacgtaccgtaacggtcccggtacccccttacgggtaccggggttacccccgtaggtaaccccgttagtttccgtacgtcggtaccctaccgtaaccgggttccccggacccgttaacccgtacccgtacgggtccccttcccgggtacgggtaccctaacgttacgtaccggggttccggggtaccccgtttaccccggggtttaccccgggaaagggttaaccgttacgggtaaccggttacgtttaacggttaactttttaaacggttaccgtttagggtaccgttacccggtaaacccgtttagggtaacggggtaaccgttaaccgggacccggtttaacccgttcgggtttaccggttacggggttaaccgttttcgggtaaccccggttttccgggaaccccgggttaacggggtaaccccgtaaaccggggttccccaacccccgggttttaccgtaacgggttacccgaaacccggggtaacccccgggtaaacccggtaaccccccgtaaacccccgttaccggttaccggttaaccccgg

SEQ ID NO: 223792 - DNA, 857 bp, Homo sapiens
  misc_feature: GYAE6OF01EOFJW.4.45.E01.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcacgcccaccctcagccgtccgtcggggaccccgggnaggacggtccaccgtatcttcgtttgttctagggaacnctaaacctccaaactacttaaccgaaactttattactagttaactacgtacggtaccagacgtaccgttacccgaacgggtaaccccgaccccctaaacgttccctacgtaacttaccgttaataaaacggtaaacttaaacgtaccgtaacggccccggtacccgttaccgggtaccggggttcccctacggttaacccgtaacgtttcctaccgtcggacccgttacccgtaaaccgggttcccggacctaccccgtacgtaacccgtccccgttacccggttacgggaccctaacgttcccgggtaacggttccgggggtcccggttccccggggtaccgggtaaggtacgggtacgggtaaccgggtacctttagggttaaccttttaaggttaaccgttgggttaacggacggtacgtacggttaggggtaaccgtccggtaacccgggtcccgttcggggttacgtacggggttactttacgggtcccgttacgggtaccggtaaccgggtaacccggtacggtacccgttacccggtcgttaaccgggaccaaccggtccccgaaccggacccccaacccggttaccgtccgttaacccg

SEQ ID NO: 223793 - DNA, 616 bp, Homo sapiens
  misc_feature: GYAE6OF01CIOV6.4.45.E01.1.454.CMB.1.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (387)..(387): a, c, t, g, unknown or other
  misc_feature (387)..(387): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggaccccggnagagggtcacatctcttgtctggancactccaacatcgaaacttattatgtaatactgtacagcacgtccaggaaccgcccccaaatcctcaatactataaagaataactacacggcggccctcgacgggtccctgaccgattactctcgactcaacgtccggctacctcacgtccctcccnggaccagtacacggtcgggctcccggtacgaggtatcggtaggcctagtacttacgtactaggtgtacgagttagtagggtagttcggaaccgggtcgttaggtcggttaggggttactcgggttccgttaccgggaccttcggggaaaccgtacgggtacccggtacccggttacgtacgggttacgacccgtacccgtacggaccccaaaccctcgtacgttacccg

SEQ ID NO: 223794 - DNA, 867 bp, Homo sapiens
  misc_feature: GYAE6OF01BHLFL.4.45.E01.1.454.CMB.1.raw
  modified_base (217)..(217): a, c, t, g, unknown or other
  misc_feature (217)..(217): n is a, c, g, or t
tcagagcactgtagcacgaccggtgctcgatttagtgagtcagtaagggaaaggggcagcttcagctgtgctagagaagacaggattcaggacaatctccagcatggccgcttccctctcctcctcaccctcctcactcactgtgcgagggtccgtgggtccagtctgtgctgactcacgccaccctcgacggtccgtcggaccggggacccccggngaacggtacgggtccaacctattcctttcgtttgttacgtagggaactacctaacctccgaaactacttaacgttaaaactttattatacgtaactacgtacggtaccagacctaccggttacccgaacgggaaccccgtaccccctaaacgtcctacacgttactaaactaaagtaaactaacgtcgaaccgggcccggttacccgtacgggtacccggggttacccacggtaaccttacgtttccgacgtcggtccctaccgtaaccggtcccggaccttacccgaccaccggttcccctacggtccggtacctacgtcggtacgggtccgggtccgtacccgggtacgaacgggtcgtaacggtccgggttacttaggtttacgtttaacgtttacggtcggtaccgggtaactaacgggtcgggttaccgggacggttaacccggtcccggggtaaccgttgggttcggggttaacggttcggttaccccgggttagggtaccccgggtaccgggtaccccggggtaaaacgtacccggggtttaccccaaccccggggtttacggacccggggttaacccgaccccgggtaaacccgggaaccccggttaaccccccgtaacccgttcggtacccttaaccccgg

SEQ ID NO: 223795 - DNA, 755 bp, Homo sapiens
  misc_feature: GYAE6OF01CUOII.4.45.E01.1.454.CMB.1.raw
  modified_base (206)..(206): a, c, t, g, unknown or other
  misc_feature (206)..(206): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggaccccggnagaggtcaccatctcttgtctgaagcaactccaacatacgaaactttattatgtaatacgtaggtaccagacctacgttaccccaacgggaacccggaccccccaaaaccttccctactaacttacctaaataaaacggaaattaaactaccgaacggcccgggtacccctacggaccgggggttcccctacggtacccgtaatttccgtcgtacggtcccttacccgaaacggttccccggaccaaccccgttcgaaccggtcccccttaccccggtcgggaccctacgttaccgacgggttcgggtcccgttaccccggggttcccggaagggtacgtcggacgggtctaggtacttttaacgtacgttcggtacgccgaacgtagggtagggtatacgggaccgggtccgttgggtcgggttaggggttacttcgggttccgttaccgggacccgttaggggacccgtaacgggtccctacccgggttccgtacgggttcccaccgaaccccggaacgaccccctaaaccccgtgttccgtacccg

SEQ ID NO: 223796 - DNA, 788 bp, Homo sapiens
  misc_feature: GYAE6OF01C26TT.4.45.E01.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (777)..(777): a, c, t, g, unknown or other
  misc_feature (777)..(777): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtcgcagggtccgtgggtccagtcctgtgctgactcacgccctaccctcgacgtccgtcgtaccggggaccccccgggnacggacgggtccaacctnttccgttctttggttccagggaacacctaacctaccgaactattaacgaaacttttatttaacgtcgttaactaacgttcgggtaacctagtccgtaaccggttacccgaaaccggggaaccccggtaccccccctaaaaaccttccctaccgtaacttaaccgttaaattaaaacgtaaacttaaccgtacgaaccgggtcccgtaccccgttacgggacccggggttcccacggtaccggtactttccgtccgtacgtaccctaacgaaccgtcccgactacccctacgacgtcccctaccgtacgacctacgtcgtacggtccggtcgtcccgggtacggtacggtagtacgggtacgtcgttacgttatttaacgtcgtacggtcgactacgaggttagcgtacggacggttcgtacggtcgggttacgttgttaccggttccggtaaccgtaccgggtacggtaaccgtacggtcccgtaccggttacgtacccggtaccgccggaacccgtacgggtacccaaaccccgtntacgttacccg

SEQ ID NO: 223797 - DNA, 770 bp, Homo sapiens
  misc_feature: GYAE6OF01BGNYQ.4.45.E01.1.454.CMB.1.raw
  modified_base (208)..(208): a, c, t, g, unknown or other
  misc_feature (208)..(208): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggacccccgggnagagggtcaccatctcttgttctggaagcaactccaacatacgaaacttattatgtactacgtgtaccagcacgttcccaaggaccggacccccaaactcctcactctaataagaataatcgagccggtccctacggacgggttccctggaccgtattccgtacgtcggtacctacccgaacggttcccggacctacccgttcgaccgtccccttcccgtacggaccctactccgtacggttccggggcccgttacccggggtaccggacgggtacgttcgggaacgggttcttacggttaacgttttaacgtttaccggtggttaccggacggtaaccgtagggttaacggggtaacgttaccgggaacccgggttccgttacgggtccgggttaggggttactttccggttcccggttacccggggtaacccggtacgggggtaacccctaacggggttaccccgtaccccgggtttccggtaaccgggtaccgaacccgggtaacccccggtaaccggggaaccccccaaacccccggttagtttcccgggtaaccccc

SEQ ID NO: 223798 - DNA, 686 bp, Homo sapiens
  misc_feature: GYAE6OF01BBG0V.4.45.E01.1.454.CMB.1.raw
  modified_base (268)..(268): a, c, t, g, unknown or other
  misc_feature (268)..(268): n is a, c, g, or t
  modified_base (346)..(346): a, c, t, g, unknown or other
  misc_feature (346)..(346): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggacccccgggcagaggggtccaccatccttcttgttcgtggaagcaactccaacatacgaaacttattatntatacgtggtaccagcacgttcccgaacggaacccgaaccccctaaaacctccctaccacttactaataaagaataancaagccggccctacgacgggttccctacgaccgtacttctcgtcgctaccgaacggtccgccacctcacgtccctaccctcggacctactcgaggtccgggcttcccgggaccgaggtataggacggtcttagtacttttagtacgtggtcgacgtacgnggtacgggnttacggaccgggtcgttagggtcggttaggggtacttcgggttaccgttccgggtacccgttaccggggtaaccgtaaccgggtcccgttaccccgggttaccgttacggggtacccaacccgggtaccccgtaaacccgggacccccaaaccccgtccgtcggtaccccc

SEQ ID NO: 223799 - DNA, 724 bp, Homo sapiens
  misc_feature: GYAE6OF01CS447.4.45.E01.1.454.CMB.1.raw
  modified_base (211)..(211): a, c, t, g, unknown or other
  misc_feature (211)..(211): n is a, c, g, or t
  modified_base (518)..(518): a, c, t, g, unknown or other
  misc_feature (518)..(518): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctccaccctcctcactcactgtgcagggtcctgggtccagtctgtgctgactcacgccaccctcagccgtcgccgggacccccgggngagacgggtccaccgtactcttcttgttcgtagggaacgaccaacctccaaactacttaaccgtaaactttaacttatgttaactacgttacggtaaccagctaccgtaccccgaacggaaccccggtaacccccctaaaccttcctactacgtacctaaataaacgtaaactactccgacggtcccgaccgtcggaccgggtccctacgtaccgttattcctcgtcggtcctaccgaacgtcccgacctaccgtcaccgtccctacccgcggactcgtcgacgggtcgggtcctccgggacgaggntcggacgtcgtagttatttacgtacgtggtacgacggtaagtcggttagggactcgggtacccgggtcgttgggtcgggtttagggtcttccggttaccgggtcccggtaccggtacccgggaaacccgtacgggtccccgttaccggttcccggtacggtaccaccggtaacccccgacgaaccccctaccctggttcccgtacc

SEQ ID NO: 223800 - DNA, 775 bp, Homo sapiens
  misc_feature: GYAE6OF01D42BJ.4.45.E01.1.454.CMB.1.raw
  modified_base (262)..(262): a, c, t, g, unknown or other
  misc_feature (262)..(262): n is a, c, g, or t
  modified_base (397)..(397): a, c, t, g, unknown or other
  misc_feature (397)..(397): n is a, c, g, or t
  modified_base (706)..(706): a, c, t, g, unknown or other
  misc_feature (706)..(706): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctccaccctcctcactcactgtgcgagggtcctgggtccagtctgtgctgactcacgcccaccctcacgccgtccgtaccggggaccccccgggcaaggacgggtaccaacctattccttctttgttccgtaggaacnccaaactaccgaacaattaacgtaaaactttattagtagtacttacgtacggtaacctagacctacggttaccccgaacggtaaccccgaaccccctaaactcctacctaatacgttaaactaaagaacttaacncgtaacggcccgtcccgtacggtaaccggggtcccctacgaccgtactttccgtacgtcggtaccctacgaaccggttcccggaacctccctacgtaccgtcccctcccgtacggacccagtaccgttaggtccgggccgtaccgggtaccgaggaacgtagacggtcttagtactttacgttaccgtgggacgtcccggaatagtacggggtatacgggaacccgggttcttacgggtagggttccggttagttacggttacccggtttacggccccggttaaaggggtaccccgtaaagggtacccncccgtttaacggaccggtaccgtaacccgaccgaaacccggtaccccaaccccgtgttccggtaacccg

SEQ ID NO: 223801 - DNA, 683 bp, Homo sapiens
  misc_feature: GYAE6OF01DQQRM.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggaccccgggcaggacgggtcacctatccttcttcgttctggaacgcaaactccaacatacgtaaacttattatgtaatactgtaccagctacgttccacggacccggacccctaaactcctcatactaataaagtaatactacgagccggccctacggacgggtcccaggtaccgtatttcctacgtcggtcctaccgaacgtccggaccacccgtccaccgtacctcccgacgccactcgacggtcgggtccgtcccgggtaccgaggtacgtggtacggtcgtagtacgtttacgttacgttgtcgacgacgtagtcgggacgtaggaccggtcgtcggttcggtaggttagttcgtttccggttaccgggtaccggtacgggtaacccggtaacgggttaccgacccggtttaccggtacgggttaccgaacccgtcccgtaaaccgggtaccccaaacccccgtaccgttacggtaaccccg

SEQ ID NO: 223802 - DNA, 903 bp, Homo sapiens
  misc_feature: GYAE6OF01EGZI8.4.45.E01.1.454.CMB.1.raw
  modified_base (214)..(214): a, c, t, g, unknown or other
  misc_feature (214)..(214): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctccaccctcctcactcactgtgcagggtcctgggtccagtctgtgctgactcacgcccaccctcagtccgtcgtcggggacccccgggnaggacgggtccacctatccttcttgttcgtaggaacgaccaacctaccaaactacttaaccgtaaaactttaatttagttacgtaacttacgtacggttaaccacggtactaaccggtttacccccgaacgggaaaccccgggaccccccctaaaaccgttcccttaccgaactttaccgttaaacgttaaaacgtaaaacgttaaaacttaccggaaccgggtacccgggtacccccgttaccggggtaacccgggggtttacccccgtacggtaaacccggtacgttttacccgttacccggttccgggtaacccttaccccgtaaacgggttccccgggaaccctaccccgttccaaccccggtcccccttacccgtcgggtaccctaacgtccggtaacgggttccggggtcccgttaccccggggtacccggtaacgggtaacgtcggggaaccggtacttacgtttaagtttaaccgtttacgttgtacggaccgtaacgtaggtacgggtacgtcgggtaccgggtcgttacgggtcgggttacggtacggttcgtaccgttaccgggtacccgtacggggtaacccgtacgggtccttaacccggttccgtaacgggtacccgaaccggtacccccgtaaacgggaacccccctaaaccccgttagtcccgttaaccccgg

SEQ ID NO: 223803 - DNA, 749 bp, Homo sapiens
  misc_feature: GYAE6OF01BS61S.4.45.E01.1.454.CMB.1.raw
  modified_base (217)..(217): a, c, t, g, unknown or other
  misc_feature (217)..(217): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtccgtgggtccagtctggtgctcgactcacgcccaccctcacgcgtccgtccggggacccccgggnaggacgggtccaccacttcttcgtttcgttacgtaggaacgccaacctaccaaacacttacgtaaaactttattattagttaactaccgttaggtaaccacgtactacggttcccgaacggtaacccgaccccctaaactcctacactacctaagtaaacgaattacacgtacggcccggtacccgtcgacggggtccctacggtaccgtacttcctcgtcgcctaccgaacggtcccgactacccgtcacgtccctccgtcgacctactccgagggtccggtaccgttcccggtaccggtagggactagggacgtacgtagttacgttacgtttacgtcggtacgacgtagtacggttacgggtacgtacggaccggtccgtacggttcgggttaagggttacttcgggttaccggttaccggtaccggtaccgggtaaccgaaccggtttcccgaccggtttcccggtaacggtacccgtaaccggaaccccgtaaccgggaaacccccaacccgtcgtttcgaaccccg

SEQ ID NO: 223804 - DNA, 927 bp, Homo sapiens
  misc_feature: GYAE6OF01DRVRZ.4.45.E01.1.454.CMB.1.raw
  modified_base (214)..(214): a, c, t, g, unknown or other
  misc_feature (214)..(214): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctccaccctcctcactcactgtgcgagggtcctgggtccagtctgtgctgactcacgcccaccctcacgcgtccgtcggggacccccggngaggacgggtccaccgtattccttcgtttgttcgtaggaacgccaacctaccaacattaaccgtaaaactttattagtagtaacttacgttacggtaccagtaccgtacgttaccccgaacgggtaaccccggtaacccccctaaacgttccctactaacttactaaacgtaaacgtaaattaacgttaccgaacggtcccggtaccccgtacggaccggggttccctacggtacccgttaagtttcccgtaccgtacggtaccccttaacccggtaaaccgggtccccggtaaccctacccgtaccgaacccggtcccccttaccccggtacggtaccctaaccgttaccggtacggggttccgggttaccccggttacccggggttacccgggtaaacgggtacggtaacgggtacggttaccgttaggtttaacctttaacgtttaccgccggttaacccgtaccgtttaaccgttaacggttacgaaccgtacgtaccggtaccggttccgttaggggttaacggttttcggggttccggggttaacgggtttccgggggaacccggggttaaccggtaaaaccccgttaaacgggttaccccggttaaccccggtttaacccggtaaaccggtaccccggaacccggtaaccccggtaaacgggttcccccggttaccccgttccccccggttccgggttaacccccg

SEQ ID NO: 223805 - DNA, 785 bp, Homo sapiens
  misc_feature: GYAE6OF01CTQVC.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccacctcagcgtctcggggaccccggcagagggtcaccatctcttgtcgtggaagcaactccaacatacgaaactttattactgtatactggtaccagctacgttcccaggaaccgacccccaaactcctcaatcctaataaagaataatcgaacgccggtaccctcgaacggggtccctacgaccgtacttccgtcgtacggcctaccgtaaacggtcccggacctacccgtcaaccggtccccttcccggttacgggcccaacgttccgaacgggttccggggtacccgtttccccgggtaaccccggtaaggggtacgttacggggacggtcgttacggttaaagtttaccgtttaacgttgggttcggaccgtaaccgtacggttacggggtaacgttacgggaaccgggttccgttacgggtccgggtttaaggggttacttcgggtttaccgttacccgggaaaccggttaccggggtaaccccgtaaacggggttccccttaaccccgggttacccgtttaaccggggtcccgttaaacccggaacccccggtaaacgggtacccccccaaaaccccggttcgttaacccggttaccccg

SEQ ID NO: 223806 - DNA, 742 bp, Homo sapiens
  misc_feature: GYAE6OF01D4RRY.4.45.E01.1.454.CMB.1.raw
  modified_base (209)..(209): a, c, t, g, unknown or other
  misc_feature (209)..(209): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcacgccaccctcacgcgtccgtcgggaccccggnaggacggtcacctattcttacgtttgttcgtaggaacgaccaacctaccaaactacttaacgtaaaactttattagtagtaactacgtacggtaccagcgtacgttcccgaacggtacccgacccctaaactcctactaatctaagtaaagtaataactcgacggccggtcccttacggaccgggttccctacgaccgtacttcctcgtcggtcctaccgtaacgtcccggactacccgtcgaccgtcccgtccgtccggacctacgtaccggtacggttccggggtccgtacccggggtacggtaacggtacgtgggtaaccggtcttaacggttactttacgttacgttggtaacgcgtaacgtagtcgggactccgggacgggttccgtaggtcgggttacggtagttccggttaccggttaccggtacccggttacgggacccgttaacggtcccgtaccgggttaccgtagggtaacccaccgggtaccccgaaccggtaacccccaaccccgttgtaccgttacccg

SEQ ID NO: 223807 - DNA, 909 bp, Homo sapiens
  misc_feature: GYAE6OF01ESWUI.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctccctcctccaccctcctcacctcactgtcgcgacgggtcctcgggtccagtctgtcgcgtacgacctcgacgccctacccgtcgacggtccgtcccgggtcccggggaccccccggagtaacgggtacgggtaccaaccctagttccgtttaccgtttcgttaccgtaacgggaaaccgtacctaaacccgttacccaaaactacgttaaccgttaaaactttattagtaacgttaacgtaccgtacggtaaccacgtactaccgttacccgaacggtaacccgaacccctaaacgtcctactaacttaaccgttaaagtaaaacgtaaactaaccgtacaaccgggtacccgttacccccgtacggggtacccggttacccgaaccgggtaacccttaacgtttcccggtcgtacccggttaccccgttaaacccggaacccgtccccgggtacctaaccccgtacccgtaccccgttaccccggtaccccgtaccggaacccgtacgtaccgggttaacggggtccgggtaccccgggttacccgggtaaccggtaacgggtacgtacggggtacgtacgttaacgttaaacgtttaacgttcgtacggtacggtaccggtaacgttagggtacggtacgggtaccggtaccgggtcgtcggttacggttggtacgttccggtacggtacccgtacgggtaaccggtacgtaccggtcccgttacggtaccgtaccgaccgaacccggacccgtaaccgacccgtaaccccgtgtacccgtaacccg

SEQ ID NO: 223808 - DNA, 873 bp, Homo sapiens
  misc_feature: GYAE6OF01CUCMB.4.45.E01.1.454.CMB.1.raw
  modified_base (149)..(149): a, c, t, g, unknown or other
  misc_feature (149)..(149): n is a, c, g, or t
  modified_base (227)..(227): a, c, t, g, unknown or other
  misc_feature (227)..(227): n is a, c, g, or t
  modified_base (557)..(557): a, c, t, g, unknown or other
  misc_feature (557)..(557): n is a, c, g, or t
tcagagcactgtagcacgaccggtgctcgatttagtgagtcagtaagggaaaggggcagcttcagctgtgctagagaagacaggattcaggacaatctccagcatcggccggccttccctcctcctcctccaccctcctcactcactgngcgaggtccgtggtaccagtctgtgctcgacctcacgccccaccctcgagtccggtccggacccggggaccccccggngaaggacgggtacccacctacttccgtttcgttcgttaccgtaggaaccgacctaaccctcccgaaacgtaacttaaccgtaaactttaaagtttagacggtttaactaacgttacggtaacctacggtcctaccgttaacccccggaacggaaaccccccgtaacccccaaacttcgtactaactactaaagtaaacgtaacaactaccgacggtacccggtcccgtaagggtacccgggtctaccgtaccgtacttccgtcgtaccggacccttaaaccgtccgggtacctaacccgtacccgtacgtacccgtcccctcccgggtanaccttcggtacgtcgggtttacccgggccggttaaccccgggagtaacgggtacgtcggtacgggttacttaggttaaacctttggtttaacccgtggttaacccgaggttaaccgcgggtttaaaccggcgttaaccgggtcccgggccggttagggtacggtttaccggggttcgttaccggttacccggtttacccgggacccggggtttacaaacccgggtttaccggtcccggttaccggtaccggttacggaaccccgacccgttaaccccggacccgttaccccaacccgttcccggttagtacccccc

SEQ ID NO: 223809 - DNA, 900 bp, Homo sapiens
  misc_feature: GYAE6OF01ES66N.4.45.E01.1.454.CMB.1.raw
  modified_base (210)..(210): a, c, t, g, unknown or other
  misc_feature (210)..(210): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcacgccaccctcagccgtcgtcggggacccccggnaggagggtccaccattctcttgtctaggaagctaactccaaacatacgtaaacttattactagtatactggtaccagctacgtacccgaacggaacccgaccccaaactccctactactactaagtaaagtaataatcgacgccggaccccttacggaccggggtcccctaggtaacccgtacgtttccgtaccgttacggtacccttacccgaaccggttcccggacctaacccgttcaacccgtccctaccccgttggaccctagttacgtacggtcggggtcccgttaccccggggtacccggtaaggtacggtaggtaaccgggtccgttaacgggttaaatttttaaccgtttaaccggttagggttacccggtaaccggtaacgttaacgggtaagggggttaacgttacccggggtaacccggggttaccgttcgggggtaaccgggttttacggggggttaactttcggggttttaaccccgtttaaccccgggggttaacccggttaaccggggggtaaaacccccgtttaaacccggggggttacccctttaacccccggggttaccccggtttaaaacccgggggtccccctaaacccccggggtaaacccccggttaaacccggggaaacccccccccgtaaacccccgtttaaacccggtccggtttaaaccccccg

SEQ ID NO: 223810 - DNA, 691 bp, Homo sapiens
  misc_feature: GYAE6OF01ANOMF.4.45.E01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (348)..(348): a, c, t, g, unknown or other
  misc_feature (348)..(348): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcacgccgtcgtcggggaccccccgggnaggacggggtccaccatcctcttcgttctgggaacncaactccaactatacgtaaaacttattatgtaattactcggtaccagcacggttcccaggtaacccgaccccctaaactcctcatctaataagaataacncagccggccctcgacgggtccctagaccgtattcctcgtcggcctaccgaacgttcccggacacccttacgaaccgtccctcccgtacggccctagttccgagtcggggccctccgggaccgaggtagtgacggtctagtattaacttaccgtggttcacggactaaggtgggtaactcgggaaccggtccggttacggcggttggggttactcggtttcccggttacgggaccgttacgggggtaaaccctacgggttacccgacccgggtttaccggttaacggttccgaacccggtaccccgaaaccgggacccctaaccccgtacgttccgttaacccg

SEQ ID NO: 223811 - DNA, 798 bp, Homo sapiens
  misc_feature: GYAE6OF01CIJ2L.4.45.E01.1.454.CMB.1.raw
tcagagcactgtagcacgaccggtgctcgatttagtgagtcagtaaggggaaaggggcagcttcagctgtgctagagaagacaggattcaggacaatctccagcatcggccggcttccctctcctcctcaccctcctcactcactgtgcgtacgggtccgtgggtccagtctgtcgctgacctcacgccctacccgtcgacgtccgtcggtcccggggaccccgggacgacggtacgggccaacctacttcttcgtttcggttcgtacgggaacacctaacctacctaacacgttaactaaactttaattacgtattaactacgttacggaacctacggaccttacgttacccggaacggaaccccggtacccctaaactccgtactactaactaagtaaactaaatacgtacacggaccggtcccctacgggaccgggtccctacgtcctagttcctggccgtactaccgtacgtccgcctcccgtcaccgccctccgcgtccacgtccgtacggtccggggtacctcgggaccggtagacgtcgggtaacgtcgttagttaactttacgtcgttacggcgtactaaaccggtggtacgggtaccgtcgggaccggttcgtacggggttcgttacggggtttactacccgggttttacggtcccccgggtaaagggttcccggggtaaacccgtaaccgggttaccccgtaccgggttttcccgggaacgggttaccccaacccggggtaaccgaaaccccgggtaccccaaacccggttcccgtcgttaaccccgg

SEQ ID NO: 223812 - DNA, 521 bp, Homo sapiens
  misc_feature: GYAE6OF02JGZ2J.4.45.E01.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccacctcagcgtctgggacccccggnagagggtcaccatctcttgtctggaancaactccaacntcgaaacttattatgtatactggtaccagcagttcccaggacgccccaaatcctcatctataagaataatcagccgccctnagggtccctgacgattctntggctccaagtccgcactcacgcctcctgccatcagtcggctccggtcgagntgagctgattattacngtncganagtggatgaccggctagcggtggtatgttccgtcggacctggaccgtaaggtcgaccgtcgtacggtaccacgcccgaaggaccccaacccgtacgtcgtaccg

SEQ ID NO: 223813 - DNA, 653 bp, Homo sapiens
  misc_feature: GYAE6OF02G3F8C.4.45.E01.1.454.CMB.1.raw
  modified_base (312)..(312): a, c, t, g, unknown or other
  misc_feature (312)..(312): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggacccccggcagagggtcaccatctcttgttctggaagcaactccaacatcgaaacttattatgtatactggtaccagcagttcccaggaaccggcccccaaactccctcatctanaaagaataatcagcgcctcgacgggtcctgaccgattctctggcctccaaggtcccggcacctcacgtccctccctcggccacgtccgaggttcgggcccttcccgggtaccggagggtacgttcgggaacggtcgttaggtaattttaacgttaccgtggttcgaccgtacaggttcggggaactcgggaaccggtccgttgggccgtttgggggttaattccgggttccgttaccgggtacccgtcggggtaacccgtaaggggttcccaaccggttccgtaacgggtaccgaccggtacccgaacggtacccccgaacccccttagtacccgtacccg

SEQ ID NO: 223814 - DNA, 528 bp, Homo sapiens
  misc_feature: GYAE6OF02IPPTW.4.45.E01.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (346)..(346): a, c, t, g, unknown or other
  misc_feature (346)..(346): n is a, c, g, or t
  modified_base (523)..(523): a, c, t, g, unknown or other
  misc_feature (523)..(523): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcaggtcctgggtccagtctgtgctgactcagccaccctcagcgtctgggacccccggnagagggtcaccatctcttgttctggaancaactccaacatcgaaacttattatgtatactggtaccagcagttcccaggaccgcccccaaatcctcatctataagaataatcagcgccctgacgggtccctgaccgtattcnctggctccaagtccgcacctcacgccctcctggccatcagtcgggcctcccggtccgaggatggacggtctgtaatttattacgtgtcgcgactagtgggatggaccgctgcgtgggtatcgtcttcggacctgggaccaaggtccaccgtctaggtcacgcccaaggccccaaccntctac

SEQ ID NO: 223815 - DNA, 515 bp, Homo sapiens
  misc_feature: GYAE6OF02F3OGS.4.45.E01.1.454.CMB.1.raw
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
  modified_base (459)..(459): a, c, t, g, unknown or other
  misc_feature (459)..(459): n is a, c, g, or t
  modified_base (481)..(481): a, c, t, g, unknown or other
  misc_feature (481)..(481): n is a, c, g, or t
  modified_base (510)..(510): a, c, t, g, unknown or other
  misc_feature (510)..(510): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagcccaccctcagcgtctcggggacccccgggcagagggtcaccatctcttgttctggaagcaactccaacatcgaaacttattatgtatactggtaccagcagttcccaggaaccgccccaaactcctcatctataagaataatcagcggccctcgacgggtccctgaccgattctctggctccaagtccgcacctcacgccctcctgccatcaggtcggctccggtcgagntggagtctgattattacgngtcgcgacagtggatcgacgcctgcgtggtntgtctcggactggacaggtccnccgtctagtcacgcccaaggcccaacccntgtcc

SEQ ID NO: 223816 - DNA, 666 bp, Homo sapiens
  misc_feature: GYAE6OF02HGF3J.4.45.E01.1.454.CMB.1.raw
  modified_base (353)..(353): a, c, t, g, unknown or other
  misc_feature (353)..(353): n is a, c, g, or t
tcagagcactgtagcacgaccggtgctcgatttagtgagtcagtaagggaaaggggcagcttacagctgtgctagagaagacaggattcaggacaatctccagcatggccggcttccctctcctcctcaccctcctcactcactgtgcagggtcctgggtccagtctgtgctgactcagccaccctcagcgtctcggggaccccccgggcaggagggtcaccatctcttgttctggaagcaactccaacatcgaaacttattatgtatactggtaccagcagttcccaggaaccgcccccaaactcctcatctataagaataactcagcgccctcgacgggtccctgaccgtnttcctctcggcctaccgaacgtcccggactacctcacgccctccctggacccagtccaggtcgggcctcccgggtaccgagggactggacggtctaggtactttacgtttacgtgtcgcgacgtagtgggtattcgggaccggtccgttcgggtacggttggggtagttcgggttcccgttcccggggtacccgttagggggtaaaccccgttaacggggtacccgtaacccgggttcccgttaaggggtccccgtaacgggcccccgaaaaccgggtacccccctaaaccccccgtacgttccggtaccccg

SEQ ID NO: 223817 - DNA, 526 bp, Homo sapiens
  misc_feature: GYAE6OF02FKD3S.4.45.E01.1.454.CMB.1.raw
  modified_base (206)..(206): a, c, t, g, unknown or other
  misc_feature (206)..(206): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggacccccgggnagagggtcaccatctcttgtctggaagcaactccaacatcgaaacttattatgtatactggtaccagcagttcccaggaaccggcccccaaactcctcatctaataagaataatcagccggccctcgaggggtccctgaccgattctctggctccaagtccggcacctcacgccctccctgccatcagtcgggctccgggtcgaggactggagctgattattctgtgcgacagtgggatggacggcctgcgtggtatgtctcggacctggaccaaggtccaccggtctaggtcacgcccgaaggcccaacccatcgtacc

SEQ ID NO: 223818 - DNA, 576 bp, Homo sapiens
  misc_feature: GYAE6OF02F94ZZ.4.45.E01.1.454.CMB.1.raw
  modified_base (206)..(206): a, c, t, g, unknown or other
  misc_feature (206)..(206): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggacccccgggnagagggtcaccatctcttgttctggaagcaactccaacatcgaaacttattatgtatactggtaccagcagttcccaggaaccggcccccaaactcctcatctataagaataatcagccgccctcgacggggtccctgaccgtattcctcgtcggcctcccaaaggtcccggacaccctcacgtccctccccgtggcccatcgaggtcggggcctcccgggtccgaggctggacggctgtatttattactgtgcgacgagtgggatcggacggtcctgcggttggtatcgtcgttccggaccgtcgggaccgtaacggtccaccgttccgtaggtccacggcccgaacggccccaaccccgatcgtaccc

SEQ ID NO: 223819 - DNA, 581 bp, Homo sapiens
  misc_feature: GYAE6OF02FXY2N.4.45.E01.1.454.CMB.1.raw
  modified_base (205)..(205): a, c, t, g, unknown or other
  misc_feature (205)..(205): n is a, c, g, or t
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggacccccggnagagggtcaccatctcttgttctggaagcaactccaacatcgaaacttattatgtaatactggtaccagcagttcccaggaaccgcccccaaatcctcatctataagaataatcagcggccctcgacggggtcccngaccgtattcctctcggctccaagtccgacacctnacgcctcccgtggccatcagtcggtctccggtccgaggatggacgcgtagtagttacttacgtgtcgactaacttatacgtacaacctagtaatgggtatacgtattatcgttaccgttacgggaaccggtaccgtaacgggtccgtacccggtccgttaggtccgacgacccgaacggtacccaaccccgtacgtaccgtaccc

SEQ ID NO: 223820 - DNA, 534 bp, Homo sapiens
  misc_feature: GYAE6OF02I2SV3.4.45.E01.1.454.CMB.1.raw
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
  modified_base (445)..(445): a, c, t, g, unknown or other
  misc_feature (445)..(445): n is a, c, g, or t
  modified_base (528)..(528): a, c, t, g, unknown or other
  misc_feature (528)..(528): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggaccccccgggnagagggtcaccatctcttgttctggaagcaactccaacatcgaaacttattatgtatactggtaccagcagttcccaggaaccgccccaaactcctnatcataagaataatcagcggccctgacgggtccctgaccgattctctggctccaacgtccggcacctcacgtccctcctgccatcgaggtcgggcctccgggtccgaggtactggacggctagtattattactgtcgcganagtggatcggacgctggcgtgggtatgtcttcggactggacaggtccaccggtctaggcacggccctaacggcccaacccgtntgtacc

SEQ ID NO: 223821 - DNA, 642 bp, Homo sapiens
  misc_feature: GYAE6OF02F2QT9.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggacccccgggcagagggtcaccatctcttgttctggaagcaacctccaacatcgaaacttattatgtatactggtaccagcagttcccaaggaaccggacccccaaactcctcatctaataagaataactcagccggccctcgacggggtcccctggacccgtattcctcgtcggcctaccgaaacggtcccggacctaccctcgacgtcccctccccgtggcccactccgaggtcggggcctcccgggtccggaggtacgtggacgggtctggtaatttacgttacgtcgtgcgtactaggtgggattcggaccgggtcctgggtcggttagggtacttcggttcgttccggaccgttaggggaacccgtaacgggttcccaacccggttccgtaacggtccgacggtaccccgaacggacccccaaccccgtacgtccgtacccg

SEQ ID NO: 223822 - DNA, 691 bp, Homo sapiens
  misc_feature: GYAE6OF02GOZKT.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggacccccgggcagagggtcaccatctcttgttctggaagcaactccaacatacgaaactttattatgtatactggtaccagcacgttcccaggaacccggcccccaaactcctcactctaataagaataactcaacggccggcccctcgacggggttccctacggaccgtattcctcgtggtcctacccgaacggtcccggccaccctcgaccgtccctcccgtggaccctactccgacgggtccgggtaccttccccggggtaccggacggtacgtacgggacggtcttaggtactttaacgttcgtggtcgacgtacgtaggtgggtaacgtcgggtaccggtccgttggtccgggttagggtactcggttccgttaccgggacccggtaggggtaacccgtaacgggttacccgtaaccggttccgttaacggttcccgaaccggaccccgaaaccgggtacccccaaaccccggttaccgtaccgtacccg

SEQ ID NO: 223823 - DNA, 559 bp, Homo sapiens
  misc_feature: GYAE6OF02FVKRV.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggaccccccgggcagagggtcaccatctcttgttctggaagcaactccaacatcgaaacttattatgtatactggtaccagcagttcccaggaaccgcccccaaactcctcatctataagaataatcagcgccctcgacggggtccctgaccgtattctctcggctccgaagtcccggctacctcacgccctcccgtggcccatccaggtcgggcctccgggtccgaggatggacggctggtaatttacttacgtgtcgccgtacagtgggatggaccggctggcgtggtatcgtcgttcgacgtcggaccgaaggtccaccgtcgtaggtcacggtcccgaacggccccaacccgtcgtgtacc

SEQ ID NO: 223824 - DNA, 564 bp, Homo sapiens
  misc_feature: GYAE6OF02I08AR.4.45.E01.1.454.CMB.1.raw
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
tcagagcactgtagcacgaccggtgctcgatttagtgagtcagtaagggaaaggggcagcttcagctgtgttagagaagacaggattcaggacaatctccagcatggccggcttccctctcctcctcaccctcctcactcactgtgcagggtcctgggtccagtctgtgctgactcagccaccctcagccgtcgtcggggacccccgggnaggagggtcaccatctcttgttctggaagcaactccaacatacgaaacttnttatgtatactggtaccagctagttcccaggaaccggaccccctaaatcctacactactaataagaataatcaagccgcctgacggggtccctagaccgtattctcgtcggcctaccgaagtcccggactaccctcacgtccctccgtggccatcgagtcgggcctccgggtacgaggatcgaggctagtatttattacgtgtcgacgactagtgggatcggaccgcgtggcggtggtatgtcgtcggaccgtggaccaggtcaccgtctaggtcacgccacggcccaacccatcgtctaccg

SEQ ID NO: 223825 - DNA, 643 bp, Homo sapiens
  misc_feature: GYAE6OF02ILU3O.4.45.E01.1.454.CMB.1.raw
  modified_base (205)..(205): a, c, t, g, unknown or other
  misc_feature (205)..(205): n is a, c, g, or t
  modified_base (523)..(523): a, c, t, g, unknown or other
  misc_feature (523)..(523): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccacctcagcgtctcgggacccccggnagagggtcaccatctcttgttctggaagcaactccaacatacgtaaacttattatgtatactggtaccagcagttcccaggaaccgccccaaactcctcatctataagataatcagcgccctcgacgggtcctgaccgtattctcgtcggcctacgacgtcccgcacctcacgcccctccgtcggccacgtcgacggtcgggaccgtcccggtacggaggtacgtgggacggtcttaggtattttacgttacgttggtcgacggtaacgtaggttcggggaatcgggtaccggtccgttgggtccggtttaggggttnttcgggttaccgttaccgggtaccgttacgggaacccgtaacgggttccctacccggttaccgtacgggtacccaccggaaccccgaaccggaccccctaacccgtccgttacgtacccg

SEQ ID NO: 223826 - DNA, 606 bp, Homo sapiens
  misc_feature: GYAE6OF02G5W8U.4.45.E01.1.454.CMB.1.raw
  modified_base (205)..(205): a, c, t, g, unknown or other
  misc_feature (205)..(205): n is a, c, g, or t
  modified_base (349)..(349): a, c, t, g, unknown or other
  misc_feature (349)..(349): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggacccccggnagagggtcaccatctcttgttctggagcaactccaacatcgaaacttattatgtatactggtaccagcagttcccaggtaaccggcccccaaactcctcatctaataagaataatcagcgcctcgagggtccctgaccgattcnctggcctcaagtccgcacctcacgccctccctggccatcgaggtcgggcctccgggtccgaggactggacggtctagtatttaagttacctgtcgcgactagtgggactggaaccggtccgtggtcggttgggttactggttaccgttccgggaccgttcggggaacctaacgggttccctaaccggttccgtaacggttaccgaaccggtacccccgaaagggaccccctaaaccccgtcgttaccgttaaccccg

SEQ ID NO: 223827 - DNA, 531 bp, Homo sapiens
  misc_feature: GYAE6OF02GV97F.4.45.E01.1.454.CMB.1.raw
  modified_base (208)..(208): a, c, t, g, unknown or other
  misc_feature (208)..(208): n is a, c, g, or t
  modified_base (452)..(452): a, c, t, g, unknown or other
  misc_feature (452)..(452): n is a, c, g, or t
  modified_base (526)..(526): a, c, t, g, unknown or other
  misc_feature (526)..(526): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggaccccccgggnaggagggtcaccatctcttgttctggaagcaactccaacatcgaaacttattatgtatactggtaccagcagttcccaggaaccggcccccaaactcctcatctaataagaataatcaagcgccctgacgggtccctgaccgtattctctcggctaccaagtccgcacctcacgccctcccgtggccatcgaggtcgggcctcccgggtcgaggatcggaggctagtattattactgtcgcganagtggatcgacgctgcgtggtatgtcgtcggcgtggaccaggtccacgtcgtagcacgcccgaacgcccaaccntgtcc

SEQ ID NO: 223828 - DNA, 707 bp, Homo sapiens
  misc_feature: GYAE6OF02G9H6N.4.45.E01.1.454.CMB.1.raw
  modified_base (207)..(207): a, c, t, g, unknown or other
  misc_feature (207)..(207): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcggggacccccggnagagggtcaccatctcttgttctggaagcaactccaacatacgaaacttattatgtatactggtaccagcagttcccaggaacccgaccccaaactcctcactctaataagaataactcagccggccctcgacggggttccctagaccgtacttctcgtcggctaccgaacggtcccggccacctcgacgcccttcccgtcggacctaagtcccgagggtcgggtccgtcccgggtaccggacggtacgttcggaacggtccttaggttaactttaagttaccgtggtacgaccgacgtaacggtagggtacgtacgggaacccggtccgtcggttaccgggttacggggttacttcgggtttccgttaccggtacccggttacggggtaaacccgtaacggggttacccgtaacccggttacccggttaacggtacccgtaaccggaccccgttaaaccgggacccccctaaaacccccggtacttacccggtaacccc

SEQ ID NO: 223829 - DNA, 601 bp, Homo sapiens
  misc_feature: GYAE6OF02H11KS.4.45.E01.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcaggtcctgggtccagtctgtgctgactcagccaccctcagcgtctcgggacccccggnagagggtcaccatctcttgttctggaancaactccaacatacgaaacttattatgtatactggtaccagcagttcccaggaaccgccccaaactcctcatctaataagaataatcagccggcctcgacgggtcctaggaccgattctctggctacaacgtccggacacctcacgccctcccgtgacccatacgacggtcgggtcctcccgggtccgaggacgtggacggtcttaggaatttacttacgtgtcgcgaactaggtacgggactacggaccggtcctggcggttgggtattcggttacgttccggaccgtacgggacccgtaagggttccgaccgttccgtacggtaccgaccgacccgaaccggaccccaaccccgtacgtcgtaccc

SEQ ID NO: 223830 - DNA, 729 bp, Homo sapiens
  misc_feature: GYAE6OF02IGWX9.4.45.E01.1.454.CMB.1.raw
  modified_base (206)..(206): a, c, t, g, unknown or other
  misc_feature (206)..(206): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccacctcagcgtcgtcgggacccccggnagagggtcaccatctcttgtctggaacgcaactccaacatacgaaacttatatgtatacgtggtaccagctacgttccaggaaccgcccctaaactcctacataccgtaaataacgaaataactacaaggccggtcctacgtaacgggggtccccttacggaacccgtattcgttccgtcgggtacccttaccgaaaacggttcccggacctaaccgtccgtaacgtcccctcccgtcggacctaacgtcgaacggtcgggtccgtaccgggtcccgaggtacgtgacggtcgtagtaagtttactaaccgtgttagaccgaacgtagtacggggtatacgggaccggtccgtacgggtcggtacggggttaacttcgggttccgttaccgggtacccgttacgggggtaaacccctaacggggttaaccctaccccgggttaacccgttaacgggttacccggaaccggttaccccggaaaaccggtacccccgaaacccccgtacgttaccgttaaccccg

SEQ ID NO: 223831 - DNA, 621 bp, Homo sapiens
  misc_feature: GYAE6OF02IHWDZ.4.45.E01.1.454.CMB.1.raw
  modified_base (209)..(209): a, c, t, g, unknown or other
  misc_feature (209)..(209): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcggggaccccccgggnaggagggtcaccatctcttgttctggaagccaactccaacatacgaaacttattatgtatactggtaccagctagttcccaggaaccgccccctaaatcctcatctataagaataatcagccgccctgacgggtccctgaccgattctcgtggcctccgaagtcccggcacctcacgtccctccgtggacctatccgaggtcgggacctcccgggtacgaggacgtggacggtctaggtactttagttaccgtggtgaccgtactaggttgggactgggaccgtccgttcggtgggttagttgttccgttacggtaccgtacgggtaaccgtacggtaccgtacccgttaccgtacggttaccgacggccccgaacggaccccgtaaccccaaccgttcggtaccctacccg

SEQ ID NO: 223832 - DNA, 746 bp, Homo sapiens
  misc_feature: GYAE6OF02IEYP6.4.45.E01.1.454.CMB.1.raw
  modified_base (205)..(205): a, c, t, g, unknown or other
  misc_feature (205)..(205): n is a, c, g, or t
  modified_base (738)..(738): a, c, t, g, unknown or other
  misc_feature (738)..(738): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggacccccggnagagggtcaccatctcttgttctggaagcaactccaacatacgaaacttattatgtatactggtaccagcagtcccacgaacggaccccgaaccctacctctactactactaaagaataactactacgacggcccgtaccacgggtacccgtccgtaccgtaaccgttcttcgtcggtacgtacccgtaaccgtacccggtccgtaccctaccgtaccgtaccccgtccccttacccgggacctaacttaccgtacgggtaccggggtcccgtaccccggggttcccgggtaaacggtaaggttccggagggtaccggttcttaagtttaaccgtttacgtcgttcggggaccaccggtaagttagggggttaaccgtagggtacccggtccggttcggtaccggggtttagggtacgtttcgtacccggtttccggacccgggtaacgggtacccggaacggtccgtacccgttccggttacggtaaccggccggtaacccgaacccggtacccggaacccccttaccggtnttaccccg

SEQ ID NO: 223833 - DNA, 681 bp, Homo sapiens
  misc_feature: GYAE6OF02HCOQP.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctcgggacccccggcagagggtcaccatctcttgttctggaagcaactccaacatacgaaacttattatgtatactggtaccagctagttcccaggaacccggcccccaaactcctcactctaataaagaataatcgacgccggccctacgacggggtccctagaccgtattcctcgtcggcctaccgaacggtcccgactacctcacgccctcccgtcggacccatcgacggtcgggtccgtacccgggtacgagggactggacggcttagtaactttacttacgtcggttcgaccgtacgtagtaggggtacttcgggaccggttccgtcgggtcgggtttggggttacttcgggtttacccgttaccggggtacccgttacggggaacccgtaaccgggttacccgtaacccgggttacccgtaacgggtacccgacggtaccccggaaccggtacccccgtaaaccccgtacgttaccgtaccccg

SEQ ID NO: 223834 - DNA, 702 bp, Homo sapiens
  misc_feature: GYAE6OF02IHX66.4.45.E01.1.454.CMB.1.raw
  modified_base (238)..(238): a, c, t, g, unknown or other
  misc_feature (238)..(238): n is a, c, g, or t
  modified_base (356)..(356): a, c, t, g, unknown or other
  misc_feature (356)..(356): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcacgccgtctcggggacccccgggcaggagggtcaccatctcttgttctggancaactccaacatacgaaactttattatgtatactggtaccagcacgttcccaaggaaccggaccccccaaactccctacatactaataaagaataatcagccgtccctgacgggtccngaccgtattcctcgtcggcctaccgaacgtcccggactacccgtcacgtccctcccgtcggaccctatccgtacggtcgggtcccgttccgggtacccgagggtactcggacgggtcttaggttaactttacgtttacgtggttacggaccgtaacgtaggttaggggtaactcgggaacccggtccgttagggtccgggtttacgggttacttcgggttccggtttaccgggtacccggttacggggtaacccggtaacgggttccctaacccgggttcccggttacgttaccggaccgacccccgaaagggtaccccccaaaccccgttcccgttagtaccccg

SEQ ID NO: 223835 - DNA, 580 bp, Homo sapiens
  misc_feature: GYAE6OF02F4XRY.4.45.E01.1.454.CMB.1.raw
  modified_base (205)..(205): a, c, t, g, unknown or other
  misc_feature (205)..(205): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtctgggacccccggnagagggtcaccatctcttgttctggaagcaactccaacatacgaaacttattatgtatactggtaccagcagttcccaggaaccggccccaaactcctcatctaataagaataatcagcgccctcgacgggtccctgaccgtattcctcgtcggccttaccgaaggtcccggacctacctcacgccctcccgtggcccatcgagtcgggcctccgggtccgaggtactggaggcgttgtaacttagttacgtgtcgacgactagtgggtatcggacggtcctggtcgtgggtactgttacgttccggaccgtgggaccgtaaggtccaccggtccgtaggtccgacgacccgaacggccccaacccgctcgtacc

SEQ ID NO: 223836 - DNA, 627 bp, Homo sapiens
  misc_feature: GYAE6OF02I65EO.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggacccccgggcaggagggtccacctatctcttgttctggaacgcaacctccaacataccgaacttattatgtatactggtaccagctacgttcccaggaacccggccccaaactcctcatactataaagaatactcacgcggtccctgacggggtccctgacccgattcctctcggcctaccaagtccggaccacctcacgtccctccctggccactcgacggtcgggtcctccggtccgaggagtggacggtctagtacttagttcgttgcgacgataggtggagttggaccgtcgtggtcggttagggttacttcggttcgttaccgggtaccgtagggtacccgtaacggtcccgtaaccggtcccgttacgggtaccgaccggtaccccgaacggtacccccgaaccccgtacgttaccgtacccg

SEQ ID NO: 223837 - DNA, 693 bp, Homo sapiens
  misc_feature: GYAE6OF02JS0Y3.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcaggtcgtcgtcgggacccccggcagagggtcaccatctcttgttctggaagcaactccgaacataccgtaaacttattatgtaatactcggtaaccagcagttcccaaggaaccgaccccaactccacactctaataaagtaataactcacgaccggccctacgacgggtccctcgaccgtattcctcgtcggctacccgaacgtccgacctaacccgtcacgtccctcccgtacggccctagttaccgacggtcgggtcccgtacccgggtaccgtacggtacggttcggacggtctaggttaactttagttaccgttaggttcgaccttaaaccgttagtacggaaccctaacgtacggtaaagtcgggtaaacttactaacgttagttaccgtaccggtttaccgggaacccggtaccggtacgggtaaccctaccggtaaccggttacggaccgtaaccggtaaccccgtaacccggaccccaaacccgttcgtaccgtaccc

SEQ ID NO: 223838 - DNA, 687 bp, Homo sapiens
  misc_feature: GYAE6OF02IC671.4.45.E01.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccacctcagcgtctcgggacccccggnaggagggtcaccatctcttgtctaggagcaactccaanatacgtaaacttattatgtatactgtaccngcacgttccaacggaacgaccccccaaactcctactactacctaataacgaataactacaacggccggtcctacggacggggtccctgaaccgtacttctcgtcggcctaccgaaacgtcccggaccaccctcgaccggtccctcccgtcggaccctagtccgtacggtccggggacctcccgggtaccgaagggtactagggacgtcgttagtaactttagttacgtggtacgacgacgtaggttgggaacgtcgggtaccgtcgttcgggtcggtttagggtacttcgggttaccgttccgggacccggttacggggtaacccgtaaggtcccgtacccggttacccgttaacgggttccaccgggtaccccgtaaaccgggaccccctaaccccgtacggttctaaccccg

SEQ ID NO: 223839 - DNA, 714 bp, Homo sapiens
  misc_feature: GYAE6OF02HY288.4.45.E01.1.454.CMB.1.raw
  modified_base (213)..(213): a, c, t, g, unknown or other
  misc_feature (213)..(213): n is a, c, g, or t
  modified_base (326)..(326): a, c, t, g, unknown or other
  misc_feature (326)..(326): n is a, c, g, or t
  modified_base (355)..(355): a, c, t, g, unknown or other
  misc_feature (355)..(355): n is a, c, g, or t
  modified_base (413)..(413): a, c, t, g, unknown or other
  misc_feature (413)..(413): n is a, c, g, or t
tcagagcactgtagcacgaccggtgctcgatttagtgagtcagtaaggggaaaggggcagcttcagctgtgctagagaagacaggattcaggacaatctccagcatggccggcttccctctcctcctcaccctcctcactcactgtgcagggtcctgggtccagtctgtgctgactcagcccaccctcacgcgtccgtcggggaccccccggnaggagggtccaccatctcttgttctggaagcaactccaacatacgaaacttattatgtaatactgaccagctacgttcccaggaaccgaccccaactcctacatctaataaanaataatcagtcggcctacgacgggtcccngtaccgtattctcgtcggcctaccgaacggtccgacctacctcacgtcccttccccgngacccacgtcgagggtcgggtcccgtacccgggtacgaacgggtgtacgggacggtctaggttaacgttttacttaccgtggtacgtaccgtaacgtaggttcggggacgttcgggaaccggtccgttagggttcgttaagggggttactttcggggttacccgtttaccggggtaccggttaccggggaacccgttaaacgggttccccgtaacccggggtttaccgtaacgggttacccgaaccgggtaaccccgaaaccggtacccccctaaaaccccgtaccggttccgtaaccccg

SEQ ID NO: 223840 - DNA, 622 bp, Homo sapiens
  misc_feature: GYAE6OF02IADQ6.4.45.E01.1.454.CMB.1.raw
  modified_base (208)..(208): a, c, t, g, unknown or other
  misc_feature (208)..(208): n is a, c, g, or t
  modified_base (466)..(466): a, c, t, g, unknown or other
  misc_feature (466)..(466): n is a, c, g, or t
  modified_base (531)..(531): a, c, t, g, unknown or other
  misc_feature (531)..(531): n is a, c, g, or t
tcagagcactgtagcacgaccggtgctcgatttagtgagtcagtaaggggaaaggggcagcttcagctgtgctagagaagacaggattcaggacaatctccagcatggccggcttccctctcctcctcaccctcctcactcactgtgcagggtcctgggtccagtctgtgctgactcagccaccctcacgcgtctcgggacccccggnagagggtcaccatctcttgttcaggaagccaactcccaacatacgtaaacttaattatgtaactactgtaccagctacgttcccgaaggaaccgcccccaaactcctcatctaataagaataatcagccgcctcgacgggtcctgaccgacttctcgtggcctaccgaacggtcccggccacccgtcaccgtcccctacccgtcggaccctatcgacgggtcggggtccctcccgggtaccggaggacgtaggcggtntacgtattttacgtacgttgcgacgactaggtcggagtcgaccggtcgtggttcggtgggttacncgggttcgtcggtaccgtacgggacgtaacggtccggtacctaccggtacgtcgaccgtacccgaaccggaccctacccgacgtctacccg

SEQ ID NO: 223841 - DNA, 649 bp, Homo sapiens
  misc_feature: GYAE6OF02GMG4P.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggacccccggcaggacgggtcaccatcctcttgttctggaagcaacctccaacatacgaaacttattatgtatactaggtaccagctacgttccccgaaggaacccggacccccaaactccctacactactaataagaataatacagccgaccctcgacgggtccctacgaccgtattccgtctcggctaccaacggtccgacaccctcacgtcccctcccgtcgacctacgtcgtacggtcgggtcccgtccggggtaccgagggtacgtgggaacggtcgtggttaaactttacgttacgttgtcgtacgactaggtgggtacgttacggaccggtcgtcggtcgttgggtacttggtaccgttcggaccgttcgggaaccgtaacggtccctaaccggtaccgtaggtaccgaccgacccggaaccggccccaaccccgtgtccgtaccc

SEQ ID NO: 223842 - DNA, 859 bp, Homo sapiens
  misc_feature: GYAE6OF02IOHBB.4.45.E01.1.454.CMB.1.raw
  modified_base (204)..(204): a, c, t, g, unknown or other
  misc_feature (204)..(204): n is a, c, g, or t
tcagagcactgtagcacgaccggtgctcgatttagtgagtcagtaagggaaaggggcagcttcagctgtgctagagaagacaggattcaggacaatctccagcatgccggcttccctctcctctcaccctcctcactcactgtgcaggtcctgggtccagtctgtgcttgactcgagccacctcagcgtctcgggacccccggnagaggtcaccatctcttgtctaggagctaactccaactataccgaaacttacttagtcgtactactacggttaccagtcctacgttcccgaagggtaacccggaccccctaaaccgttccgtaccactacccgtaattaaacggaaacttaattaccgacgaccggtaccccgtacgtaacgggggttacccctaggacccgttagttcccttcggttacggcccgtttaacccgtaaaccggttcccgggtaccctaacccgtttccgaaccggtccccgtttaccccggtacggacccgtaccttccggtaacgggtcgggtcccgtacccgggtcgaacgggtcgtacggacggtccgtaagtacgtttaacttaccggtagttcggaaccgtacgttaacgggtggggttaacgtacgggtacccggggtaccttcgggggtaccggtttaggggggttaacttaccgggtttcccggttaacccggggtacccggttaaccgggggttaacccggtaaaccgggtccccggttaaccccgggtttaacccggtttaccggggttaaacccggtaccccggttaaacccccgggtaacccggttaaaccccccgtaaacccccggttacccgtttaccggttaacccccgg

SEQ ID NO: 223843 - DNA, 729 bp, Homo sapiens
  misc_feature: GYAE6OF02J2WDI.4.45.E01.1.454.CMB.1.raw
  modified_base (147)..(147): a, c, t, g, unknown or other
  misc_feature (147)..(147): n is a, c, g, or t
  modified_base (286)..(286): a, c, t, g, unknown or other
  misc_feature (286)..(286): n is a, c, g, or t
  modified_base (606)..(606): a, c, t, g, unknown or other
  misc_feature (606)..(606): n is a, c, g, or t
tcagagcactgtagcacgaccggtgctcgatttagtgagtcagtaagggaaaggggcgagcttcagctgtgctagagaagacaggattcaggacaatctccagcatggccggcttccctctcctcctcaccctcctcactcactgtncagggtcctgggtccagtctgtgctgactcacgccaccctcagccgtcgtcggggacccccgggcacggacgggtccaccacgttccttcgttcgttccgtggaacgccaacttacccaactactaccgtaaaaccttnttatcgtactacgtcggtaccagcacgttcccgaacggaacccggccccaactcctctatctaataagataactcacgtccggccctacggacggggtccctacggaccgtacttcgtaccgtcggacctacccgaacggttcccgaccaacccttccgaccgccccgttcccgtggaccctacgtccgtaacgggttccggaccccgttcgggtaccccggtagggacgttgggacgtcgacggttactttacgttacgtcggagtacggactaggtgggtaactcggaccgggttccgtacgggtcggtacgggtttntccgggtttacggtaccggtaccggtacgggtaacccgtaacgggttcccgaccggtttacccgaacgggttccaccggtaaccccgaccgggaaccccctaacccgtcgtccgttaacccgg

SEQ ID NO: 223844 - DNA, 780 bp, Homo sapiens
  misc_feature: GYAE6OF02H0PRE.4.45.E01.1.454.CMB.1.raw
  modified_base (206)..(206): a, c, t, g, unknown or other
  misc_feature (206)..(206): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctctcaccctcctcactcactgtgcagggtcctgggtccagtctgtgctgactcagccaccctcagcgtcgtcgggacccccggnagagggtcaccatctcttgttctaggagcaactccaacatacgtaaacttattatgtattactaggtaccagctacgttccccaagggaaccgacccccctaaactcctacacttacctaataacgaataactcgaacgccggtccctacgaccggggtccctaggaacccgtattccgtcgtcggacctacccgaacgtcccgggacctacccttaccgaccgtccccttaccccgtacgggtaccctacgttaccgagggttacccggggtcccgttacccgggggtacccgtaaggggtacttcggggaaccgggttaccgttacgtaaacgttttttaagttacccggttggttaccggaccggtaaaccgtaggttacggggacgtttaccgggacccgggttcccgttagggaccgggttttggggtaaacgtttcgggtttacccgttaccggggtacccgttacggggaacccgtaaacgggttcccgtaaccgggttacccgttacgggtaccacccgggtacccgtaacgggtacccccctaacccgtcggttacgtaaccccg

SEQ ID NO: 223845 - DNA, 672 bp, Homo sapiens
  misc_feature: GYAE6OF02HGA9V.4.45.E01.1.454.CMB.1.raw
  modified_base (120)..(120): a, c, t, g, unknown or other
  misc_feature (120)..(120): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
tcagagcactgtagcacgaccggtgctcgatttagtgagtcagtaagggaaaggggcgagcttcagctgtgctagagaagacaggattcaggacaatctccagcatggccggcttccctntcctctccaccctcctcactcactgtgcgacgggtccgtgggtccattcgtgtgctcgactcacgccacctcacgcgtcgcgggaccccggnagnggtcaccntctcgttgttaccgnggaacgcctaactccaaatactacgaactttatatgtatactcgtaccagctacgttccaacggaccgacccctaacncctacactactanaagaactaacncagtccgcccgtacgacgggtccctacgacgtattccncgtcgctacgacgtccgacacctcgacctccctcgcgactctcgtacgggtcggtacccgtccggtaggaacgtacggtacgggcggtacgttacgttaacttttacgtacggtcgtacggaccgtacggtaggtacgggtacggttaccggccgggtcggttacgggtcgggttacggttacgttaccggttccgttaccgggaccggtacggggtaaccgtaccgtaccggttaccgtaccggttacgtaaccgacccgaccgtaacccgaccccgtacgtacgtccgtacc

SEQ ID NO: 223846 - DNA, 725 bp, Homo sapiens
  misc_feature: GYAE6OF02HLW4M.4.45.E01.1.454.CMB.1.raw
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcgggaccccggnagacggtcaccatctcttgtctggancaactcaacactacgaacttatatgtatactgtacagtcacgttacccgaacggtaacccgaccccaaactccctactactacgttaataaacggtaactaacgtaccgaggccggtacccgtacggtaccggggtccctacggaccgtacgttccgtcgttcggtacctaccgtaacggtcccggtactacccgttaccgaccggtccccgttacccgtaggtaccctacgtaccggtacgggtccggggttacccgtcccggggtacggtacggtacgttacggagtccgttagtactttacgttacgtgtacgacgtacgtaggtacgggtactacgggtaccggtccgttacggtcggttaggggttacttacgggttacgttccgggtaccggtacgggtaaccggtaacggtttacccgtaccggttaccggttacggtaccgaccgtacccgaccggtaacccctaaccccgtgtacccgtacccg

SEQ ID NO: 223847 - DNA, 722 bp, Homo sapiens
  misc_feature: GYAE6OF02I7DZ2.4.45.E01.1.454.CMB.1.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctctcaccctcctcactcactgtgcagggtcctgggtccagtctgtcgctgactcagccaccctcagcgtcncgggaccccggnagagggtcaccatctctgttcaggacgcaactccaacatacgaaacttattatgttatacgtggtaaccagactacgttccgaacggaaccggacccccaaactcctcaactacctaagtaaagaaataactccgagccggaccctacgacggggtcccctagaccgtacttccgtctggacctacgaacggtcccggactacccgtcgacggtccccttccgacggccctactccgaacgggtccggacccgttcccgggtaccgagggactagggacggtacgtacgtaatttaacgtttacctgggtacgtcccggtaaagtacgggtacgggtaacgttcgggaacccgggttacgtcgggtacgggtttaagggtacgttcgtttaccggttaccgggacccgttaggggtaacccgtaacgggttcccggtaaccccggttaacgttaccgggtaaccacccggaacccgtaacccgggaaccccctaaccccgtaccgtagttaaccccg

SEQ ID NO: 223848 - DNA, 817 bp, Homo sapiens
  misc_feature: GYAE6OF02JPYZH.4.45.E01.1.454.CMB.1.raw
  modified_base (210)..(210): a, c, t, g, unknown or other
  misc_feature (210)..(210): n is a, c, g, or t
tcagagcactgtagcacgaccggtgctcgatttagtgagtcagtaagggaaaggggcagcttcagctgtgctagagaagacaggattcaggacaatctccagcatggccggcttccctctccctcctcaccctcctccactcactgtgcagggtcctgggtccagtctgtgctgactcagccaccctcagcgtcgtcgggacccccgggnacggacgggtcaccatctcgttcgttctaggaacgcaacctccaaacactaccgtaaaactttattatcgtaattacgtcggtaccaggtacctacgttaccccgaacgggaacccggtaacccccaacgttccctacacttactaagttaaacaaagttaactaccgacggacccggtccccgtacggtaccgggggttcccctaggaacccgttactttcccttaccggtaccgggtacccttaacccggtaacggtccccggtacctaaccccgttcgacccgtaccccgttcccggtaccgccgtactaccggtacgggtaccgggtccccggtacccgggtaccgggaacggtacgttacggaccggtaccgttaggtttaaccttacgtttacggtggtccggtacgtacgtagggttacgggtacgtaccggtaccggccggttacggtcgggttcgggtacgtttccggttaccggttccggtacgggttaccgggtacccggtaacggtacccgttacccggttacggtacccggttacgaccccggttaacccggaacccggtaaccccgtacccccgttacgtacccgttaacccg

SEQ ID NO: 223849 - DNA, 607 bp, Homo sapiens
  misc_feature: GYAE6OF02HLF7I.4.45.E01.1.454.CMB.1.raw
  modified_base (357)..(357): a, c, t, g, unknown or other
  misc_feature (357)..(357): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagcccaccctcagcgtcgtcggggacccccgggcaggacgggtcaccatctcttgttctggaacgcaactccaacatacgaaacttattatgtatactggtaccagctacgttccacggaaccggccccaaactcctcatctaataagaataatcacgcgccctgacgggtcctgaccgtnttctctggcctacgaacgtccgactacctcacgtccctccgtcggcctatccgacggttcgggaccctcccgggtacgaggtagtcggacggtctagttactttagttacgtgtacgccgaagtacgtgggtatcggaccggtcgtggtcggtgggttatcggtcttccgggaccgtacgggacctaacggtccgtaccggtcgtaacggccgaccggacccgaacggtaccccaacccgtgtacgtacc

SEQ ID NO: 223850 - DNA, 507 bp, Homo sapiens
  misc_feature: GYAE6OF02GEEWU.4.45.E01.1.454.CMB.1.raw
  modified_base (185)..(185): a, c, t, g, unknown or other
  misc_feature (185)..(185): n is a, c, g, or t
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
tcagagcactgtagcacgaccggtgctcgatttagtgagtcagtaagggaaagggcagcttcagctgtgctagagaagacaggattcaggacaatctccagcatggccggcttccctctcctcctcaccctcctcactcactgtgcagggtcctgggtccagtctgtgctgactcagccaccctnagcgtcngggacccccggnagagggtcaccatctcttgttctggaagcaactccaacatcgaaacttattatgtatactggtaccgnagttcccaggaaccgccccaaactcctcatctaataagaataatcagcgccctgacggggtccctgaccgattctcgtgctccaagtccggcacctcacgcctccctggcctatcagtggctcggtcgagntgngctgattactactgtgcacatgggatgacgctgcgtggtatcgtcgtcggcctgggacctaggtcaccgtcgtagcgagcccgagcccacccagtgctccg

SEQ ID NO: 223851 - DNA, 820 bp, Homo sapiens
  misc_feature: GYAE6OF02HXQOU.4.45.E01.1.454.CMB.1.raw
  modified_base (205)..(205): a, c, t, g, unknown or other
  misc_feature (205)..(205): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctctcaccctcctcactcactgtgcaggtcctgggtccagtctgtgctgactcagccacctcagcgtcgtcggggacccccggnaggacggtcaccatctcttgttctggaagcaactccaacatacgtaaacttattatgtatacgtggtaccagctacgttacctaaggaaccggaccccctaaactccctacaacttactaaataagaaataactcaaggccggaccctacggacggggtccctgaaccgtattactcgtacggcctaccgacgtcccggacctaccgtcaccgtccctccgtacggacctaacgtccgtaacgggtcgggtacccgtcccgggttaccggaagggtactacgggtacggtcttacggttaaagttttaccgttaacgttcgggtacggaccgtaaacggttaggttacgggggtaacgttaccggggtaccggttaccggtacgggttccggggttttaacgggggttactttacccgggtttacccgggttttaacccgggggtacccgggtttaaccgggggaaaaccccgtttaacgggggttacccccggtaaaaccccgggttttacccggttaacgggggttaccctaaacccggggtaaccccccggtaaaacccggggtaaccccccctaaaacccccccggttacggtttacccggttaacccccg

SEQ ID NO: 223852 - DNA, 675 bp, Homo sapiens
  misc_feature: GYAE6OF02GDRBN.4.45.E01.1.454.CMB.1.raw
  modified_base (206)..(206): a, c, t, g, unknown or other
  misc_feature (206)..(206): n is a, c, g, or t
  modified_base (403)..(403): a, c, t, g, unknown or other
  misc_feature (403)..(403): n is a, c, g, or t
tcagagcactgtagcacgaccggtgctcgatttagtgagtcagtaagggaaagggggcagcttcagctcgtgctagagaagacaggattcaggacaatctccagcatggccggcttcctctcctctcacctcctcactcactgtcgacacgggtcctggtccagtctgtgctgactcacgccacctcagcgtctcgggaccccggnacggcgggtcaccatcttcttgttctacggaagcaacctccaacatacgaaacttattatgtatactcgtaacacgctagttccaaggaaccgaccccaaactcctacactactaataacgaaataatacacgtccgtaccgtcgacgggtcctacgaccgtattctactcggctaccgaacgtccggactacctcncgtaccctccgtacggaccactacgacggttcgggccttccgggtacggagggtacgtgggaacgtctacggttaactttacgttacgtcggttacgccgtagtacgttacggggacttcggaaccgggtcgtttcgggacgggtttacgggttacgttacgtttccggttaaccggtccggtacgggtaccgtaaacgggtcccgtaaccggttccgttaacggtacgaacccggtacccgaaacggacccctaaccctacgtcttaaccg

SEQ ID NO: 223853 - DNA, 739 bp, Homo sapiens
  misc_feature: GYAE6OF02HS41K.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctctcaccctcctcactcactgtgcaggtcctgggtccagtctgtgctgactcacgccacctcagcgtctcgggaccccggcagaggtccaccagtctcttgttctggaacgtcaacgtccaaacatacgaaaacttattaactgtattactacggtaccagctacgttacccaaggaaccgaccccccaaactcctcaatctaactaaagaataaatcagccggacctacgacgggtcctgaaccgtattctcgtacgactccgaaacggtcccggtaccaacctcgacgtccccttacccgtcggtacctaacgtccgtaacggtacggggtccccgtacccggggttaccggaacgggttaacgttacggggacgggtaccttaagggttaattttaaaccgttaacgttggttacgaaccggaactaaggtcggggtaaatcgggaacccgtccgttcggacgggttagggtaacgttcgttacgtttaccggtaccggtacggggtaacccgaaacgggttaccggaacccgttcccggtttaacgggaccgaaccggtaaccccggaaaccggtacccccgaaaaccccccgttagttaccgttaaccccgg

SEQ ID NO: 223854 - DNA, 748 bp, Homo sapiens
  misc_feature: GYAE6OF02HA1JF.4.45.E01.1.454.CMB.1.raw
  modified_base (225)..(225): a, c, t, g, unknown or other
  misc_feature (225)..(225): n is a, c, g, or t
  modified_base (319)..(319): a, c, t, g, unknown or other
  misc_feature (319)..(319): n is a, c, g, or t
  modified_base (428)..(428): a, c, t, g, unknown or other
  misc_feature (428)..(428): n is a, c, g, or t
tcagagcactgtagcacgaccggtgctcgatttagtgagtcagtaagggaaagggggacgagcttcagctgtgctagagaagacaggattcaggacaatctccagcatggccggcttccctctcctcctcaccctcctcacctcactcgtgcgacgggtccgtcgggtccagtctgtgctacgactcacgccctacctcgacgcgtcgtccggggacccccgggngacggacgggtcacctattcttcttgttcgtaggaacgcctaactccaacgtactaaccgtaaactttattagtagttaatacgtcggtaaccngctacgttaccgacggaacccggtaccccctaaactcctactactactaataaacgtaataacgtcgacggtccgacccgtaccggtacggggttcccacgaaccgttnttccgtacgtccggtaccttaccgtaaccgggtccgacctaacccgtccgacgtacccccgttccgtaccggtaccaacggttccggagggttccgggttcccggtacccggtacgggtaaggtacgtcgggacgtacggtactttaacggtttacttacggtggaccgtacgtaacggtcgggttaaggtccgtcgggtaccggttcgtcggtacgggttggttaccgtgtttccgtaccggtacgtaccggacgacgggttaccctcggtcgttagaccggcccacggacccgtacccgtaaccctaggccttacccg

SEQ ID NO: 223855 - DNA, 1016 bp, Homo sapiens
  misc_feature: GYAE6OF02GIVN6.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagcccaccctcagcgtcgtcggggaccccggcaggagggtccaccgatctcttcggttcgtacgggaacgacctaaccgtacccaaactaacgttaaccgtaaaaccttttaattttaattaggttaacttaaccgttacggggtaacccctaaggtacccttaacggttttaccccccgaacggggaaaacccccgggtacccccccctaaaaaacccgttccccttacctaaaccttaacccgttaaaattaaaacggtaaaaacttttaaaacgtaccccgtaagggtaccccgggtaccccttacccggggtaaccggggggttaccccctacgggtaacccgttaaacttttccgtccgttacgggtaccctacccggtaaaaccgggttccccggtacctaaccccgttccaacccggtccccccgtttaccccggtaccgggaccctaaccttccggtacgggttacccgggggtcccgttaccccgggggttcccgggtaacgggtacggtccgggtaacgggtccgttagggttaaacgttttaactttaccggttacggtacgggtaccggtaaacgtacgggttaggggaaccggttacgggacccgggttaccgtccggggttacggggttacgggttttacgttccgggttacccggttttacccggggtacccgggttaacgggggaaccccgtttaaacggggtcccccggtttaaacccgggtaccccggtttaacggggtacccggttaacccgggaaccccggtaaaaccccgggtacccccccgtaaaccccgttccccgggttaccgttaaaccccccgg

SEQ ID NO: 223856 - DNA, 645 bp, Homo sapiens
  misc_feature: GYAE6OF02GFUZX.4.45.E01.1.454.CMB.1.raw
  modified_base (212)..(212): a, c, t, g, unknown or other
  misc_feature (212)..(212): n is a, c, g, or t
  modified_base (282)..(282): a, c, t, g, unknown or other
  misc_feature (282)..(282): n is a, c, g, or t
tcagagcactgtagcacgaccggtgctcgatttagtgagtcagtaagggaaagggggcagcttcagctgtgctagagaagacaggattcaggacaatctccagcatggccggcttccctctcctcctcaccctcctcactcactgtgcagggtcctgggtccagtctgtgctgactcacgccaccctcagccgtcgtcggggacccccgggnacggagggtcaccatctcttgttctggaacgcaactaccaacatcgaaacttattatgtatactcgtacngcacgttcccaggaaccggacccccaaactcctctactctaataaacgaataactcacgccggcctcgacgggtcctagaccgtattctcgtcggtcctaccgtaacgtcccggactacctcacgtcccctccgtggaccctatcgagggtcgggcccgtccgggtacccggaaggtactgggaacggtcttaggtaatttacgttacgtgtctacggtactagtagggtagtacgaccggtcgtgtcggtggtactcggttcgtaccgcggttacgggaccgtacgggtccgtaaccggtccgttaacgggtcccgaacggtaccccggtacggaaccccctaacccgtaccgttgtacccc

SEQ ID NO: 223857 - DNA, 739 bp, Homo sapiens
  misc_feature: GYAE6OF02IP59Y.4.45.E01.1.454.CMB.1.raw
  modified_base (211)..(211): a, c, t, g, unknown or other
  misc_feature (211)..(211): n is a, c, g, or t
tcagagcactgtagcacgaccggtgctcgatttagtgagtcagtaaggggaaaggggcagcttcagctgtgctagagaagacaggattcaggacaatctccagcatggccggcttccctctcctcctcaccctcctcactcactgtgcagggtcctgggtccagtctgtgctgactcacgccacctcacgcgtcgtcggggacccccgggnaggacgggtcacctatcttcgttgttcaggtaacgcaactccaactatacgtaaacttattatatacttacgtaggtacagctacgttccaacggaaccggaccccctaaactcctacacgtactaataaataataatacacggccgcctcgtacgggtcctacgaccgtattctcgtcgctaccaacggtccgcacctcgactccctccgtcggcctactcgtacggtcgggtcgtccgggtccgaggtactcgggacgtcgtacggttactttacgttacctggttacggacgtaacgtacggtgggtaagtacgggtaccgtccgttcggggtaccggttggggttaaccgtttcggttaccggtttaaccggggtacccgggttaccgggggttaacccgtaaacggggtttaccccggaaaccccggtttccggtttaaaccgggtacccgtaaccggggtaacccccgtaccgggtaaaacccccctaaacccccggttaccggttacccgttaacccccgg

SEQ ID NO: 223858 - DNA, 796 bp, Homo sapiens
  misc_feature: GYAE6OF02HEQZG.4.45.E01.1.454.CMB.1.raw
  modified_base (209)..(209): a, c, t, g, unknown or other
  misc_feature (209)..(209): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcacgccacctctagccgtcgtcgggacccccggnaggacgggtcaaccatcttcgttgttctaggtaagactaacctaccaaactactaacgtaaaactttattaactagtaataactcggtaacagactaacgttacccgacggaacccggacccccctaaaacttccctacgtacttactaaacgtaaagaaactaaacgtaccgaacggtaccgacccctacggtaccggggttccctacgtaaccgtacgttcgtcgtcggtacctacggtaaacggtccggacctaaccgtcgaaccgtcccttacccgtacgacccgtaataccgtacggggttaccgggtcccgttaccggggtacccggaagggtacgttacgggaacgggtccttaaggtaaacttttacgttaaccggtgtacggacgtaacgacggtgggtaactcggtaacccgggtccgtagggtaccggtttggggtacttccgggttccgttaccgggtaacccgtacggggtaacccgtaaccggttcccgtaaccccgggttacgttaaccgggaccaaccggtaaccccgaaaccggtaccccccgaaaacccttacggttacccgtaacccg

SEQ ID NO: 223859 - DNA, 812 bp, Homo sapiens
  misc_feature: GYAE6OF02IAXC8.4.45.E01.1.454.CMB.1.raw
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtcgcagggtcctgggtccagtctgtgctgactcagcccaccctcagcgtcgtcggggacccccgggnacggnggtccaccattcctctttcgttcgaggtaagcctaactacccaaactaattaccgtaaaactttatttaactagttaactacgttcggtaacacggctaaccgttccccgaacggaacccggacccccctaaaccttcccgtactaactactaagtaaacgtaaatacgtacgaacggcccgtacccgttacgggaccggggttcccctacggacccttactttcgtcgtcggtacccgtaacccgtaacgggtccccgacctaacccgttccacggtcccctccgtcgggcctacgtcgtacggtccggggtaccgtcccggggttacggaacgggtacgtacgggtaacggtccggttagttaaacgttttagttacccggttgggttccgaaccggttacgtacgggttacggggtacgtaaccggggtcccgtacggttcgggttacgggttcgggttacgtcggtttcccggttacccgggtaacggttaaccggggacccggtttaacggtaccccggttaacccggtttacccggacgttacccggaccgaacccggtaccggacccctaacccggtacgtcgtacccg

SEQ ID NO: 223860 - DNA, 848 bp, Homo sapiens
  misc_feature: GYAE6OF02GXD0J.4.45.E01.1.454.CMB.1.raw
  modified_base (207)..(207): a, c, t, g, unknown or other
  misc_feature (207)..(207): n is a, c, g, or t
tcagagcactgtagcacgaccggtgctcgatttagtgagtcagtaagggaaaggggcagcttcagctgtgctagagaagacaagattcaggacaatctccagcatggccggcttccctctcctcctcaccctcctcactcactgtgcagggtcctgggtccagtctgtgctgactcacgccaccctcagcgtcgtcgggaccccggnaggacggtcaccagtcctcgttgttctaggacgtacaacctcccaaatactaccgaaaacttattaagtgttaactaacgtcggttaacccaagtctaaccggttccccggtaaggaaaccccgggtacccccccaaaacgttccccttaccgacttacttaaacgtaaacggtaaacttaaactacacgggccggaccccttacggtaacggggttcccctacggtaacccgtagtttcctaccggttcgtcctacccgtaacggtccggacctaccgtcacgtcccttcccgtggacctagtaccgtggtccgggccgttcccgggtccgagggtataccggggtacgtaccgttgttaaacgttttattaccggtacgttaggtacccgtaacgggtacggtttacggggtaggtacgggttacccgggtacggttcggggtaaccggggtttcggttaaggtttccggttacccgggtttaccggggtaccgtttaacccgggggaaccgtttaaacccggggttaccccggtacccggtttaacccgggtttaccggggaacccgtaaacccgggttacccggaaaacccccgggtaccccctttaaaccccgggaacttttacccggggtaaccc

SEQ ID NO: 223861 - DNA, 822 bp, Homo sapiens
  misc_feature: GYAE6OF02JBF1Q.4.45.E01.1.454.CMB.1.raw
  modified_base (220)..(220): a, c, t, g, unknown or other
  misc_feature (220)..(220): n is a, c, g, or t
tcagagcactgtagcacgaccggtgctcgatttagtgagtcagtaagggaaaggggcagcttcagctgtgctagagaagacaggattcaggacaatctccagcatcggccggcttccctctcctcctccaccctcctcactcactgtgcgacgggtcctgggtcctagtctgtcgctgactcgacgcccacctgagcggttccgccgggggacccccggngtaacggacgggttcccaacctacgttcctttacgtttcggttaccgttagggaaacgacctaaacccgtaccgtaaacgtaaccttaaccggtaaaaactttaagtttaataacgtttaactaaccggttaccggtaaccgtacttaccgtaacggttaccccgaaacggttaaacccggacccccctaaaactccttaaccattaaccttaaagaaacgtaaacttaacgtaccgaacgggtcccgtcccgtaacggtccggggtaccccttaggaaacccgtttcttccgtacccggtgaaccctttacggaacggtcccgacttaacccggcaccggtccccttacggtagaccgtacgtacgtacggtacgggtccgtaccggtaccggtacgtacgtaggtacggtagtacccccccccccgttaagttacgttaacgtcgtacgacgtacgtagtaggtacgtacgcgacggtcgacggtacggtagtcggttcgttaccggtacggtacggtaccgtaaccggtaccgtaccggtaccgtaccggtacggaccggaccgtaacccggaacccgaacccgtaccgtaccgtaccg

SEQ ID NO: 223862 - DNA, 693 bp, Homo sapiens
  misc_feature: GYAE6OF02FVGCD.4.45.E01.1.454.CMB.1.raw
  modified_base (206)..(206): a, c, t, g, unknown or other
  misc_feature (206)..(206): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
tcagagcactgtagcacgaccggtgctcgatttagtgagtcagtaagggaaaggggcgagcttcagctgtgctagagaagacaggattcaggacaatctccagcatggccggcttccctctcctcctcaccctcctcactcactgtgcaggtcctgggtccagtctgtgctgactcagccaccctcagcgtctcgggacccccggnagacgggtcaccatctcttgttctggaacgcaactccaacatacgaaacttattatgtatactgtaccagcagttcccaggaaccgccccaaatccncatctataagaataacncaggccgccctgacggggtccctcgaccgtattcctctcggcctaccgaacggtcccggacctaacccgtccaccgtcccttaccccgtggaccctacgttccgacgggtcgggtccccgttcccgggtaccggagggacgttggacggtccttagtaacttttatttacggttgtcggaccgtaacgtggtacgggtaagtacggtaccgggtccgttcggggtcgggttacgggttagttccgggttaccggttaccggtaccgggtaccggggtaaccgtaacgggttaccaccccgggttaccggttacggttccgaaccggtaccccggaaaccggtacccccaaccccgttaccgtcggtaaccccg

SEQ ID NO: 223863 - DNA, 945 bp, Homo sapiens
  misc_feature: GYAE6OF02IYUBE.4.45.E01.1.454.CMB.1.raw
  modified_base (211)..(211): a, c, t, g, unknown or other
  misc_feature (211)..(211): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctccaccctcctcactcactgtgcagggtcctgggtccagtctgtgctgactcacgcccacctcagcgtccgtccggggaccccggnacggagggtccaccatcctcttgttctaggacgacaacctccaaacgtactaacgtaaactttaattagtagttaatacgtaggtaaccaggtactacgttacccgacgggtaaacccggacccctaaaccgtcctaccaacttactaaagtaaacgtaaacttaactccgaacggtcccggaccccgttacgggacccggggttccctaccgaaccggtttacttacccgttcggttacggtaccccgttaaccgtaacgggttacccccggacgtacccttaaccggacccttacccgttacccccgttggaacccctacggttaccggtacgggttaccccggggttaccggtacccccggggtagggtaaacgggttaacggttacgggaaccgggtcgtttaaacgggttaacgtttttaccgtttaaccgggtggggtttaaaccgtacccggttaaccggtaacggggtttaacgggttaccggtaccggggttaaaccggttcccgggttacggggtacggggttttaaccgggttacgtttaccgggttaacccgggttttacccgggtaccggggttaacccggggtaaaacccggtttaaccggggtaacccccgggtttaaccgggttaacccggtttaccgggttaaccgaaccccgggttaaaccccggaacccgggtaaccccccgtaaacccgtttacccgggttccgttaaccccgg

SEQ ID NO: 223864 - DNA, 817 bp, Homo sapiens
  misc_feature: GYAE6OF02JNJFJ.4.45.E01.1.454.CMB.1.raw
  modified_base (363)..(363): a, c, t, g, unknown or other
  misc_feature (363)..(363): n is a, c, g, or t
tcagagcactgtagcacgaccggtgctcgatttagtgagtcagtaagggaaaggggacgagcttcagctgtgctagagaagacaggattcaggacaatctccagcatggccggcttccctctcctcctccaccctcctcactcactgtgcagggtcctgggtccagtctgttgctgacctcacgccaccctcagccgtcgtccgggacccccgggcacggacgggtcacccattccttcttacgtttcgtaggaacgaccaaaccttcccaaacgtataccgtaaaactttattaagtgtaattactcggtaaccagccgtacgttaccccaacggaacccggacccccctaaaactccctanacgttacttaaagtaaacgaaacttaactcgacggtccggtaccccttacggtaaccgggggttcccctacggtaacccttaacgtttccttacgtccggtaccgtttacccgaaccgggttcccggtaccccacccgtttaccgacccggttcccctttaccccggtaccggtacccgtaccgttaccggtaccgggtttccggggtaccccgttaccccggggtaccggtacgggtacgttacggtacggtccgttacgtaacttttacgtttacgttggtcgtacgacggtagtagggtactcgggaccgttcggtggttcggttacgggtattccgttacggttaccggttaccggtaccggtaaccgtaaccggttaccgttaccggtcccggttaacggtaccgaccggtacccgaacccggaccctaacccggtacttacggtaccc

SEQ ID NO: 223865 - DNA, 892 bp, Homo sapiens
  misc_feature: GYAE6OF02JBK32.4.45.E01.1.454.CMB.1.raw
  modified_base (207)..(207): a, c, t, g, unknown or other
  misc_feature (207)..(207): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccacctcagcgtcgtcgggacccccgggnaggagggtcaccattcctcttcgttcgtaggaacgtaccaacctaccaaacactaccgtaaaactttattacgttacgttaactacgttacggtaacccagtacctaacgttaccccgacggaaccccggtacccccctaaaaacttccccttactaacttaccttaaaagtaaacgtaaacttaaacgttaccgaacggccccgggtaccctaccgggtaaaccgggggttccccttaacgggaacccgttaacgtttccgttccgtcggtaccctaccggtaaacggtcccggaccctaacccgtacgacccggtacccctttccccgagggtaccctaacggtccgtaacggggtccggggtacccgtcccgggtaccgggtaacgggtacgtacgggtaacggtccttaagggttaactttaacgtttaccgtacggtccggtacgtaaccgtaggttacggggaaccgttacgggtacccgggtaccgttcggggttacgggtttaggggttaccgtttaccgggtttcccgggttaccggtacccgggttaccgggtaacccgggtaaaccgggttaacccgttacccggggttacccgttaacggttaaccccggaaccggtaccccgaaaacccgggtacccccgtaaacccccgttaccggttaccgttaaccccg

SEQ ID NO: 223866 - DNA, 673 bp, Homo sapiens
  misc_feature: GYAE6OF02GII06.4.45.E01.1.454.CMB.1.raw
  modified_base (205)..(205): a, c, t, g, unknown or other
  misc_feature (205)..(205): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcacctcctcactcactgtgcaggtcctgggtccagtctgtgctgactcagccacctcagcgtcgtcggggacccccggnagtacgggtcaccatcctcttgtctggaagcaactcaacatcgaaacttntatgtatacgtgtacngctacgtccgagaccgaccccaatcctacatacagtaacgtaatactcgacgtccggacctggacggtcctagacctattctacgtcggctacctaaggtcccggactaccctcgacgtcccctccgcggtaccacgtccgtaaggtccggggccttcccgggtacgagggtacgtaggaccggtcttggtaaacgtttacttaccgagttcggacgtacgaccggttaggggtacttacgggaccggttccggttagtcggggttgtaacggttccgttaccgttaccggggtacctacgggggtaacccctaggggtacccctaccgggttcccttaggacccgtaaccggacccgttaaccggaacccccgtaaaccccggttgtacccggttaacccg

SEQ ID NO: 223867 - DNA, 819 bp, Homo sapiens
  misc_feature: GYAE6OF02GOK1F.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcgacgggtcctcgggtccagtctgtcgctgactcacgcctaccctcacgtccgtccgtccggggacccccgggcgaggacgggtccacctactccgttcgtttcgttcgtaggtaacgccaacctccaaacactaacgtaaactttattactagttaactacgttcggtaaccagtactacgttccccgaacgggtaaccccgaacccctaaaccgttcctacgtaacttaaccgtaaataaaacggtaacttaaacgtaccgacggtcccgggtaccctaccgggtaccggggttaccccgtacggtaccgtcttaccgtcgtcggtacctaacccggtacggccgtccctaaccgtccgaccgtcccgtaccgtccgactactacggtaggtaccgggtccgtcccgggttacggaacggtacgtacgggtacgtccgtaaggttactttacgttacgtcggtacgacggtaacagggttccgggtaacgtcgggtaaccggtccggttaggtacgggttcgggtacgtttcggttaccggttacccgggtaccgggtaccgggtaccgtaaccgggttaccggttaaccccgtacggttaccgggtaaccctacccgggtaaccccgaaccggttaacccccgaacccgttaccgtaactttacccccgg

SEQ ID NO: 223868 - DNA, 824 bp, Homo sapiens
  misc_feature: GYAE6OF02JVSLO.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttcctctcctcctccacctcctcactcactgtgctacgggtccgtgggtccagtctgtgctgtactctacgcctacctctcggtccgtccggtccggggacccccgggtacacggtacgggtccaaccgtacttcttccgttcgttacgtcgggaacgtacctaacctaccgtaactaacgtacgtaaacctttatacgttataacttcgtaccggtactagctaccgttaccgaacggaaccccggacccctaaacgtccctacgtacctactaaacgtaaacgaacttaactcgacggacccgtcccgtacggtaccggtcctagaccgttacttcgtcgtcgtacctacgtacggtccgactaccgtctacccgtccgtcctaccggtacctacgttcgaccgggtccgggttcccggtaccgggtacggtaacgggtcgcgtacgggtacgttgttaaccgttttagttcgttacgggtgacccggtaaggtacgggtttaggaaccgttccgggaccgggtttcgggtaccggtcgggttttaacggggtaccttttaggggttacccgttccgggtaacccgggttacggtaccggttaaaccgggttaccccggttacggtttccgggtaaccgggttaaccgaccccggttaacggaacccccgggtaccctaaccccgggtttacccgtcgttaaacccccgg

SEQ ID NO: 223869 - DNA, 715 bp, Homo sapiens
  misc_feature: GYAE6OF02FL4EI.4.45.E01.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctccaccctcctcactcactgtgcgacgggtcctgggtccagtcctgtcgctgactcagccacctcagcgtcgcgggaccccggnaggacggtcacntctcttgtcnggacncaactcaacntactaacttatatgtatcgtaggaccagtcacgttcccgaacggacccggacccctaaactccgtacgactactaactaagaacttaactcgaacggtccgcccgtacggtaccggggtccctacggaccgtacttcctcgtacggcctacgtaccggtccggtacctaccgtaccgtccgtccccgtacccgtcgggaccctacgttaccggtacgggttacgggtcccggttcccgggtaccggtacgggtacgttaccggacgggtaccttaggttaacgtttacgttacgtgtacgtacgtactacgggttaggaacgttcggaccggtcgtacggttcgggttggttcgtccggttccggttaccgggtaccggtacggtaaccggtaacgtacccggtaccggttaccgtacggtacccgaccgaacccgtaaccggacccctacccgttccgtacgtacccg

SEQ ID NO: 223870 - DNA, 802 bp, Homo sapiens
  misc_feature: GYAE6OF02I8DU8.4.45.E01.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
tcagagcactgtagcacgaccggtgctcgatttagtgagtcagtaagggaaaggggcagcttcagctgtgctagagaagacaggatttcaggacaatctccagcatggccggcttccctctcctcctccaccctcctcactcactgtgcagggtcctgggtccagtctggtgctcgactccagccaaccctnacgcgtccgtacggggaccccccgggnaggagggtccaccatctcgttgttcgaggaaccgcaaccgtccaactacgtacctaaacgtttacttaattgtaatactacggtaccacgacgtacgtccggaacggaacccggaccccctaaactccctcgtaactactaaacgtaacaaacttaacgtacgaacggtccggaccccgttaccggtaccggggttaacccctcgtaacccggtaactttcccggttacctaccggtcccgttaaccgtaaccggtacccgggccctaacccgtaccgtaacccgtcccctttacccggtcggtacccgtacgttaaccctacggggttaccggaccccgttaaccgtacccggtaaccggtacgggtacgttacggtacggttaccgttaaggttaaccgtttacgttaaccgttcggtacgaccggtaacgtacgggtacgggattcgggtacccgttagttcgggtaacggttcggttaacgtcggtttaccgtacggtaccgggtcggtaaccgtaacggtccgtacccggttcgtacgtaccgaccggtaaccgacccgtacccgacccgtctaccgg

SEQ ID NO: 223871 - DNA, 634 bp, Homo sapiens
  misc_feature: GYAE6OF02HRQ40.4.45.E01.1.454.CMB.1.raw
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctggtccagtctgtgctgactcagccaccctcagcgtctgggacccccggnagaggtcaccatctcttgtcnggaancactccaacatcgaaacttatatgtatacnggtacagcagttccaggaccgccccaaactcctcatctaataacgaataanctagcgcctacgagggtccngacctattctctggactcccgaagtccggtaccaccgtcacgtcctcccgtcggacccataccgaggtcgggtacccgtccgggtccggtaggtacgtcgggtcgtaggtaacgttacttacgttgtacgtccgtacgtacgttgggacgtaggtacgtccgtaggtccgtacggttagttcggtcttccggtaaccttcggggtacccggtaaggtcccgttacccggtaccgttacggttaacccgcgtaaccccgtaaccggtacccgtaacccccgtaaccgttcgtaccccggtaacc

SEQ ID NO: 223872 - DNA, 970 bp, Homo sapiens
  misc_feature: GYAE6OF02HLR77.4.45.E01.1.454.CMB.1.raw
  modified_base (220)..(220): a, c, t, g, unknown or other
  misc_feature (220)..(220): n is a, c, g, or t
tcagagcactgtagcacgaccggtgctcgatttagtgagtcagtaagggaaaggggcagcttcagctgtgctagagaagacaggattcaggacaatctccagcatggccggcttccctctccctcctcaccctcctcactcactgtgcacgggtccgtgggtccagtctgtgctgactcacgcccaccctcacggccgtccgtccggggaccccccgggnacggtagggtccacctattccttcgtttcggttcgtagggaacgacctaacctaccaaaacctacgtaaccgttaaaacttttaattttaacgttaacgttaacgttaaccgttacgggtaaacccgacggtaccgttaaccggtttaacccccgaaaccggggtaaccccccgtaaccccccaaaccttacccctacgtaacttaaccgttaaataaaacgtaaacttaaacgtaccgaacggcccgggtacccctaccggggtaaccggggttcccctaacggtacccgttacgttccgtaccggttacggtaccccgttaacccggtacccgggtacccggttaccctaacccgttacccgtaccggtaccccccttcccggttacccggaccttacggttacggtacccggggttccgggaccccgggtttcccgggaccggtagggtaaccggtacggtaacgggttcgttacgtttaaacttttacggttaccgtttacggtccgtaacggttaccggttacgggtacgggtaccgttacgggtacccgggttcggttacgggttaccgggtttaggggttacgttttaccggtttccggtaaccggggttacccggtacggggttaacccggtaaaccggtttcccgtaacccgggttacccggttaacggggttaccaaccccggggttaacccgtaaaccccgggttaaccccctacccggttacccgttccgtaaccccg

SEQ ID NO: 223873 - DNA, 744 bp, Homo sapiens
  misc_feature: GYAE6OF02JU4TF.4.45.E01.1.454.CMB.1.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
tcagagcactgtagcacgaccggtgctcgatttagtgagtcagtaagggaaaggggcagcttcagctgtgctagagaagacaggattcaggacaatctacagcatggccggcttccctctcctcctcaccctcctcactcactgtgcaggtcctgggtccagtctgtgctgactcagccaccctcagcgtcgtcgggacccccggnagacgggtcaccatcnctttgttctggaagcaacctccaacatacgtaaacttattatagtatactgtacagctacgtccgaaggacccgaccccaactcctacatctaataacgaataactacacgcgacctcggacgggtccacgtacctactcctagtcgcctaccgaacgtccgacacccgtacaccgtccctccgtcgccacttacgtacggtcggtcccgtccggtaccggagtcgtaggtcgtcgtagttactttacgttacgtcgtacgtaccgacgtaggttacgggtaacgttccgggtacccggttaccggttcgggttaaccgggttaggggtttaccggtttaccggggtttacccggttacccgggggtaaccgggttaccgggggttaaacccggttaaaccgggggttccccgttaaaccccggggtttaccgggtaacccgggttaccggaaccccggttaaccccggtaacccggtaaccccccgttaaaccccggtaccggttacccggtttaaccccg

SEQ ID NO: 223874 - DNA, 693 bp, Homo sapiens
  misc_feature: GYAE6OF02FHAD6.4.45.E01.1.454.CMB.1.raw
  modified_base (207)..(207): a, c, t, g, unknown or other
  misc_feature (207)..(207): n is a, c, g, or t
  modified_base (335)..(335): a, c, t, g, unknown or other
  misc_feature (335)..(335): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcagggtcctgggtccagtctgtgctgactcagccaccctcagcgtcgtcggggaccccggnaggacgggtcaccatctcttgttctggaagcaacctccaacatacgaaacttattatagtatacgttcggtaccagcacgttcccaaggaacccggaccccaaactcctacactctaataagaataancgagccgcctacgacggggtccctaggaccgtattcctcgtcggtcctaccgaacggtccggacctaacccgtcaccgccccgttcccgtcggaccctacgtcgacggtcgggaccgtcccgggtcggacggtagtcgggacggtcgttaggtaactttacgttactcggtcgtaccgaacgtaggtcgggagtacggaccgtaccgtggtacgggttggttaacgttcggttaccgttaccgggtaccgttacgggaacccgttaacgggtcccgtacccggttacccggtacggttacccgaaccggtacccccggaaaccggtaccccgaacccccgtacgttacccgtaacccg

SEQ ID NO: 223875 - DNA, 795 bp, Homo sapiens
  misc_feature: GYAE6OF02H2D9Z.4.45.E01.1.454.CMB.1.raw
tcagagcactgtagcacgaccggtgctcgatttagtgagtcagtaagggaagggcagcttcagctgtgctagagaagacacggattcaggacaatctccagcatggcggcttccgtctccgtctccacccttcctcactcactgtgcacgggtcctgggtcctagtcctgtgctgactcacgccacctgacgtcgtcgtcgggacccggcacggtacgggtccaccgtatcgtcttcgttcgtaggaagcctaacgtccgaactacgttacgtaaacttattatacgtacttacgtacggtaccagtacgtacgttcccgaaggaaccgacccctaacgtcctacgactacgtaagtaacgtaactaacgtcctacggtccgtaccgtacggaccggggttacctacggtaaccgtacttccgtacgtacggtccttaaccggaaccggtccggacgtaacccgtacgaccggttaccctacccggtcgggtaccctacgttccgaacgggtccgggtaccgttacccgggtccgtaaacgggtcgtacggacggtaaccgttataacgttttaacgttaacgtcggttacgacggtacgtacggtacgggacgttaacggtaccgggttccgacggtcggtttagggtaacgttccgggttaccggtttaccgggacccggtttaacggggaacccgtaaacggggtttcccgtaaccgggttacggttaccggtaccggtaccggtaacccggtaacccggtaaccctaacccggttacgtacgttaccccgg

SEQ ID NO: 223876 - DNA, 855 bp, Homo sapiens
  misc_feature: GYAE6OF02GR078.4.45.E01.1.454.CMB.1.raw
  modified_base (208)..(208): a, c, t, g, unknown or other
  misc_feature (208)..(208): n is a, c, g, or t
tcagagcactgtagcacgaccggtgctcgatttagtgagtcagtaagggaaaggggcagcttcagctgtgctagagaagacaggattcaggacaatctccagcatggccggcttccctctcctcctcaccctcctcactcactgtgcaggtcctgggtccagtctgtgctgactcacgccaccctcagtcgtcgtcgggacccccggnacgacgggccaccacttcgtcttgttcgtggaacgacaactaccaactactacgtaaaactttagttaatacgtaattaacgtaccggttaacacggtacgtaacgttaccccgaacgggtaaaccccggtacccccctaaaactcccgtacaagttacctaaataaaacggtaaactaaactacgtaaacggcccggacccctttacggaaccggggttaccctacggtaaacccgttacgttaacccttcgttcggtacccttaaccggtaacccggttccggacctaacccgttaccgaaccgggtacccctttccccgtcggtacccgtaattaacccggtacggggttcggggtacccccctttaccgggggtaacccgggtaaacgtacgggttaggaccggggttcctaggtttaaaaccgtttactttaccgtgggttacggtaccgtaacgttaacggttacggggtactaccgggtacccggtcgtcgggtttacggaagggttctttcgggtacccgttaccggtacggttaccgggtaacccggtaaggttacccggaaccggttacgtacggtaacccggaccggaaccccggtaacccggaaccccgtaaaccccgttccgtagttaaccccg

SEQ ID NO: 223877 - DNA, 813 bp, Homo sapiens
  misc_feature: GYAE6OF02FZP2Z.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctcctctcaccctcctcactcactgtgcagggtcctggtccagtctgtgctcgactcacgcccaccctcgacgcgtcgtccggggacccccggtgacggagggtccacccgtatccttcttgttcctaggaacgacaacctccaaacgactacgtaaaacttattagtgttaactaccgtacggtaaccctagccgtaaccgttccccgaacggggtaacccgtaacccccctaaactcccgtaccgacttacccgtaaataaagtaaaactaaacgtcgtacggtaccccggaccttaccgggaacggggtttccccacggtaacccgtaactttccgtccgtacggtaccctttaccgaaaccggttcccgggaacctaaaccccgttccggaaccggtaccccgttttccccgagggtacccctaacgttacccgtacgggtccgggtaccccggtccggtaccggtaacgggtcgtaacggacggtcgttacgttaattaacgtttacgttcgtagtcccggtaagtacggtcgggacgtaccggtacgtccgttagggcgggttaagttccggttcgttacccggttccgggtaacccgttcggaaccggtaacggttccgtacccggttacgtacccggtccgtaccggacccgttacccggacccctacccggttactaccgtacccg

SEQ ID NO: 223878 - DNA, 925 bp, Homo sapiens
  misc_feature: GYAE6OF02HI98B.4.45.E01.1.454.CMB.1.raw
tcagagcactgtagcacgaccggtgctcgatttagtgagtcagtaagggaaaggggcagcttcagctgtgctagagaagacaggattcaggacaatctccagcatggccggcttccctctccctctccaccctcctcacctcactcgtgcgacgggtccgtcgggtcccgagtcgtgtcgctgactcacgcccaccctcgacgcgtcgtccggggacccccgggcgacggacgggtccacctacttccgttctttcggttcgtaggaacgaccaaaacctcctaaaccgaactaccgttaaaactttaatttaacgttagtaacttaaccggtacgggtaacctacgtaccgtaaccgttccccgaaacgggtaaccccggacccccctaaacctccctaccactactaataaagtaacttaacgtacacggtacccgtacccgtaccggtaccggggttaccctacggtaccgtacgttaccgttacggccggtacctacccgtaacggttcccggacccgttaaccctccggtaacccgtcccccgttacccgtaccgggaccttaaccggtccggtacgggttacgggtccccgggttaacccggggttaccggaagggtacgttcggggaacggttccggttacggtttaactttaaccggtttaccggtaggttacccggtaaccggtaacgggttttaacgggacgggtttacgtaccgggggtaaccggttcccgggttaggggtaccggggttttaggtaaccgggtttcccggtttacccgggttacccggttacccgggtaaccggggtaacctaaccggggtcccggttaaacccggttaccggtaaccgggttaccgaccccggaaacccggtaccggtaaccccccgtaacccggttcggtacccttacccg

SEQ ID NO: 223879 - DNA, 843 bp, Homo sapiens
  misc_feature: GYAE6OF02H9AGG.4.45.E01.1.454.CMB.1.raw
  modified_base (117)..(117): a, c, t, g, unknown or other
  misc_feature (117)..(117): n is a, c, g, or t
tcagagcactgtagcacgaccggtgctcgattagtgagtcagtaagggaaagggcagcttcagctgtgctagagaagacaggattcaggacaatctccagcatggccggcttccctntcctcctcacccgtcctcactcactgtcgcgtacggtccgtggtccagtccgtggtcgacttgactcgacgccctaccgtcgacgtcgtcggtaccggggacccccggagacggtaacgggtcaaccggtacgttcttcgttagttccgaggtaacgcctaaactccgaaacacggttaactaaaccttattagtacggtactaacgtacggaacctaggtaccgtaacgttacccgaaacggtaacccggtacccccgtaaaccttaccgtactaacttaccgtaaactaaacggtaaactttaaaccgccgtaaacgggtcccgtacccgtacggtaccggggttacccgtagtaaacccgttcgttaccgtcgtacggtaccttcccggaaacgttccggcctaacctcgaaccgttcccgtaccgtacgggtacacgtccgtaacgggtccgggttcccggtaccgggtaccggacgggttacgtacgggtaccgtacggttacgttaaacgtttcggttaacgttcgggttaacggcggtaacggttaaggtcgggaacgtccgggtaaccgtacgtcggttaaccggtgttacggtccgttaccgggtacggtacccgtaacgggtacccgtacggtaacccggtacgttacccggtacgtaccggtaacccgacccggtaaccggtaaccccgacccgttaacgggtccttaacccggg

SEQ ID NO: 223880 - DNA, 780 bp, Homo sapiens
  misc_feature: GYAE6OF02FLT2D.4.45.E01.1.454.CMB.1.raw
  modified_base (217)..(217): a, c, t, g, unknown or other
  misc_feature (217)..(217): n is a, c, g, or t
  modified_base (466)..(466): a, c, t, g, unknown or other
  misc_feature (466)..(466): n is a, c, g, or t
tcagagcactgtagcacgaccggtgctcgatttagtgagtcagtaagggaaaggggcagcttcagctgtgctagagaagacagggattcaggacaatctccagcatggccggcttccctctcctcctcacccctcctcactcactgtgcagggtccgtgggtccagtctgtgctgactcacgcccaccctcagtcgtccggtccggggacccccggnaggacgggtccacccgacttccttcgttcgtcctaggaacgtccaacctacccgaactaagttaccgtaaaactttattacgtagttaataccgttcggtaacccaggtccgttacggttaccccgaacggtaacccgacccccccaaacgtcctacgtactactaataaacaataactacgacgtcccggcctacggtaccgggtcccaggtaccgtattcctcgtcgacctcctaacggtcccgacnccctcgtaccgcccctccgtaccgaccacgtcgtacggttccgggtccgtaccggggtccgaggcggtacggaggtacctaggttattaccgtttacggtacgtcggtaccgtacggtaaggttggggtactccggggtaaccgtccggttagggtccggggttaaggttacgttccggttaccggttacccggggtacggttaccggggtaaccgtaaccccgggtccttaaccccggggtacggttaacgaacccgggtacccggaacccgtacccgggaccccctaaacccggtaccgttccgtaacccgg

SEQ ID NO: 223881 - DNA, 534 bp, Homo sapiens
  misc_feature: GYAE6OF01CT7C6.48.30.C08.1.454.CMB.1.raw
  modified_base (429)..(429): a, c, t, g, unknown or other
  misc_feature (429)..(429): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcattccccagactttcagtctgtgactccaaaggagaaagtcaccatcacctgccgggccagccagagcattcgtggtagtttacactggtaccagacaagaaaccagatcagtcctaccaaagctcctcatcaaagtatgccttccgagtccatctcgtcggggtcccctgagttcagtgcagtgatcgtgggacagtactttccaccctcacatacaatacgcctaggaanctagaagatgactgaccaaccttattactgtacatcagtacttttagttacgtcgaccttcggaccgaaggacacgactggaactaattaaacgactgngntacg

SEQ ID NO: 223882 - DNA, 550 bp, Homo sapiens
  misc_feature: GYAE6OF01C1EWT.48.30.C08.1.454.CMB.1.raw
  modified_base (435)..(435): a, c, t, g, unknown or other
  misc_feature (435)..(435): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggcagccagagcattcgtggtagtttacactggtaccagcaagaaaccagactcagtcctaccaaagcctcctacatcaagtatgcttccgagtccatcctcgtccggggtccctcggacggttcaggtgcgaggtcggatcgtgggacagtacttccacccccacatacaatacgctaggaanctagaagatcgctcgactaaccttatactgtacattctagttactttagttacgtcgtaccgtcggaccgaacggacacgtcgtaggagtaacgtaaacgactagtcgctgtacc

SEQ ID NO: 223883 - DNA, 528 bp, Homo sapiens
  misc_feature: GYAE6OF01EUW4P.48.30.C08.1.454.CMB.1.raw
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctaccaaagctcctcatcaagtatgctcgatccatctcgtcgggtccctcgagttcagtgcagtgatcgtgggacagtattccaccctcaccatcaatagcctaggaancgtagaagntcgctgacctaaccttatactgtacatctagtacttttagttaccgtcgtaccttcgggactaagggacacgacgtaggaacgtacttaaacgatgtgctacg

SEQ ID NO: 223884 - DNA, 555 bp, Homo sapiens
  misc_feature: GYAE6OF01CZYR4.48.30.C08.1.454.CMB.1.raw
  modified_base (391)..(391): a, c, t, g, unknown or other
  misc_feature (391)..(391): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctgacggttcagtggcagtggatcgtgggacagtntttccaccctcacccatacaatacgcctaggaacgctagaagatgactgacctaaccttattactgtacattccagttactttttagttacgtccggtacctttcgggaccctaagggaccacgacgtagggagtaaacgttaaacgaacgtggtcggctacgg

SEQ ID NO: 223885 - DNA, 532 bp, Homo sapiens
  misc_feature: GYAE6OF01B935A.48.30.C08.1.454.CMB.1.raw
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
  modified_base (502)..(502): a, c, t, g, unknown or other
  misc_feature (502)..(502): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcattccccagtactttcagtctgtgactaccaaaggagaaagtcaccatcacctgccggccagccagagcattcgtggtagtttacactggtaccagcagaaaccagatcagtctaccaaagctcctcatacaagttatgtccttccgagtccatcctcgtcggggtcccctggtaggttcaggtgcaggtgatcgaggacagtactttccaccctcacatacaatcgcctaggaacnctagaangtgctcgactaactnttactgtcatcagttactttagttcgcgtacctcggacaaggaccncggactaggactaactaacgatgnggntcg

SEQ ID NO: 223886 - DNA, 572 bp, Homo sapiens
  misc_feature: GYAE6OF01BRVMG.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctcgaggttcagtggcaggtggatcgtgggacagtactttccaccctcaccatcaatagcctaggaagctagaagatgctgacctaaccttattactgtactattcaagttacttttaaggtttaccgtaccggtaccctttccgggaccgtaaaggggaccaacggtacgtagggaacgtaaacgttaaaaccggaacgttcggttgggctacg

SEQ ID NO: 223887 - DNA, 541 bp, Homo sapiens
  misc_feature: GYAE6OF01DXB17.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcgggtccctcgaggttcagtggcagtggatctgggacagatttccaccctcaccatcaatagcctggaagcgtgaagatgctgacaaccttattactgtcatcagttacttttagtttacgtccggtaccttcgggaccgtaagggactacgacgtgggaacgtaactttaaaacggacttaggtggctacgg

SEQ ID NO: 223888 - DNA, 538 bp, Homo sapiens
  misc_feature: GYAE6OF01C0Y4K.48.30.C08.1.454.CMB.1.raw
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
  modified_base (465)..(465): a, c, t, g, unknown or other
  misc_feature (465)..(465): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcggtggttagtttacactggtaccagcaagaaaccagatcagtctaccaaagcctcctacatcaagtatgccttcgagtccatcctcgtcgggtcccctggaggttcaggtgctaggtggatcgtgggacagtactttccaccctcacctatacaatacgcctaggaagctagaagntgctgaccaaccttntacgtntacatctagtacttttagtacgtccgtaccgttcggaccaagggcacgagtaggataataacgatggtgctcg

SEQ ID NO: 223889 - DNA, 545 bp, Homo sapiens
  misc_feature: GYAE6OF01CRZ3V.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgcccgggccagccagagcattcgtggtagtttacactggtaccagcagaaaccagatcagtctccaaagcctcctcatcaagtatgcttccgatccatctctcgggtcccctgaggttcaggtggcaggtggatcgtgggacagtactttccacccctcacccatcagcagcctgcagcctgaagatgttcgactaactttattactgtaccaacgtgtacttagtaccgtaaccctccgttaactcgtttggaccgacggggacctaagggtcgagactaccaaacgagtggtacgg

SEQ ID NO: 223890 - DNA, 548 bp, Homo sapiens
  misc_feature: GYAE6OF01CHGSF.48.30.C08.1.454.CMB.1.raw
  modified_base (439)..(439): a, c, t, g, unknown or other
  misc_feature (439)..(439): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggcagccagagcattcgtggtagtttacactggtaccagcagaaaccagatcagtctaccaagctcctcatcaagtatgctccgagtccatctcgtcgggtcccctcgtaggttcagtggcaggtggatcgtggggacagtactttccacccctcacccatacaatagccgtaggaacgctagaagtntgctgacctaaccttattactgtcatctagttacttttagttaccgtccggtaccttcggaccgaagggaccacggacgtaggacgtaacttaaacgatggtggtctcg

SEQ ID NO: 223891 - DNA, 567 bp, Homo sapiens
  misc_feature: GYAE6OF01B8W7N.48.30.C08.1.454.CMB.1.raw
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagacaagaaaccagatcagtcctaccaaagcctcctcatacaagtatgcttccgacgtccatctcgtcgggtcccctcggtaggttcagtggcagtggatcgtgggactagtacttccaccctcaccatcaatacgcctaggaacncgtagaagntcgctgacctaaccttattactgtacatcgtagttactttttacggtaccgtccggtaccgttcgggaccgtaaggggactacgtacgtaggaacgtaactttaaacggactggtgggctacg

SEQ ID NO: 223892 - DNA, 730 bp, Homo sapiens
  misc_feature: GYAE6OF01D2DO4.48.30.C08.1.454.CMB.1.raw
  modified_base (176)..(176): a, c, t, g, unknown or other
  misc_feature (176)..(176): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattggtttctgctgctctggtccagcctcagggtnaattgtgctgactcacttcccagtactttcagtctgtgactacgaaaggagaacgtcaccatccaccgtggccgggccacgccagacgcagtttcgtaggttacgtttaccacgttacggtaccagtaccaacggtaaaccagaactcgaacggtacctaccgtaaacgtcctacctactaatacgtaaagttcgtcgtaccttaccgacgttcctacgttccgtcggtccgggttacccctacggtacggttaccgaggttcgacgtaggtcggtacgttacggtcgggaactacgttacctttaccgacccgttacctaacccgtaagttaaccaacgttacggtaccgtagggaaacgtccgttaagtaaccgtaacgttcgacgttacggaacccttaacttaacgtttaccgttcgtaccgtaacgttccgtaaggttttacccgtttttaacgggttaccggttacccgtaccgtttacgggacctaaaggggtacctaacggtacgtaggtaaacgtaacgtttaaaccgacgttcggtcgcgtacg

SEQ ID NO: 223893 - DNA, 616 bp, Homo sapiens
  misc_feature: GYAE6OF01CWX7D.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcattccccagactttcagtctgtgactaccaaaggagaaagtcaaccatcacctgccggccagccagagctatcgtggtagtttacactggtaccagcaagaaaccagatcagtctaccaaagcctcctcatcaagtatgcttcgagtccatctcgtcgggtccctgaggtcagtgctaggtgactcgtggactagtacttccacccgtcaacctatacaagtacgcctagggaaacgctaggaagtactcgcctagaacctaaccttactttacgtcgtacctattaccgtagtttaaccgtttttaaggtttacccggaccggttacccgtttaccgggaacccggtaaaggggaccctaaaccggaggttaacgggaagttaaacgttaaaacggaaccgtttggacgggtctaacg

SEQ ID NO: 223894 - DNA, 562 bp, Homo sapiens
  misc_feature: GYAE6OF01E14Y5.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtcctaccaaagcctcctcatcaagtatgcttccgagtccatctcgtcgggtcccctgtacggttcagtggcagtggatcgtgggacagtatttccaccctcaccatacaatacgcctaggaacgctagaagatgcgtgacctaaccttattacctgtacatctagttacttttagttaccggtccggtaccttcgggaccgtaagggacaccggacgtaggaacgtaacgttaaacggaagttcggtggcctacgg

SEQ ID NO: 223895 - DNA, 547 bp, Homo sapiens
  misc_feature: GYAE6OF01BSFJ5.48.30.C08.1.454.CMB.1.raw
  modified_base (329)..(329): a, c, t, g, unknown or other
  misc_feature (329)..(329): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggtccagcctccaggggtgaaattgtgctgactcattccccagactttcagtctgtgactccaaaggagaaagtcaccatcacctgccgggccagccagagcattcgtggtagtttacactggtaccagcagaaaccagatcagtctaccaagcctcctcatcaagtntgcttccgagtccatctcgtcggggtcccctcgtacggttcagtggccaggtggacttcgtggggacaggtactttccaccccttcaccctaatccaatacgcctaggaacgctagaagatgctagcctaaccttattactgtcatcagtacttttaggttaccgtcgaccttcggacctaagggacacgcgtaggactaattaacgatggtgcgtcg

SEQ ID NO: 223896 - DNA, 508 bp, Homo sapiens
  misc_feature: GYAE6OF01AZDOK.48.30.C08.1.454.CMB.1.raw
  modified_base (483)..(483): a, c, t, g, unknown or other
  misc_feature (483)..(483): n is a, c, g, or t
tcagagtatacatacacgaccggtgctcgatttagtctgacgtcaaagggaaaggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccagagcattcgtggtagtttacactggtaccagcagaaaccagatcagtctccaaagctcctcatcaagtatgcttccgagtccatctctgggtcccctcgaggttcagtggcagtggatctgggacagatttcaccctcacccatcaatagcctggagctgaagatgctgcaacctattactgtcatcatacttttagttacgtcggaccttcggcctaagggacncgactggacgattaacgatgtgctg

SEQ ID NO: 223897 - DNA, 585 bp, Homo sapiens
  misc_feature: GYAE6OF01C5L0X.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtgtagtttacactggtaccagcagaaaccagatcagtcctaccaaagcctcctcatcaagtatgccttcgactccatctcgtcgggtcccctcgtaggttcagtcgcaggtggatcgtgggacagtactttccaccctacaccctataccaaatcggcctaggaacgtctagaatgtgcgtgacctaacctattacgtcgtactactacgtacgttacgttttacgttaccgttccggtaccgttaccgggaccgtaacgggtaccaacgtacggtaggtaacgtaacgttaaacgagtttcggagggtctaccgg

SEQ ID NO: 223898 - DNA, 569 bp, Homo sapiens
  misc_feature: GYAE6OF01BUO2J.48.30.C08.1.454.CMB.1.raw
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
  modified_base (441)..(441): a, c, t, g, unknown or other
  misc_feature (441)..(441): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattggttctgctgctctggttccagcctccagggtgaaattgtgctgactcacttccccagactttcagtctgtgactccaaaggagaaagtcaccatcacctgccggccagccagagcattcgtggtagtttacactggtaccagcaagaaaccagatcagtctaccaagcctccncatacaagtntgtccttccgagtccattctcgtccggggtcccctggtaggttcagtcggcaggtgatcgtgggactagtacttccaccctcaccatacaatcgcctaggaactcgtagaagntgactagacctaaccttattactgtactatactagttacgtttttagttaccggtccggtaaccgttccggaccgtaagggactaaccggtactagggaactaacgttaaacgacgtgtcggcgtacg

SEQ ID NO: 223899 - DNA, 590 bp, Homo sapiens
  misc_feature: GYAE6OF01ACMDA.48.30.C08.1.454.CMB.1.raw
  modified_base (331)..(331): a, c, t, g, unknown or other
  misc_feature (331)..(331): n is a, c, g, or t
  modified_base (447)..(447): a, c, t, g, unknown or other
  misc_feature (447)..(447): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcattccccagactttcagtctgtgactccaaaggagaaagtcaccatcacctgccgggcagccagagcagttcggtggtagtttacactggtaccagcagaaaccagatcagtctacaagcctcctcatcaagtntgcttcgagtccatcctcgtcggggtcccctggacggttcagtcggcgtaggtggatcgtagggactagtactttccaccctacacctataccaattcgcctaggaagctagaagntgcctagacctaacttatactgtactagtctacgttacgtttttacgtaccggttccggtaccgttcgggaccgtaaggggacctacgggaaccgtagggtaacgtaaaccgttaaacccgaagttacggtcggacgtaccgg

SEQ ID NO: 223900 - DNA, 590 bp, Homo sapiens
  misc_feature: GYAE6OF01CLHDF.48.30.C08.1.454.CMB.1.raw
  modified_base (449)..(449): a, c, t, g, unknown or other
  misc_feature (449)..(449): n is a, c, g, or t
tcagagtatacatacacgaccggtgctcgatttagtctgacgtcaaagggaaagggggtatcttaaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggcagccagagcattcgtggtagtttacactggtaccagcagaaaccagatcagtctaccaaagcctcctcatcaagtatgcttccgagtccattcctcgtcggggtcccctcggacggttcagtggcaggtggatcgtggggactagtactttccacccctcaaccctatacaaatcgcctaggaagtctagaagntgacctagcctaaaccttatttacctgttaccataccgtagttaactttttaggttacccgtcggttacccttccgggacctaaaggggacccaacggtacgtagggaacgtaactttaaaaccgattgggtggccgtacg

SEQ ID NO: 223901 - DNA, 714 bp, Homo sapiens
  misc_feature: GYAE6OF01BO9Z6.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagtactttcagtctgtgactaccaaaggagaaagtcaccatcacctgccgggccagccagagcattcggtggtagtttacacgtggtaccagacaagaaaccagactcagtcctaccgaaagcctcctcatacaagtactcgtccttaccgacgtccattccgtcggtccgggtcccctcggtacggttcgaggtcggacgtaggtggacgttcggtacggggaactacggttacctttcccgaaccccttacaaccctaataccgtaaagtaccggtcccgtaggaacgcgttaaggaaacgtacgttcggaccttacggtaaccctaaaccgtttactttaccgtagtaccttaacgttaccgttaacgtttaaccgttttttacggttaacccggttaccgggttaacccgtttaaccgggaaccgtaaacggggaccctaaccgggtacgtaacgggtaaacgttaaacgttaaaacggtacggttcggtaaccgggtctaacccgg

SEQ ID NO: 223902 - DNA, 573 bp, Homo sapiens
  misc_feature: GYAE6OF01D5NK7.48.30.C08.1.454.CMB.1.raw
  modified_base (383)..(383): a, c, t, g, unknown or other
  misc_feature (383)..(383): n is a, c, g, or t
  modified_base (457)..(457): a, c, t, g, unknown or other
  misc_feature (457)..(457): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcacttcccccagtactttcagtctgtgactaccaaaggagaaagtcaccatcacctgccggccagccagagctattcgtggtagtttacacgtggtaccagacaacgaaccagactcagtacctaccaaagtcctcctacatacaagtatcgtccttccgatccatctcgtcgggtccctggtagtcnggtgctaggtggatcggtgggactagtactttccaccctcaaccatacaagtcgcgtaggaacgtcgtagaagntgctcgacctaacttattacgtgtcatctagtttacttttacggttcgtaccggtaccttcgggaccgtaaggacctagacgtaggaacgtaacttaaacgagttggtcgtctacg

SEQ ID NO: 223903 - DNA, 757 bp, Homo sapiens
  misc_feature: GYAE6OF01C3JOT.48.30.C08.1.454.CMB.1.raw
  modified_base (229)..(229): a, c, t, g, unknown or other
  misc_feature (229)..(229): n is a, c, g, or t
  modified_base (271)..(271): a, c, t, g, unknown or other
  misc_feature (271)..(271): n is a, c, g, or t
  modified_base (463)..(463): a, c, t, g, unknown or other
  misc_feature (463)..(463): n is a, c, g, or t
tcagagtatacatacacgaccggtgctcgatttagtctgacgtcaaagggaaagggggggtatcttaaaaggaggttctttcgtcgtgggatgtggcagtgagcaaaactgacaagtcaacggcaggaagatcgttcgccattcacaactcattgggtttctgctgctctgggttccagcctccgaggggtgaacttgtgctgactcacttcccagacttcagtctgtnactaccaaggagaaagtcaccatcacctagccggcagccagnctattcggtgtattacactcggtaccagcagaaaccagactacacggtcctaccgaaagtcctacctacaataccgaagttctagaccttacggacttccatcgttcccgtcggggtcccctaggtacggttcgaacggtggactacggtggtactcgtagggaactacggtacgtttcccaaccccggtanaaccccttataccgtaaagtaccggtcccgttaagggtaaacgtccgtttagggaaaccgtcgttaacgggtccgttaggtaaaccccgtttaaaaccgtttacgtttaaccgtttaggtacccgttaagttacccggttaagggtttaacccggtttttttaacgggtttaacccgggtaccggtttacccggttcccgggtaaccggtaaacgggtaccgtaccggttaacggtagggtaacccttaaaccggttaaacccgtacgtttacgggccggtttccgtaccccgg

SEQ ID NO: 223904 - DNA, 560 bp, Homo sapiens
  misc_feature: GYAE6OF01E1MJE.48.30.C08.1.454.CMB.1.raw
  modified_base (181)..(181): a, c, t, g, unknown or other
  misc_feature (181)..(181): n is a, c, g, or t
  modified_base (230)..(230): a, c, t, g, unknown or other
  misc_feature (230)..(230): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (426)..(426): a, c, t, g, unknown or other
  misc_feature (426)..(426): n is a, c, g, or t
  modified_base (457)..(457): a, c, t, g, unknown or other
  misc_feature (457)..(457): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtnaaattgtgctgactcattccccagactttcagtctgtgatccaaagganaagtcaccatcacctgccggccagccagacgcattcgtggtagtttacactggtaccagcagaaaccngatcagtccncaagcctcctnatcaatatgctccgagtccatctcgtcgggtcccctggtagttcaggtgctaggtgatcgtgggacagtactttccaccctcaccataccaatacgccgtaggaacnctagaagatgctagcctaaccttattacgtnttcattctaagttacttttacgttaccgttaccgacccgtttcggaccctaagggaccacggtaacgtagggaacgtaacgttaaacggacttggtcgctacg

SEQ ID NO: 223905 - DNA, 545 bp, Homo sapiens
  misc_feature: GYAE6OF01DH6EX.48.30.C08.1.454.CMB.1.raw
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (458)..(458): a, c, t, g, unknown or other
  misc_feature (458)..(458): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggcagccagagcatcgtgtagtttacactggtaccagcagaaaccagatcagtcctaccaaagctcctcatcaagtatgcttccgacgtccatctcgtcggggtcccctggtacggttcagtggctaggtggatcgtagggactagtactttccacccctcacccatcaatacgcctaggaacnctagaagntgctgacctaacctnttacctgtacatcagtacttttagttaccgtccggtaccttcggaccaagggacacgacgtggaactattaaacggatggtgctacg

SEQ ID NO: 223906 - DNA, 607 bp, Homo sapiens
  misc_feature: GYAE6OF01CI50K.48.30.C08.1.454.CMB.1.raw
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaattgtgctgactcattccccagtactttcagtctgtgactccaaaggagaaagtcaccatcacctgccggcagccagagcagttcgtaggtagtttacactggtaccagcaagaaccagatcagtctaccaagcctccncatcaagtntgcttcgatccatctcgtcggtccctgtcgttcagtgcagtgatcgnggacagtactttccgaccctcacctatactaagtcgtccgtaggaacgtctagaagtatgtcctagacctaaccttatttacctgttcctaattaccgtaagtttaaccgtttttcggtttaaccggtacccggttacccggtttccggaacccggtaaggggaaccctaaccggtacgtagggtaaactaaaggttaaacccgtacggttacggtcgggtccgtacgg

SEQ ID NO: 223907 - DNA, 593 bp, Homo sapiens
  misc_feature: GYAE6OF01AWITQ.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgtcatcacaactcattgggtttctgctgctctgggttccagcctccaggggtgaaattgtgctgactcattccccagactttcagtctgtgactccaaaggagaagtcaccatcacctgccggccagccagagcattcgtggtagtttacactggtaccagcagaaaccagatcagtctacaaaagcctcctcatcaagtatgcttccgagtccatctcgtcggggtcccctcgtacggttcaggtggctaggtggagtcgtggggacagtactttccaccccttcaccctatacaaatacgccctaggaacgcctagaagtagtgcctacgacctaaccttagttactcgttacacttacctagttaccttttagtttaccggtccggttaacccgttccggacccgtaagggaccacggtactagggaacgtaacgttaaacggaattcggtggtcctaccgg

SEQ ID NO: 223908 - DNA, 587 bp, Homo sapiens
  misc_feature: GYAE6OF01CSNAA.48.30.C08.1.454.CMB.1.raw
  modified_base (330)..(330): a, c, t, g, unknown or other
  misc_feature (330)..(330): n is a, c, g, or t
  modified_base (391)..(391): a, c, t, g, unknown or other
  misc_feature (391)..(391): n is a, c, g, or t
  modified_base (463)..(463): a, c, t, g, unknown or other
  misc_feature (463)..(463): n is a, c, g, or t
  modified_base (578)..(578): a, c, t, g, unknown or other
  misc_feature (578)..(578): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcacttccccagtactttcagtctgtgactaccaaaggagaaagtcaccatcacctcgccggcagccagagctattcgtggtagttacacgtcgtaccagacaagaaaccagactcagtcctacaacgtcctccncagtacaagtatcgtcctcgacgtccattctcgtccgggtccctcggtcggtcagtcgcgngtggtactcgtcggactagtatttcccaccctcaccctattacaaatcgcccgtaggaacgtcgtagaagtntcgctacgactaaccgttattacctgactatactagttaactttttcgttaccgtccggttacccgttccggaccgtaaggaccgcgtaacgtgggactaaacgttacgagtcgnggtctaccg

SEQ ID NO: 223909 - DNA, 593 bp, Homo sapiens
  misc_feature: GYAE6OF01BR3VJ.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagtactttcagtctgtgactccaaaggagaaagtcaccatcactgccggcagccagagcattcgtggtagtttacactggtaccagcaagaaaccagatcagtctaccaaagctcctcatacaagtatgtccttccgacgtcatctcgtcggggtcccctggacgtttcgaagttcggacgagtggactcgtgggacagtaactttccaccctcaaccctatacaaatgaccttagggaatccgtaggaaacgtagtcggaccttgaaccctaacttactttaacgtacgtacctattacgtaagttacctttttaagttaccgtcggtacctttcggacctaaagggactacggaccttaggaacgtaataaacgtacgtgtgtctacg

SEQ ID NO: 223910 - DNA, 540 bp, Homo sapiens
  misc_feature: GYAE6OF01EZ1WF.48.30.C08.1.454.CMB.1.raw
  modified_base (382)..(382): a, c, t, g, unknown or other
  misc_feature (382)..(382): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcaagaaaccagatcagtctaccaaagctcctcatcaagtatgcttccgagtccatctcgtcgggtccctgaggttcagtgcagtggatcgngggacagtactttccaccctcacccatcaatacgcctaggaagctagaagatgctgactaacctattactgtacatcagttactttagttacgtccgtaccgttcggaccgtaagggacacgacgtaggaacgtaacttaaacgacgtggtggctacg

SEQ ID NO: 223911 - DNA, 610 bp, Homo sapiens
  misc_feature: GYAE6OF01AETIF.48.30.C08.1.454.CMB.1.raw
  modified_base (483)..(483): a, c, t, g, unknown or other
  misc_feature (483)..(483): n is a, c, g, or t
tcagagtatacatacacgaccggtgctcgatttagtctgacgtcaaagggaaagggggtatcttaaaagaggttctttctctgggatgtggcatgagtcaaaactgacaagtcaagggcaggaagatgttgccgatcacaactcattgggtttctgctgcctcgtgggttccagccctccgagggggtgaaattggtgctgactcacttccccagtactttcagtctgtgtactaccaaaggagaaacgtcaaccatccaccgtggccgggtccagccagacgcaagttcggtggtacgtttaccactaggtaccagcaagaaacccagactcgacgtcctaccgaaacggcctcctacatcgaagtactgcttccggatccatctcgtcggggtccctgacggttcagtcgacaggtcgatcgtagggacagtactttccaccgtcaacctactacaactacgcctaggaagtctagaagtntgcctgacctaactagttacgtgtacacgttacacgttacttttacggtacgtccggtaccttcgggaacccgtaagggtacctacggacgttaggactaaccgttaaacgacgtcggtgtcgtacg

SEQ ID NO: 223912 - DNA, 523 bp, Homo sapiens
  misc_feature: GYAE6OF01BZ8V0.48.30.C08.1.454.CMB.1.raw
  modified_base (429)..(429): a, c, t, g, unknown or other
  misc_feature (429)..(429): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggcagccagagcattcgtggtagtttacactggtaccagcagaaaccagatcagtctccaaagctcctcatcaagtatgcttccgagtccatctctcggggtcccctcgagttcagtggcagtggatcgtgggacaggtactttccaccctcaccatcaatcgcctggaagctagaagntgctgcaacctattactgtcatcagtacttttagttacgtcgtaccttcggaccaagggacacggactggaacgtattaaacgaatgtgctacg

SEQ ID NO: 223913 - DNA, 681 bp, Homo sapiens
  misc_feature: GYAE6OF01AK0XK.48.30.C08.1.454.CMB.1.raw
  modified_base (335)..(335): a, c, t, g, unknown or other
  misc_feature (335)..(335): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactaccaaaggagaaagtcaccatccacctgccgggccagccagagcattcgtaggtagtttacactggtaccagacagaaaccagatcagtcctaccaagcctcctcatcaagtntcgcttccgagtccattcgtcgtcgggtcccctgtacggttcagtcggcgtaggtggattcgtacggggactacggtactttacccaccccttacaaccctatactaaagttacgcccgttaagggaacgtccgtaggaacgtacgtgccgtaggaccctaaaccctttagttaacccgtacggttacctaacgttaccgttaacgtttaaccgtttttaacggttacccgggttaccggtaacccgtttccgggtaacccggaacggggtaaccctaccgggtaacgtacggggttaaactaaaccggtttaaacggaacgtttcggtacgggtccgttaaccgg

SEQ ID NO: 223914 - DNA, 562 bp, Homo sapiens
  misc_feature: GYAE6OF01EMFYD.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaacgtcaccatcacctgccggccagccagagcattcgtggtagtttacactggtaccagcaagaaaccagatcagtctaccaaagcctcctcatcaagtatcgcttccgagtccatctcgtcgggtcccctgtacgttcagtcggcaggtgatcgtgggacagtacttccgacccttcacctatcaatacgcctaggaacgtctaggaagtagtcgacttcgacctaaccttacttactcgtactatactagttacttttagttaccgtcgtacccgttcggacctaagggacacgacgtaggaacgtacttaaacgacgtgcgcgtacg

SEQ ID NO: 223915 - DNA, 550 bp, Homo sapiens
  misc_feature: GYAE6OF01AQEPS.48.30.C08.1.454.CMB.1.raw
  modified_base (437)..(437): a, c, t, g, unknown or other
  misc_feature (437)..(437): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctcgacggttcagtggcagtggatcgtggggacagtatttccacccctcacccatcaatagccctaggaagcgtagaagntgctgccaacctattactgtcatcagttacttttagttaccgtccggtacccttcgggacctaagggaccaccgtacgtagggaagtaacgttaaacgaactggtggcgtacg

SEQ ID NO: 223916 - DNA, 526 bp, Homo sapiens
  misc_feature: GYAE6OF01AZ2Z7.48.30.C08.1.454.CMB.1.raw
  modified_base (363)..(363): a, c, t, g, unknown or other
  misc_feature (363)..(363): n is a, c, g, or t
  modified_base (425)..(425): a, c, t, g, unknown or other
  misc_feature (425)..(425): n is a, c, g, or t
  modified_base (523)..(523): a, c, t, g, unknown or other
  misc_feature (523)..(523): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctaccaaagcctcctcatcaagtatgcttccgagtccatctcgtcgggtcccctgnggttcagtggcagtgatcgtgggacagtactttccacccctcaccatcaatcgctaggaacnctagaagactgctgccaacttattactgtcatcagttacttttagttaccgtcgtaccttcggacctaagggacacgatggacgtattaacgatgtgntcg

SEQ ID NO: 223917 - DNA, 589 bp, Homo sapiens
  misc_feature: GYAE6OF01APN8J.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagttacactggtaccagcagaaaccagatcagtcctaccaaagcctcctacatacaagtatgccttccgagtccatcctcgtcggggtcccctcgtaggttcagtggcgaggtggatcgtggacagtacttccaccctcaccatcaatacgcctaggaacgtctagaagagtacgcttacgacctaaaccttagttacctcgtacctatcctaagttaccgtttttagttaccggtccggtaccgttccgggaccgaaagggtaccacggacgtagggtaacgtaaacgttaaacgaccttaggtccggtctacgg

SEQ ID NO: 223918 - DNA, 539 bp, Homo sapiens
  misc_feature: GYAE6OF01CQ6MN.48.30.C08.1.454.CMB.1.raw
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (529)..(529): a, c, t, g, unknown or other
  misc_feature (529)..(529): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattggtttctgctgctctgggttccagcctccaggggtgaaattgtgctgactcattccccagactttcagtctgtgactccaaagganaaagtcaccatcaccgtgccggcagccagngcattcgtggtagtttacactggtaccagcagaaaccagatcagtctaccaaagcctcctcatacaagtatgccttcgagtccatctcgtcgggtccctgagtcagtgcngtgntcgnggangtacttcacctcaccatacaatagccgtaggaagcgtagaagtatgctcgacaaccttatactgtcatctagttactttagttacgtccgtaccgttcggaccgtaagggacacgtacgtaggaacgtaagtttaaacgattagggnggtctaccgg

SEQ ID NO: 223919 - DNA, 592 bp, Homo sapiens
  misc_feature: GYAE6OF01DX7R4.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctaccaagctcctcatacaagtatgcttccgagtccatctcgtcgggtcccctgtacgtcagtggcaggtgatcgtgggacagtactttccacccttcacctatacaaatacgccgtaggaacgctaggaagtatcgactgacctaaccttattacctgtactatactacgtttacgtttttacgttaccgttccgggtacccgtttaccgggacccgtaaaggggtaccaacggtaacgttagggaaacgtaaacgttaaaaccgacgttgggtcggtctacgg

SEQ ID NO: 223920 - DNA, 587 bp, Homo sapiens
  misc_feature: GYAE6OF01BW4PW.48.30.C08.1.454.CMB.1.raw
  modified_base (231)..(231): a, c, t, g, unknown or other
  misc_feature (231)..(231): n is a, c, g, or t
  modified_base (443)..(443): a, c, t, g, unknown or other
  misc_feature (443)..(443): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaagganaaagtcaccatcacctgccgggccagccagagcattcgtggtagtttacactggtaccagacagaaaccagatcagtcctaccaaagcctcctcatcaaagttatgccttccgagtccatctcgtcggggtcccctgaggttcagtgcaggtgatcgtagggacagtactttccgacccctcgaacccatacaaagtacgcctagggtaacncgtagaagtatgacctgacctaacctattactgtaccatctagttacttttacggttaccgtcggtacccgtttacggaccgtaaagggacctaaccggacgttagggaacgtaaacgttaaacggacgttcggtcggctaccg

SEQ ID NO: 223921 - DNA, 599 bp, Homo sapiens
  misc_feature: GYAE6OF01EOGGK.48.30.C08.1.454.CMB.1.raw
  modified_base (300)..(300): a, c, t, g, unknown or other
  misc_feature (300)..(300): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccngatcagtcaccaaagctcctcatcaagtatgcttccgagtccatctcgtcgggtcccctcgaggttcagtggcagtggatcgtgggacagtactttcaccctcacccatcaatacgccgtaggaacgcttagaagtatcgctacgacctaaaccgttattaccgtagtcctaattcctaagttaactttttaacggttaccggttacccggtaaccgtttccgggacccgtaaggggtaccaacggaaccgtagggaacggttaaacttaaacggtaaacgtggttacggcgtaaccgg

SEQ ID NO: 223922 - DNA, 652 bp, Homo sapiens
  misc_feature: GYAE6OF01B4OL2.48.30.C08.1.454.CMB.1.raw
  modified_base (319)..(319): a, c, t, g, unknown or other
  misc_feature (319)..(319): n is a, c, g, or t
  modified_base (383)..(383): a, c, t, g, unknown or other
  misc_feature (383)..(383): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggcagccagagcattcgtggtagtttacactggtaccagcagaaaccagatcagtctccaaagcctccncatcaagtatgcttccgagtccatctcgtcggggtcccctggacggtttcagtcggcaggtggntcgtgggactagtactttccgacccctcgaacctactacaaatacgtacccgtagggaagccttaggaaagacggttacaccgttacggaaccctaaaccctttaagtttacccgttagttaccaattccgtaacggtttaaccgttttttacggttaacccggttcccgggtaacccgtttccgggtacccggaaagggtacccaaaccggtaccgttaggaaacggttaacgttaaaaccggtaacgttcggtcgggtacctaccgg

SEQ ID NO: 223923 - DNA, 672 bp, Homo sapiens
  misc_feature: GYAE6OF01AHHJI.48.30.C08.1.454.CMB.1.raw
  modified_base (180)..(180): a, c, t, g, unknown or other
  misc_feature (180)..(180): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
tcagagtatacatacacgaccggtgctcgatttagtctgacgtcaaagggaaaggggtaagtcttaaagaggttcttctctggatgtggcatgagcaaaactgacaagtcaaggcacggaagatgttgccatcacaactcattgggtttctgctgctctggttccagcctccgaggggtnaaattgtgctgacctcacttccccagactttcagtctgtgacctaccaaaggagaaagtccaccatccacccgtagcccgggccagcccagtacgctagttcggtgttacgtttacgactggtacccagaccaagaaacccngacttccagttcctaccaaaggcctccnctatacgaagtatcgtactccgagtcctagtccgtcgtccgggtcccctggtagttacaggttcggcaaggttggacttcgggtacggtactagtaccttccgacccttacacctacgtacaacgttacgcgtacggacgtacgtagaacgtactagccgtaacgtacctaaaccgttacttacgtacgtactacgttacctacggttttacgttttaacggtaccgttaccggtaaccgttaccggaacccgtaaggacccttaccggaacgttaacgggaacgtaacgttaaacggtaaacgtcggtcggtccgtaaccg

SEQ ID NO: 223924 - DNA, 625 bp, Homo sapiens
  misc_feature: GYAE6OF01CSND8.48.30.C08.1.454.CMB.1.raw
  modified_base (334)..(334): a, c, t, g, unknown or other
  misc_feature (334)..(334): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcacttccccagtactttcagtctgtgactaccgaaaggagaaagtcaccatccacctcgccgggcacgccagagctagttcgtggtagtttacacgtggtaccagacaacgaaaccagatcagtcctaccaagctccncatacaagtatgccttcgacgtcatctcgtcgggtccctgtagtcagtgntaggtgagtcgngggactagtacttccacctcactatacaagtcgaccgtaggaacgtcgtagaagtacgtcgctacggaacccttaaaccgttactttacgtgttacctaagttacctacggtttaaccttttttacggttaaccggtccggttacccgtttaccgggacccgtaaacgggtactaaccgggtagtaacgggtaagttaaacttaaaacggtacttggacggtccgtacg

SEQ ID NO: 223925 - DNA, 666 bp, Homo sapiens
  misc_feature: GYAE6OF01BH3NM.48.30.C08.1.454.CMB.1.raw
  modified_base (317)..(317): a, c, t, g, unknown or other
  misc_feature (317)..(317): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgagggtgaaattgtgctgactcattccccagactttcagtctgtgactccaaaggagaaagtcaccatcacctgccgggccagccagagcagttcgtggttagtttacacgtggtaccagcaagaaccagatcagtctacaanctctcatacaagtatgtacttccgacgtccatcgtccgtcggggttcccctcggtacgttcgaggttcggacgaggttgacttcgtaggggactaggtactttccaaccccgttcaacacgtccaaaagttcgacccgtacgggaaagccgttaggaaagacttggacccttaacggaccttaaacccttagtttaacctcggtttaaccaactttaccgaagtttaaccgtttttacgtttaccggttacccgggtaaccgtttaccgggaacccgaaaggggttacccaacggttacgtagggaacgttaaacggtttaaccgaaacgttcggttacggctaaccgg

SEQ ID NO: 223926 - DNA, 572 bp, Homo sapiens
  misc_feature: GYAE6OF01DXEUY.48.30.C08.1.454.CMB.1.raw
  modified_base (442)..(442): a, c, t, g, unknown or other
  misc_feature (442)..(442): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcattccccagactttcagtctgtgactccaaaggagaaagtcaccatcacctgccggccagccagagcagttcgtggtagtttacactggtaccagcaacgaaaccagatcagtcctaccaaagcctcctcatacaagtatgctcgagtccatctcgtcgggtccctgacgtcagtgctagtgatcgtgggactagtactttccgacccctcaccctataccaatcgcctaggaacgctagaagtntcggctgaactaccttagttactgtctactctagttacttttacggttccgtaccggtaccgttcgggaccgaacgggtactaaccggtacgtaggtaaactaacgttaaacgattcggtggtctaccgg

SEQ ID NO: 223927 - DNA, 543 bp, Homo sapiens
  misc_feature: GYAE6OF01EV6Z5.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctcgaggttcagtggcaggtggatcgtgggacagtactttccgaccccttcacctatcaatacgcctggaacgctgaagattgctagcctaacctattacctgtcatcagttactttagttacgtccgtaccttcggaccgtaagggccacgactaggaagtaacttaaacgaacgtgtggctacg

SEQ ID NO: 223928 - DNA, 573 bp, Homo sapiens
  misc_feature: GYAE6OF01A49FQ.48.30.C08.1.454.CMB.1.raw
  modified_base (231)..(231): a, c, t, g, unknown or other
  misc_feature (231)..(231): n is a, c, g, or t
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaagganaaagtcaccatcacctgccgggccagccagagcattcgtggtagtttacactggtaccagcagaaaccagatcagtctaccaaagctcctcatcaagtatgcttccgagtccatctcgtcggggtcccctggagttcgagtggctaggtggatcgtagggacagtatttccaccctcaccatacaatacgcctaggacnctagaagatcgctagaccaaccttattactgtacnctacgtagtaccttttagttaccgtacggtacccgttcgggacctaagggaccaacgtacgtagggaacgtaaacgtttaaaccggaacgttcggtcggtcgtaccgg

SEQ ID NO: 223929 - DNA, 756 bp, Homo sapiens
  misc_feature: GYAE6OF01CBEO1.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcacttcccagactttcagtctgtcgactaccaaaggaagaaagtccaccactccaccgtcggcccgggccacgccgagacgctacgtttcggtaggttacgttttaacacgttacggtaaccgagaccaacgaaaccgagtatacacgtacctaccgaaacgtcctcctactatacaagtactcgtccttcgtacgtcctactcgtcggtccggggttccccgtcggtacggttcgaggtcggcgtaggtggtacgttcggtacggggactacggttaccttttaccccgaaccccttacccgaaccctaagttaccgtaaacgttaccgggacccgttaagggaaaccggtcgtaaaggaaacgtcgttaggtacccttaacgtaccccttaaaaccgtttatttaacccgttcgtaacttaacggttaccttaaggttttaaccctttttacgggttaaccgggttcccgtaaccgttcccgggaacggttaacgggacctaccggtaacgtagggtaacttaaaacggttaacggaacgttcgggtacgtcgtaacg

SEQ ID NO: 223930 - DNA, 1018 bp, Homo sapiens
  misc_feature: GYAE6OF01BQBB7.48.30.C08.1.454.CMB.1.raw
tcagagtatacatacacgaccggtgctcgatttagtctgacgtcaaagggaaggggtatcggttaaagaggttctttcgtactgggagtgtggcgaggtgagtcaaaacctgaacaagtcaacggctaggaagactgttgccagtcacaactcagtcgggtttctgcgtgacttcgtgggttaccgagcctcctaggggtgtaaattggtgtctcgactcacttccccgagtaccttttcggacgttcgtgttagtacgtacccaaaggtagaaaagttccaaccgaattccaaccgttggcccggggacctaagtccgaaggacggtacctaaccgtttacggttacgggttaaccgttttaacctaccgttacgggtttaacccccaagggttaccccgtaacggaaaaaccccccgtaggggaaaccttaccggaaccgggttacccctttaccccgaaaaaggttcccgtttccccgtacgtaacttaacccgtaaaaggtttaaccgttcggtaaccgttttaccccggaacggtttcccctaagtttccccttaaccgggtttaaccggggggttccccccctaagggttaaggggttttaacccaacggtttacgggtacctaagggttaccgggtaacgtttacccgttagggggaaccctaggtaaaccttttcccgaaccccgttccaaacccgtacctttacccaaaagttaccggtaccccgttaggggtaaaacgttcccgttaagggtaaaccgtttacgttacggtcccgttttaacggtaccgtaaacccggtttactttaacccgtacggttacctaaacgttcccgtaaaggttaaccgttttttagggttaaacccggttcgggtaacccccgggttttaccgggaacccgggttaaacgggtaacccgtaaccgggtttaaccgtaacggggaaaccggttaaaggtttaaaaaccccgtaaaccggtttcggggtaaccgggggtccgttaaacggg

SEQ ID NO: 223931 - DNA, 600 bp, Homo sapiens
  misc_feature: GYAE6OF01B7CL8.48.30.C08.1.454.CMB.1.raw
  modified_base (418)..(418): a, c, t, g, unknown or other
  misc_feature (418)..(418): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggcagccagagcagttcgtggtagtttacactggtaccagcaagaaaccagatcagtcctaccaagcctacctcatacaagtatgccttccgagtccatctcgtcggggtcccctcggacgttcaggtggctaggtggatcgtggggacagtactttccaccccttnaccctatacaagtacgcctaggaactcgtagaagatcgctacgacctaaccttatttacgtcgttacacttctaacgttacgtttttacggttaccgtaccggtacccttacgggacctaagggaaccgtacgtacggtacggaagtaacttaaacggaacgttcgggtacggtcgtaccgg

SEQ ID NO: 223932 - DNA, 846 bp, Homo sapiens
  misc_feature: GYAE6OF01CHEEW.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcacttccccagtactttcagtctgtcgactaccgaaaggaagaaagtcaaccatcacctggccgggcacgccagagctagttcgtaggttagtttacacgtggtaccagacaacgaaaccagactacgacgtacctaaccaaacgtcctacctacatacaagttactcgtaccttcgacgttccacttccgttccggtccggggttcccctcggtacggttcgtaacggttgacgtaggtggtactcggtacgggtactaaggttacctttacccaccccgttactaaccctaacgtaacctaaacgttaccggaccgttaacggggaactaccgtaaggtaaaccgtaacgttcgtaaccgtaacgtaacccgttaaaaccttttacgtttaacccgtacggtttaacccgttaaacgttaccggtttaaaccggtttttaaaccgttttttttaaaccggggttttaaccccggttacccggggtttaaaccccgttttaccccgggggtaaaccccgggtaaacgggggttaaccccgttaaaccggggttacccggttaaaagggggtaaacggttttaaaaacccggtttaaaacccgggttaacggttttccgggggttaaccgggtaacccggttaaacccggg

SEQ ID NO: 223933 - DNA, 594 bp, Homo sapiens
  misc_feature: GYAE6OF01CZZGO.48.30.C08.1.454.CMB.1.raw
  modified_base (477)..(477): a, c, t, g, unknown or other
  misc_feature (477)..(477): n is a, c, g, or t
  modified_base (504)..(504): a, c, t, g, unknown or other
  misc_feature (504)..(504): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccgcctccaggggtgaaattgtgctgactcattcccccagtactttcagtctgtgactccaaaggagaaagtcaccatcacctgccggccagccagagcattcgtggttagttacactggtaccagacagaaaccagatcacgtcctaccaaagcctcctcatacaaagttatcgtccttccgagtcccagttccttcgtccgggggtccccctggtacggtttccaggttcggctaggtcggtacttcgtagggacagtactttcccaccctacaccagtacaacgtacgaccgtaggaagcgtagaagtntcgacgtagactaaccttacttacgtntactactactagttactttagttaccgtaccgtccgttacggaccgtaggactacgtacgtacgaataagtaacgtagtgtcgctgtacc

SEQ ID NO: 223934 - DNA, 647 bp, Homo sapiens
  misc_feature: GYAE6OF01DPFTI.48.30.C08.1.454.CMB.1.raw
  modified_base (509)..(509): a, c, t, g, unknown or other
  misc_feature (509)..(509): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcaggggtgaattgtgctgactcacttccccagtactttcagtctgtgacctaccaaaggagaaagtcaccatccaccgtcgccgggccagccagagctattcgtggttagtttacactggtaaccagaccaagaaaccaggactcacgtaccaccaaacgtcctacctacactacaaagtctcgtccttaccgactcctactccgtcggtccgggtcccctcggtacggttcgtaggtcggactaggtcgtacgtacggtagggacgtaacgttacctttaccctaccctaccgacctactaactaaacgtcgaccgtaggacgtacgtaggaagtntacgtcctacgtaacctaaccttacgttactcgtactatacgttacgttacgttttacgttacgtaccggttacgtaccggaacgtaacggacgtacgacgtaggtaacgtaacgttaaacgtatacggtgcgtaccg

SEQ ID NO: 223935 - DNA, 690 bp, Homo sapiens
  misc_feature: GYAE6OF01DEZ8M.48.30.C08.1.454.CMB.1.raw
  modified_base (181)..(181): a, c, t, g, unknown or other
  misc_feature (181)..(181): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtnaattgtgctgactcacttccccagtactttcagtctgtgacctaccgaaaggagaagtccaccactccaccgtcggcccgggccacgaccagacgactacgtttcggtaggttagtttaccgacttcggtaccagaccgaacgaaacccaggtaacttacgacgttcctaccgaaacgtcctcctactactacgtaagttactcgtccgttaccgacgtccacttccgtccggttccggggtcccctaggtacggttcgaggtcggacgtaggttacggacttacgggtagggactaggttaccttccaaccccgttccaactactactaagtaccggtaccgtaggacgtacgtaggaactgtcgcgtacgtaacctaaccttacgttctgtacctagtacgtttacgttacgttttacggttaccggttacgggtacccctttacgggaaccgtacggaccgaccggtagtggaaacgttaattaaccggtatcggtcggtctacgg

SEQ ID NO: 223936 - DNA, 759 bp, Homo sapiens
  misc_feature: GYAE6OF01CTYVI.48.30.C08.1.454.CMB.1.raw
  modified_base (228)..(228): a, c, t, g, unknown or other
  misc_feature (228)..(228): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctcgtcgggttccagcctccgaggggtagaaattgtgctagtactcacttccccagtactttcagtctgtanactaccgaaaggaagaaacgtccaaccactccaccgtcggccgggcacgaccagacgacttagttcggtaggttactttaaccgacgtcggtaaccagacgaaacgtaaaccagtactacacgtacctaaccaaacgccttaccactatactaaagtctcgtccgttcgactacctacgttccgtcggtacccggtccctacggtacggttacacgggtcgacgtaggtcggtacgttccggtaggggtaactacgtttacgttaccccaaccctacctaacccgtacttaaacgtaaacgttcccggacgtaacgggtaacgtaccgtaaaggtaagtacgttacgggtacctaacggtaacccttaaccttttacggtaaccttcgtaaccttacttaacggtttaaccggttttacgttttaaccggtttacggaccccggttacgttaacccgggacgtaaacccgggacgtaacgaacggttaagggtaacttaaaccggttaactaggttcgaccgtcgtacccg

SEQ ID NO: 223937 - DNA, 579 bp, Homo sapiens
  misc_feature: GYAE6OF01ETZSF.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattcccccagactttcagtctgtgactccaaaggagaaagtcaccatcacctgccgggccagccagagcattcgtggtagtttacacgtggtaccagcaagaaaccagatcagtctaccaaagcctcctcatcaagtatgccttccgagtccatcgtcgtcggggtcccctcgacggttcagtcggcagtggatcgtaggggacaggtactttccacccctaccaccatacaagtacgccgtaggaacgctagaagtgcgtctacgactaaccgttattactgtcatcctaagttacgttttaggttaccgtccggtacccgttacggccgtaaagggaccaacggactaggaacgtaacttaaacggtactcggtgtctcgg

SEQ ID NO: 223938 - DNA, 601 bp, Homo sapiens
  misc_feature: GYAE6OF01EWPHN.48.30.C08.1.454.CMB.1.raw
  modified_base (398)..(398): a, c, t, g, unknown or other
  misc_feature (398)..(398): n is a, c, g, or t
  modified_base (446)..(446): a, c, t, g, unknown or other
  misc_feature (446)..(446): n is a, c, g, or t
tcagagtatacatacacgaccggtgctcgatttagtctgacgtcaaagggaaagggggtatcttaaaagaggttctttctctgggatgtggcatgagcaaaaactgacaagtcaaggcaggaagatgttgccatcacaactcattgggtttctgctgctctgggttccagcctccaggggtgaaattgtgctgactcattccccagactttcagtctgtgactaccaaaggagaaagtcaccatcacctgccgggccagccagagcattcgtggtagtttacactggtaccagcaagaaaccagatcagtcctaccaaagctcctcatcaagtatcgcttccgagtcccatcctcgtcggggtcccctcggtacggtcaggtggctaggtggtatcgngggacacgtactttccaccctccacctatacaatacgcctagggaacncgtagaagatcgctcgacctaaaccttacttactgtactatctaacgttacttttaacgtttaccggttccgtaaccgtttcgggacccgtaaaggggacctaacggtacgtagggtaaacgtaaacgttaaaccgaagttcggtggtccgtacg

SEQ ID NO: 223939 - DNA, 610 bp, Homo sapiens
  misc_feature: GYAE6OF01COBYX.48.30.C08.1.454.CMB.1.raw
  modified_base (260)..(260): a, c, t, g, unknown or other
  misc_feature (260)..(260): n is a, c, g, or t
  modified_base (500)..(500): a, c, t, g, unknown or other
  misc_feature (500)..(500): n is a, c, g, or t
  modified_base (526)..(526): a, c, t, g, unknown or other
  misc_feature (526)..(526): n is a, c, g, or t
  modified_base (603)..(603): a, c, t, g, unknown or other
  misc_feature (603)..(603): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcattccccagtactttcagtctgtgactacaaaggagaaagtcacatcactgccggcagccagngcagttcgtggttagtttacacgtggtaccagcaagaaaccagatcacgtcctaccaaacgcctcctactataccgaagttacgtcgtccttccgacgttccctacttccgtccggttaccggggttcccctggtaacgggttcgtagggtcgacggtaggtggtactcgggtacgggactacggttactttacccacccgtacacctatacgtaaactcgaccgtaggacgtctagagntgacctacgacctaacgttcttacgnttacatactagttacgtttagtccgtccgtacttcggaccgaggtacacggacgtaggacgtaagttaccgagtcgnggctccg

SEQ ID NO: 223940 - DNA, 601 bp, Homo sapiens
  misc_feature: GYAE6OF01B94VI.48.30.C08.1.454.CMB.1.raw
  modified_base (180)..(180): a, c, t, g, unknown or other
  misc_feature (180)..(180): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattggtttctgctgctctgggttccagcctcgaggggtnaaattgtgctgactcacttccccagtctttcagtctgtcgactaccaaaggagaaagtcaccatcaccgtggccgggccacgccagagactagttcgtggtaatttaccactcggtaccagacaaggaaaccagatacataccaccaaagctccanatacaagtntcgctcgatcatctcgtcggtccctggacgttcgagtcgacgtgtgatcgtaggatacgtactttcaccctacacactacaaactcgccttaggaactcgaggatactcgctacgtaacctaacctagttaacctgtactacttcgtaactttacgttttaccgttaccggtaccggttaccgtacggtaaccggtaaagggacaaccggttaagagtaaacgtaacttaaaccggtactaggtcggtcgtaaccg

SEQ ID NO: 223941 - DNA, 782 bp, Homo sapiens
  misc_feature: GYAE6OF01EOX7Y.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcgagggtgaattgtgctgactcacttcccagtactttcagtctgtgactaccgaaaggagaacgtacaccatccacctcggcccgggaccacgccgagacgacgtacgtttcggttaggttaacgttttaccacgtacggtaaccacgtacaacggaaaaccctaggaacttaccgtaacggttacctaaccgaaaacgtccctacccgtacaacttacgtaaagttactacgtacccttaccgtacgttaccacttccgttccggttccggggtaccccgttccggtaacgggtttccacgggtttcggacgtaacggttggacgttcggtagggtaacctaacggttactttaccccaccctacctaacctaactaacaaacgtaccgtccgtaaggggaactacggtaagaaccgtagttacgtacgttacgaaccttaaaccttctttaaccgtgttaccctagttacctttaaggtttacccggttttttaagttaccccggtacgggttacccgtttaacgggaccccggtaaaggacccggtaccgtaacgtaacgggaagttaaaccggttaaaccaacgggttctaggtcccgttaaacgg

SEQ ID NO: 223942 - DNA, 852 bp, Homo sapiens
  misc_feature: GYAE6OF01CAWBW.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcacttccccagtactttcagttctgtgactaccgaaaggagaaagtcaccatcacctcggccggcagccagagctagttcgtaggtagtttactacgtggtaaccagacgaagaaaccaggactcacgtacctaaccgaaacgccttcctacaacttacgtaaacgttactacggtaccttaccggacttacctacttccgtccggttaccggggttcccctacggtacgttacgtacgggttcggaccgtaggtcggacgttacggtacgggtaacgaacgttactttaccccgaccccttacaaccccttaaagtaccgtaaaacgtttaccggaccctttaaggggggaaactccgttaaaggggaaacgttacggttacggtaccgtaaccggttaaccccttaaaacccttttacgtttaaccgtacgtttaacctaacgtttaccgttaaacggttttaacccggttttttttaaaccggtttacccggggttaccccggggttaaccccgttttacccgggggtaaaacccggtaaaggggggttaaacccctacccgggggttaaaccgttacgggggttaaaaacgtttaaaaccggtttaaaacgggtaacccggttcggggttaaccgggtccgttaaaccccgg

SEQ ID NO: 223943 - DNA, 778 bp, Homo sapiens
  misc_feature: GYAE6OF01A5582.48.30.C08.1.454.CMB.1.raw
  modified_base (182)..(182): a, c, t, g, unknown or other
  misc_feature (182)..(182): n is a, c, g, or t
  modified_base (237)..(237): a, c, t, g, unknown or other
  misc_feature (237)..(237): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtnaattgtgctgacctcacttccccagtactttcagtctgtcgactaccgaaagganaacgtccaacctatccaccgtcggacccggccacgccagacgctagtttcggtaggttactttacgacgtacggtaccacgacgaacgaaaccgtagtactacgtacgtacctaaccaaacgtcctacctactactactaacggtactacgtccgttaccgtacgttacctacgttcccgtccggttacccggggtccccttacggtacggttaccgtacgggtcggtacgtaggtcggtacgttcggtacggactagttacctttaccacccttaccaaccgtactacgtaaacgtaccgaccgtaggaacgtaccgtaggaacgtcgtacgaccgttacgtaaccttaaccgtttaccgttacgttacgtacttaacgtttaccgttaacgttttaacccgtttttaacgggtttacccggtaccggttaacccggtttaccgggaacccggttaacgggaacccgtacgggttaaccggtaacggtaaacggtttaaaaccgttaacgggtacgtttcgggtcggttaccgtaaccgg

SEQ ID NO: 223944 - DNA, 568 bp, Homo sapiens
  misc_feature: GYAE6OF01CD6UV.48.30.C08.1.454.CMB.1.raw
tcagagtatacatacacgaccggtgctcgatttagtctgacgtcaaagggaaagggggtatcttaaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaaggagaaagtcaccatcacctgccgggccagccagagcattcgtggtagtttacactggtaccagcagaaaccagatcagtctccaaagctcctcatcaagtatgtcttccgagtccatctcgtcggggtcccctcggacggttcagtggctagtggatcgtagggacagtatttccacccttacaccatcaatcgcctaggaacgcgtagaacgtatcgcctagacctaaccttagttaccttagtactatctagtactttttacgttacgtccggtaccttcgggacctaagggacctacggacgtaggaacgtaacgttaaacgaagtgtggctacg

SEQ ID NO: 223945 - DNA, 679 bp, Homo sapiens
  misc_feature: GYAE6OF01DBDYU.48.30.C08.1.454.CMB.1.raw
  modified_base (182)..(182): a, c, t, g, unknown or other
  misc_feature (182)..(182): n is a, c, g, or t
  modified_base (655)..(655): a, c, t, g, unknown or other
  misc_feature (655)..(655): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtnaaattgtgctgactcacttccccagactttcagtctgtgactaccgaaaggagaaacgtcaccatccaccgtgccgggccagccagagcattcgtggtagtttacactggtaccagcaagaaaccagatcacgtcctaccaaagcctactcatacaaagtactcgccttccgagtcctactccgtcgtccggggtcccctggtacggttcaggtcggctaggtgggtactcggtagggactacggtactttaccaccccctacgaaccctagtacctaaacgtacggtcccgtagggaacgtcgtacgaaggtactcggtactacggtaacctaaccttacgttactcgtacttactaccgttaggttaaccgtttttaacgtttaccgggtcccggtacccgtttaccgggaaccggtaaacggggtaccctaacgggaaccgttacgggaaacggttaacgttaaaaccgnggttacggtcgggacgttacccgg

SEQ ID NO: 223946 - DNA, 819 bp, Homo sapiens
  misc_feature: GYAE6OF01D9ZR8.48.30.C08.1.454.CMB.1.raw
  modified_base (180)..(180): a, c, t, g, unknown or other
  misc_feature (180)..(180): n is a, c, g, or t
  modified_base (300)..(300): a, c, t, g, unknown or other
  misc_feature (300)..(300): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcaggggtnaaattgtgctgactcacttccccagtactttcagtctgtgacctaccaaaggagaaagtcaccatccacctggccgggaccagccgagagctagttcgtaggtagtttacacgtgtaccngacaagaaaccagctacacgtacctaccaacgtcctccgtactaagtcgtaaagtcttcgacctttccgaacgttccaagttccgtacccggttccggggtccccacggttaagggttccgaaggttcgggacgtagggttacggtacgttaccgggttaggggtaacctaacgggttaccttttaccccgaacccccgttaccctaaacccgtaaacgttaccctaaagtaacccgggtccgtaagggtaacggtaccgtaaggtaacgacgttacggaccgtaacgtaacccgtaaacccgttttacgttaaccgttacgttaaccttaacgttaacccgtttaaacggttttacgttttttaaaccggtttaacccggttacccgggttaaaccccgtttaccggggtaacccggaaaccggggttaaccggtacccgggtaaacggttaccgggtaaaacggtaaaaccgttttaaaacccggtaacgttcggttaaccgggtccgttaacccgg

SEQ ID NO: 223947 - DNA, 763 bp, Homo sapiens
  misc_feature: GYAE6OF01E4I5E.48.30.C08.1.454.CMB.1.raw
tcagagtatacatacacgaccggtgctcgatttagtctgacgtcaaagggaaagggggtatcttaaaagaggttctttctctgggatgtggcatgagcaaaaactgacaagtcaaggcaggaagatgttgccatcacaactcattgggtttctgctgctctgggttccagcctccgaggggtgaaattgtgctgactcacttccccagtactttcagtctgtgactaccgaaaggagaagtccaccatccacctcggccggccagccagacgcagttcgtggtagttacacgtggtaccagcaacgaaccagactacagtacctaccgaaacgtccttacctacaactacaaagtactcgtaccttaccggacgtccctaacttccgttaccggttcccgggggttacccccttacgggtacgggtttaccgtagggttacgggacgtaaggtcgggtacgttaccggtacgggggaaccctaacggttacctttttccccgaaaccccctcccgtaaaccctaacttaaccgtaagtaaccggtcccgttaagggaacgtaccgtaggaacgttactcggtaccttacgaacctttaaaccttaacttttaaccgtagttacctacttacgttaacggttttaaccgtttttaacggtttaccgggttaccgtaacccgttaccgggaaccgtaaacgggaacccgttaacggacgtaacggtaaacgtaaacgttaacgtaacgtcggttcggcctaccgg

SEQ ID NO: 223948 - DNA, 836 bp, Homo sapiens
  misc_feature: GYAE6OF01EZYSN.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaattgtgctgactcacttccccagactttcagtctgtgactaccgaaaggagaaagtcaccatcaccgtcgccgggccagccagagcagttcggtaggttagtttacacgtggtaccagcaagaaaccagatcagtccacctaaagcctcctacactacgtaagttacttcgtcccttaccgacgttccctacgttccgttccggttcccggggtccccttacgggtacggttaccgaagggttcggacgtaggtggtacgttcggttaggggtaaccaacgttaccgttttacccaccccgttaccaacccgtaactaaccgtaaagttaccggacccgttaaggggtaaaccgacgttaacgggtaaagtacggttaccggccgttaaccgaacccttaaaacccgtttaccgtttaccgttacgtaaccttaacgtttaccgttaaacggttttttaacccgttttttaaacggggttttaccccgggtttacccgggttaaaccccgttttacccggggggaaacccggttaaaacgggggtaacccctaaccggggttaaaccggttaacggggtaaaaacgtttaaaaccgggtttaaaaacccggttaccggtttacggggtttaaccgggtcccggttaaacccggg

SEQ ID NO: 223949 - DNA, 876 bp, Homo sapiens
  misc_feature: GYAE6OF01DDRRY.48.30.C08.1.454.CMB.1.raw
tcagagtatacatacacgaccggtgctcgatttagtctgacgtcaaagggaaagggggtatcttaaaaagaggttctttctctgggatgtggcatgagcaaaactgacaagtcaaggcaggaagatgttgccatcacaactcattgggtttctgctgctctggggttccagcctccaggggtgaaattgtgctgactcattccccagtacttcagtcttgtgactaccaaaggagaaagtcaccatccaccgtcggccggccacgccagacgctattcggtggttacgtttacacgtggtaacccagaccaacgaaaccagactacacgtactaccaaacgtccttaccctcactactaaagtctcggtccttccgacgtcctacttccgttccgtccggggttccccctggtacggttccgtaggtcgggtaccgtagggtaggtaacgttcgggtacggggtaaccgtaacggttacccgttttacccctacccccgttaacctaaaccccgtaacttaaccgaaaaccgttaccggtacccggttaaggggtaaaccgtaccgtagggtaaacggtgttaccggtacgttaccggtaaccctaaaccccgtttaagtttaaacccgttcgttaaaccgttaacgtttacccggtttaacggtttttaaacccggtttttttaaccgggtttaaaccccggttaccccgggggtttaacccccggtttaacccggggtaaaccccgggttaaaacggggtaacccgtaaaacccggggttaacccggttaaagggggtaaaaccggtttaaaacccgggtttaaaaaacccgggtacggttttaaaccgggttcggggtacccgttaacccggg

SEQ ID NO: 223950 - DNA, 606 bp, Homo sapiens
  misc_feature: GYAE6OF01C0CHW.48.30.C08.1.454.CMB.1.raw
  modified_base (136)..(136): a, c, t, g, unknown or other
  misc_feature (136)..(136): n is a, c, g, or t
  modified_base (357)..(357): a, c, t, g, unknown or other
  misc_feature (357)..(357): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcanaactcattgggtttctgctgctctgggttccagcctccgaggggtgaaattgtgctgactcattcccagtactttcagtctgtcgactaccgaaaggagaaagtcaccatccactcgccgggcctagccagacgactacttcggtaggttacgtttacaccgttggtaaccacgcaacgaaaccagactcgagtcctacaaagccttccatactacaagtntgtcctacgagtccagtcgtcgtcgggtccctggtacggtcaggtcggcaggtgctcggtcggacagtcttccactccactatacaagtacgcctaggactcgaggtanagtcgntacggacctaaccgttnttaccgtntactactacgttacgttacttttacggttaccgttccggtaccgtttacggaccggtaaggacgtaccgtacgtagggtaactacggttaaacagttacgtgcgtaacg

SEQ ID NO: 223951 - DNA, 571 bp, Homo sapiens
  misc_feature: GYAE6OF01BYUHM.48.30.C08.1.454.CMB.1.raw
  modified_base (436)..(436): a, c, t, g, unknown or other
  misc_feature (436)..(436): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagtactttcagtctgtgactccaaaggagaagtcaccatcacctgccggcagccagagcattcgtggtagtttacactggtaccagcagaaaccagatcagtcctacaaagctcctcatcaagtatgcttccgagtccatctcgtcgggtccctcgtagttcaggtggcagtggatcgtgggactagtactttccaccctcacctatcgaatacgcctaggaacgctagaagntgactgacctaactattacgtcgtacatacgtacttacgttttacggttacgtccggtacccgttacggacccgtaagggaccaacggtacgtagggtaacgtaaacgttaaacgacgttgtcgggtctaaccgg

SEQ ID NO: 223952 - DNA, 682 bp, Homo sapiens
  misc_feature: GYAE6OF01EM4OY.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctcgtgggttccagcctccaggggtgaaattgtgctgactcacttccccagtactttcagtctgtgactacgaaaggagaaagtcaccatcacctcggccgggccacgccagacgctagttcgtaggttagtttaccacgttggtaaccagcaacgaaaccagactcacgtcctaccaagcctctcatacaagtactcgtcttccgagtcccattccgtcggttccgggtcccctggtacgttcgacggtcggactaggtggtacttcggtacggggaactacgtacctttacccgaccccttacaaccctactacgtaaactccggaccgttagggaactcggtagaagtctcggtactacgaaccttaacccttagttactacgttacctaacttacgtaacgttttaccggttttacgtttacccggtaccggttacccgttacggacccggtaaaggggtacccaacgggtacgtaaggtaaccgttaaacttaaacggtacgttacgggtacgtcgtaccg

SEQ ID NO: 223953 - DNA, 676 bp, Homo sapiens
  misc_feature: GYAE6OF01BQBO8.48.30.C08.1.454.CMB.1.raw
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcaggggtgaaattgtgctgactcattccccagtactttcagtctgtgactccaaaggagaaagtcaccatcacctgccggccagccagagcattcgtggtatttacactggtaccagcagaaaccngatcagtcaccaagctcctcatcaagtntgcttccgagtccatctcgtcgggtcccctggtagttcagtggctaggtggatcgtagggactaggtactttcccgacccctacaacccagtacaaagtacgtccgttagggaacgtccgtaggaagacgttcgacccgtagaacctaaaccgttaatttaccgttagttacctaacgttaccgttaacgttttaaccgttttttaacggttttaccggtaccccgggttaacccgttttaccggggaacccgttaaacgggggtaccctaaaccggtaccggttaacggggtaaacgttaaaaccgtttaaaccggtaaaccggtttcggttacgggtacctaaccggg

SEQ ID NO: 223954 - DNA, 729 bp, Homo sapiens
  misc_feature: GYAE6OF01A1KGG.48.30.C08.1.454.CMB.1.raw
  modified_base (198)..(198): a, c, t, g, unknown or other
  misc_feature (198)..(198): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcntccccagactttcagtctgtcgactaccgaaaggagaacgtcaccatccacctcggccgggccagccagacgctagttcgtggttacgttacacgtacggtaccagacaacgaaaccagactcgacgtacctaccaaacgtccttacctactactacgtaacgttacgtcggtaccgttccgaccgttaccctaacgttccgtccggtccggggttccccgtacgggtacggttcgtacggtcggacgtacggtcggacgtcggtagggaactacggtacctttccgaacccctcgtaaaccctactactaaacgtacgcccgtaagggtacgtacctaggtaacagttccggaccgttaacggtacctaaaccctttagttaaccgttacgttactacgttaccgttaacgttttaaccgtttttaccgggtttaccgtaccgggttacccgttacgggtaaccgtaacgggactaccggtacgtacgggtaacgttaacgtaacggtaaccggttggtggtcctaacgg

SEQ ID NO: 223955 - DNA, 578 bp, Homo sapiens
  misc_feature: GYAE6OF01AWM9K.48.30.C08.1.454.CMB.1.raw
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgcccgggcagccagagcattcgtggtagtttacactggtaccagcagaaaccagatcagtctaccaaagctcctcatcaagtatgcttccgagtccatcctcgtcgggtcccctggacggttcaggtggctaggtggatcggtgggacagtactttccgacccttcacccatccaatacgcctaggaacnctagaagtntgcctgacctaaccttattacgtgtacctatactacgttacttttaaggttaccgtccgggtacccttcgggaccgtaaggggacctacggacgtagggaagtaacttaaacggacttgggtcgtcgtccgg

SEQ ID NO: 223956 - DNA, 715 bp, Homo sapiens
  misc_feature: GYAE6OF01BOKGC.48.30.C08.1.454.CMB.1.raw
  modified_base (494)..(494): a, c, t, g, unknown or other
  misc_feature (494)..(494): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcacttccccagtactttcagtctgtgactaccaaaggagaaagtccaccactcacctcggcccgggaccagccagagctattcgtggttacgtttacacgtggtaccagacaacgaaaccagatcacgtcctaccaacgcctacctcatactaagtactcgtccttaccgacgtccacgtcgtccgttccggggtcccctcggtacggttcgaggtcggacgtaggtcggtatcggtaggggtacagttactttacccgacccctacacccactaccaacgttacgaccgtagggaacncgtaagacgtatcggtaccgtacgaaccttaacccgttactttaccgttactccgtacttacgttaacggttttaaccgtttttaccgggtttaacccggtacccggttacccggtttaccgggaacccggtaaacccggggtaccaaacccgggttaacggtacgggtaaacgttaaacggtttaaacccgtaacgttcgggttccggtccgtaacccgg

SEQ ID NO: 223957 - DNA, 543 bp, Homo sapiens
  misc_feature: GYAE6OF01ECJAN.48.30.C08.1.454.CMB.1.raw
  modified_base (406)..(406): a, c, t, g, unknown or other
  misc_feature (406)..(406): n is a, c, g, or t
  modified_base (439)..(439): a, c, t, g, unknown or other
  misc_feature (439)..(439): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccagagcattcgtggtagtttacactggtaccagcagaaaccagatcagtctaccaaagctcctcatacaagtatgcttccgagtccatctcgtcgggtcccctgtacggttcagtggcaggtgatcgtgggacagtacttccacccctnacccatacaatcgcctagggaactctaggaagngtcgctgacctaacctattacgtgtcatctagttacttttagttacggtcgaccttcggactaagggcacggacgtggaacgtacgttaaacgatggtgctacg

SEQ ID NO: 223958 - DNA, 752 bp, Homo sapiens
  misc_feature: GYAE6OF01DCHFG.48.30.C08.1.454.CMB.1.raw
  modified_base (557)..(557): a, c, t, g, unknown or other
  misc_feature (557)..(557): n is a, c, g, or t
  modified_base (739)..(739): a, c, t, g, unknown or other
  misc_feature (739)..(739): n is a, c, g, or t
  modified_base (746)..(746): a, c, t, g, unknown or other
  misc_feature (746)..(746): n is a, c, g, or t
tcagagtatacatacacgaccggtgctcgatttagtctgacgtcaaaggggaaagggggtatcttaaaagaggttctttctctgggatgtggcatgagacaaaactgacaagtcaaggcaggaagatgttgccatcacaactcagtttggttctgctgctcgtcgggttccagcctccgaggggtataaagttgtgctgactctacttcccagtacttcgagttctgtagactacgaaaggagaaacgtcaacctactccgccgtacgggaccccgggaccacggaccgaaggtacgtacgtacggtttcggtaggttaacgtttaccacgttacggtaaccagaacaaacgaaacagactcgtaacgtcctaaccgaatccttaccatacgtacgtaacgtcgtacgtcctaccggtagttaccctacgttccgttccgggtcccgggttcccgtacgggttcgttacggtacgggtcggtccgtagggtcggtaacggttccggtaacgggtaccttacgttacctttaaccgacccctacgaaccctaacgtanaaccgttacggacccgtagggaactccgtaaaggtaacgtacttcgggtacctaccgtaaaccttaacctttacggttacctacgttaattacgttattaacggtttttaccgttttacggtaccgtaccgggtccttaacgggaccgaaggtcgagtacggtagaaacgttaacgtaacgngttcggngcgtac

SEQ ID NO: 223959 - DNA, 574 bp, Homo sapiens
  misc_feature: GYAE6OF01D18YG.48.30.C08.1.454.CMB.1.raw
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
tcagagtatacatacacgaccggtgctcgatttagtctgacgtcaaagggaaagggggtatcgttaaaagaggttctttctctggatgtggacatgagcaaaactgacaagtcaaggcaggaagatgttgccatcacaactcattggttctgctgctctggtccagcctaccagggtgaaattgtagctgactcattccccagactttcagtctgtgacctccaaagganaaagtcaccatcacctgccggcagccagacncagttcgtgtattacactggtaccagcagaaccagatcagtctacaaagcttaccncatanaacgtntcgcttcgagtccatctcgtcggtccctgagttcagtgcngtgatgngacagtcttacgacctacactanctaatcgctaggaacnctagacgtatcgctcgaactaaccgttattaccgtgttacactacgtacgttagtttttaccgttacgtacccgtacccgttacccggaaccgtaacgggaccgtaacgtacggtacgaacggtaactttaaaaccggtacgtaggtcgcgttaacccgg

SEQ ID NO: 223960 - DNA, 550 bp, Homo sapiens
  misc_feature: GYAE6OF01DCYX3.48.30.C08.1.454.CMB.1.raw
  modified_base (233)..(233): a, c, t, g, unknown or other
  misc_feature (233)..(233): n is a, c, g, or t
  modified_base (298)..(298): a, c, t, g, unknown or other
  misc_feature (298)..(298): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (454)..(454): a, c, t, g, unknown or other
  misc_feature (454)..(454): n is a, c, g, or t
  modified_base (535)..(535): a, c, t, g, unknown or other
  misc_feature (535)..(535): n is a, c, g, or t
tcagagtatacatacacgaccggtgctcgatttagtctgacgtcaaagggaaagggggtatcttaaaagaggttctttctctgggatgtggccatgagcaaaactgacaagtcaaggcaggaagattgttgccatcacaactcattggtttctgctgctctgggttccagcctccagggtgaaattgtgctgactcacttccccagtactttcagtctgtgactccaaagganaaagtcaccatcacctgccggcagcagagcatcgtgtagtttacactgtaccagcagaaccagancagtctccaaagctcctcagtcaagtatgcttcgatccatctcgtcgggtcccctggacggttcagtcggcaggtgtacgtgtggacagacttcaccctcaccntactaanacgctacggancgtagagactgctcgaccaactacttactgtacnttatacttaacttttacgtttaccgtcggtaccgtacggtaccgaacggttaccacgacgtaggtaagtaacttaaaacgngtagtcggtcgtacg

SEQ ID NO: 223961 - DNA, 580 bp, Homo sapiens
  misc_feature: GYAE6OF01EHBVH.48.30.C08.1.454.CMB.1.raw
  modified_base (301)..(301): a, c, t, g, unknown or other
  misc_feature (301)..(301): n is a, c, g, or t
  modified_base (425)..(425): a, c, t, g, unknown or other
  misc_feature (425)..(425): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaaggagaaagtcaccatccacctgccggccagccagagcattccgtgtagtttacatggtaccagcaggaaaccngatcagtctccaaagctcctcatcaatatgcttccgagtccatctctcgggtcccctcgaggttcagtggccaggtggatcgtgggacagtactttcacccgtcaccatacaatacgctaggancgtagagatgactgacctaaccgttattacctgtactagttacgtacgttacgttttaagttaccgttaccggtaccctttacgggaccctaaggggacctaaccggacgttagggaaagttaaccttaaacggaagttggtcggtcgttacccg

SEQ ID NO: 223962 - DNA, 675 bp, Homo sapiens
  misc_feature: GYAE6OF01B00TU.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcacttccccagactttcagtctgtgactaccaaaggagaaagtcaccatccacctcggccgggccagccagagctattcggtaggtagtttacacgtcggtaccagacaacgaaacagactacagtcctaccaaacgcctcctacactacaagtacgtcgtcttccgactcctactcctcgtcgggtcccctcggtacggttcaggtcggcgtaggtgtagtcgtcgggaactagtactttccacccctacaacctaatctaaacgtcgacccgtaggaactcgtagaagtactgactacgtacctaaaccttagtttacctcggttactaacgttacgtacgtttaacgttttttaccgggttaaccggtcccggttaacccgttaccgggaaccggtaaacggggtacctaaccgggtaaccgttagggtaaaccgttaaacgtttaaaacggaaccgtttggtacgggtccgtaacg

SEQ ID NO: 223963 - DNA, 835 bp, Homo sapiens
  misc_feature: GYAE6OF01DGM3M.48.30.C08.1.454.CMB.1.raw
  modified_base (128)..(128): a, c, t, g, unknown or other
  misc_feature (128)..(128): n is a, c, g, or t
tcagagtatacatacacgaccggtgctcgatttagtctgacgtcaaagggaaaggggtatcttaaaagaggttctttctctgggatgtgcatgagacaaaactgacaagtcaaggcaggaagatgttnccatcacaactcagttggtttctgctgctcgtggttccacgcctcgagggtagtaaagttgtgctcgacttctaccttccctaagttacttcctagtctggtactaacctaaccgaaaaggaaacgtaaacgtccaacctactaccaccggttccggacccggaccaccgaccgaaggacgtactacgtttccggttagtttaacgtttaactacgttacggtaaccgacgaacgaaacgaaccgaagtacaccgtacgtaccctaaccgaaaccgtcccttctactaacttacgtaaacgttacgtaccgttaccgttaccgtaacctcctaaccgttccgtttaccggttccccgggttccccgttaacggttaaccggttcgtaacgggtcggacgtaggtacggttagtaccggggtacgtaacgttaaccgttccttttaacccgaccccgtaccgtaaccttactaaacgtacgtaacccgtacgtaacggtaacgtagtaacgtacgtacgtcgtactaccggtaaacttaaccgtttaactacgttagaccttaacgttacgttttacgttttaaccgttttaccggtttaccgaccccggtttactaacccgggtaacggaaccgggtaacccaaggttaacgttaacggaaacgttttaaccctaaaagggtccgtttaacggtcgcgttaaacccg

SEQ ID NO: 223964 - DNA, 830 bp, Homo sapiens
  misc_feature: GYAE6OF01BR647.48.30.C08.1.454.CMB.1.raw
  modified_base (183)..(183): a, c, t, g, unknown or other
  misc_feature (183)..(183): n is a, c, g, or t
  modified_base (189)..(189): a, c, t, g, unknown or other
  misc_feature (189)..(189): n is a, c, g, or t
tcagagtatacatacacgaccggtgctcgatttagtctgacgtcaaagggaaagggggtatcttaaaagaggttctttctctgggatgtggcatgagacaaaactgacaagtcaaggcaggaagatgttgccatcaacaactcattgggttctgctgctcgtggttccagcctcgaggggtanaattgngctgactctacttcccagtactttcgagtctgtacgaactaccgaaaaggagaaagtccaaccgtactccgacccgtcgggaccccgggccacgaccgaaggtacgtaccgtacgtttcggttaacgggttaacgtttaaccacggttacggttaccccaggaccgaaagaaacccgagtacgtacgacgtaccaccaaacgtccctacctactaagtacgtaaaaggttctccggtacccttacggaaccgttaccgtacgttccgttacccgggtcccggggttacccccttgggtaacgggttcacgggttacggagttaccggtaggtacgtacgggtagggtacgtacgttacttacccctacccgtacaacctagtaacctaacgtaccgtacgtaacggtaacgacgttacgaaggtactaggtaccgtaacgtaacccttaaacgttcgttaaccgtagttacctaacgttcgtttaacggtttaacctttttacggtacccggtttaccgggttaacccggttaacccggggtaccggtaaaacgggacccttaacggggtaccgttaaaccgggttaaacgtaaaccggttttaaacccggaagttttccggggtaggttacccggtaacg

SEQ ID NO: 223965 - DNA, 584 bp, Homo sapiens
  misc_feature: GYAE6OF01A9P76.48.30.C08.1.454.CMB.1.raw
  modified_base (181)..(181): a, c, t, g, unknown or other
  misc_feature (181)..(181): n is a, c, g, or t
  modified_base (290)..(290): a, c, t, g, unknown or other
  misc_feature (290)..(290): n is a, c, g, or t
  modified_base (328)..(328): a, c, t, g, unknown or other
  misc_feature (328)..(328): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccagtcacaactcattgggtttctgctgctctgggttccagcctccagggtnaaattgtgctgactcattcccagactttcagtctgtgactccaaaggagaaagtcaccatcacctgccgggccacgccagagcattcgtggtagtttacactggtaccngcagaaaccagatcagtctcaaagctcctcatcaagtntagccttcgagtccatctcgtccgggtcccctgtacgttcagtcgctagtggattccgtgggactagtactttaccaccctcaacccatcaatacgcctaggaacgcctagaagtatcgctagacctaaccttagttactgtactactacgtagtttaccgttttagttaccgtccggtaccctttacgggaccgtaaggacctacggtacgtaggaacgttaaacgttaaaccggtaagttgtcgggtctaaccg

SEQ ID NO: 223966 - DNA, 896 bp, Homo sapiens
  misc_feature: GYAE6OF01ATQQX.48.30.C08.1.454.CMB.1.raw
  modified_base (179)..(179): a, c, t, g, unknown or other
  misc_feature (179)..(179): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcagggtnaattgtgctgactcacttccccagtactttcagtctgtgactacaaaggagaaagtcaccatccacctcggccggcagccagacgctatttcggtaggttagtttacacgttcggtaccagaccaagaaacccgagtatcagtcctaccgaaacgtcctcctacagtactaagtactcgtccttaccgacgtacctattccgtccggttccggggttccccctaggtacgggtttaccgacgggttcggaccgtaggttacgggtaacttccgggttacgggggaactaaggtttaaccctttttaccccgaacccccgttacctaaaccccttaacttaacccgaaaacggtttacccggtacccgttaacggggtaaaccgttaccggttaaggtaaaccgggtaacgttccggtaaccgtttaaccgaaacccggtttaaaccccttttaacggtttaaaccccgtttaccggttaaccgttaaaccgtttaccgtttaaacggttttttaaccccggttttttttaaacgggtttaacccccgggttaccccgggttttaaaccccggtttaccccggggtaaaacccggttaaaccggggggtaaacccgtacccgggttaaaccgggttaacgggttaaaaccggtttaaaaccggttaaaaccccggttaacggtttacccgggtttaacgggtccgttaaacccccggg

SEQ ID NO: 223967 - DNA, 825 bp, Homo sapiens
  misc_feature: GYAE6OF01D6117.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcgagggtagaaattgtgctgactcacttccccagtacttcagtctgtgactaccgaaaaggagaaacgtccaaccactccaccgtcggcccggggccagacccagacgacctagtttaccggttggttaacgtttaaccacgtacggtaacccaagacaaacggaaaaccagaacgtaccaacgttaccctaaccgaaaacgtccttccctactaactaccaaagttatcgtaccttaccggaacgttccctaacgttcccgtccggggttacccgggggtttacccccctttacggggtaacggttttaccgaaggggttccggtaccgttaaaggggtcggtaaacggttccgggttacggggaaccgtaacgttaaccctttacccaccccttacaaaccctaataacctaacgtaacggacccgttaagggaactaccggtaaggaagtacgttcgaccgttagtaaccctaaactttacttacttaccgttactaactttacgtaacgtttttaacggtttaacggtttaacccggtccggttaaacccgttaccgggaacccgttaaagggaacccgtacggttaacggtagggtaaaaccgttaaaacgtttaaaaccggaacgttgggtacggtacccgtaacgg

SEQ ID NO: 223968 - DNA, 1015 bp, Homo sapiens
  misc_feature: GYAE6OF01CEO5E.48.30.C08.1.454.CMB.1.raw
  modified_base (253)..(253): a, c, t, g, unknown or other
  misc_feature (253)..(253): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctctaggggtagaaattgtgctgtactcacttccccaagtactttcagtcctgtgactaccgaaaggaagaaacgtcaaccancaaccgtcggccgggccagccagagctaattcggtagtagtttacacgtgtaccagacaagaaaccagactacagtacctaaccgaaaagtccttacctactaagtaacctaaaagttctacgttccgtttaccggaacgttacccctaagtttcccgttaccgggttacccgggggttaccccccgtacggtttaacggggtttaccggtaacgggttacggggtaccggtaaaggggttaggggtaaccctttacggggtttaacggggaaacccggtaacgtttaaacccggttttacccccctaaaccccccggttaacccctaaaaaccccttaacgttaaacccgtaaaaaacgtttaccccgggtaccccgggttaaagggggtaaaccgacccggtttaaagggaaaaacgggttcgtttaaccgggttaccgttaaccgtaaaccccctttaaaaccggtttaacctttaaaccgtttttcgggaacctttaaaccgggttaacctttaaccggttttaaaccggtttttttttaaaaccgggtttaccccggtttaaaccccgggggttaaaccccggtttaacccgggaaaccccggggttaaaagggaaaccccccgggtttaaacgggtttaaaaccccgggaaaaggggggtttaaaaaacccgtttaaaaccccgggtttttaaaaaaaaccggggttaaccccgttttaagggggtaaccccggttaaaccgggtttaaccccggg

SEQ ID NO: 223969 - DNA, 752 bp, Homo sapiens
  misc_feature: GYAE6OF01DKRKI.48.30.C08.1.454.CMB.1.raw
  modified_base (182)..(182): a, c, t, g, unknown or other
  misc_feature (182)..(182): n is a, c, g, or t
  modified_base (387)..(387): a, c, t, g, unknown or other
  misc_feature (387)..(387): n is a, c, g, or t
tcagagtatacatacacgaccggtgctcgatttagtctgacgtcaaagggaaagggggtatacttaaaagaggttctttctctgggatgtggcatgagcaaaactgacaagtcaaggcaggaagatgttgccatcacaactcattgggttctgctgctcgtgggtccagcctccgaggggtntaaattgtgctgactcacttcccgagtactttcagtctgtagacctaccgaaaggtagaacgtcaccatacaccgtcggacccgggccacgaccgaagacgacgtacgttcggtaggtttaacgtttacacgttcggtaccagacaacgaaacctagacttacgacgtcctaaccgaacgtcctaccgtacaatacgtaaacgtntccggtaccttacgacgttcccaacttccgttaccgggtcccggggttcccctagggtacggttacgtagggtcggacgtaggttcggacttcgggtacgggaacctaaggttaccctttaccccaaccccccgacgtaacttaccgaaacgttaccggaccgtagggaacgtcgttaaggaagtcgtacgctacggtaacctaaacgtttcttaaccggttctacgtacttacttaacggttttacttttaaccggttaccgtaccgggtacccttacgggaaacccggtaaggtaccgtaaccggacgttaacgggtaacgttaaacgtttaacggacggtttggaccggttcacggtaaccc

SEQ ID NO: 223970 - DNA, 890 bp, Homo sapiens
  misc_feature: GYAE6OF01A915U.48.30.C08.1.454.CMB.1.raw
  modified_base (882)..(882): a, c, t, g, unknown or other
  misc_feature (882)..(882): n is a, c, g, or t
tcagagtatacatacacgaccggtgctcgatttagtctgacgtcaaaggggaaagggggtatcttaaaagaggttctttctctgggatgtggcatgagcaaaactgacaagtcaaggcaggaagatgttgccatcacaactcattgggtttctgctgctcgtcgggttccagccctccgaggggtagaaattgtgctgactcacttcccagtacttcagtctgtgactacgaaaggagaacgtcaccatccaccgtcggacccgggccacgccgagacgactacgtttcggttagggttaacgttttaaccgaccgttcggtaacccgaaggtaccaaaacggaaaaacccctaggtaacctaccgtaacggttcccctaaacccgtaaaacggtcccctttacccctaactaaaccgttaacctaaaaggttaccgttaccgggtacccctttacccggtaaccgttaccccgtacgtttccccgttccgggttaccccgggggttaccccccttagggttaccggttacggtaacgggttacggggaccgtaaggggttcggtaacggtttaccgggtaacgggggtaacctaacggtttaccctttccccgtaaccccctacctaaaccctaacttaaaccgtaaccgttacggtacccggtaagggtaacctacggtaacgtaaacgtcggttaccgtaccgtacgtaaaccctaacccgtttaattaccgtaaccgttaccttaaacgtccgttaaacgttttaccgtttttaaacggtttacccggtacccggtaccggtttaacccggaccggtaaagggtaccgtaaccggtagttaacgggaaagttaaccgttaaacggacgttggtaccgngtaccccg

SEQ ID NO: 223971 - DNA, 745 bp, Homo sapiens
  misc_feature: GYAE6OF01EAWF9.48.30.C08.1.454.CMB.1.raw
  modified_base (379)..(379): a, c, t, g, unknown or other
  misc_feature (379)..(379): n is a, c, g, or t
  modified_base (493)..(493): a, c, t, g, unknown or other
  misc_feature (493)..(493): n is a, c, g, or t
tcagagtatacatacacgaccggtgctcgatttagtctgacgtcaaagggaaagggggtatcttaaaagaggttctttctctgggatgtggcatgagacaaaactgacaagtcaaggcaggaagatgttgccatcaacaactcagtttgggtttctgctgcttcgttcgggttccacgtcctacgagggtataagttgtgctgactctaccttcccagtctttcagtctgtacgactaacgaaaaggacgtaactaccaacctactaccgaccgtccgggacccgggaccacggaccgaaggcgtacgttacgtttcggttaacggtttaacgttaccgtacggttaccggtaccaacgtaaccgaaccggtaaaaccngtactacccgtacggttaacccaaccgtaaccgtccttaccaactacgtaacgtaagtctcgtcctaccgtactacctacgtccgtcgggtcccggtaccgtaggttacgtagnggtacgtacggtaggtcgtagtcgggtagaacttacgttaccctaccccgaccgtacacgtaacgtacacggtacgtaccgtaggaacgtcgaaagtcgtcgtacgacctaccgtaactttaacttcgacgttcgtaacttacggttaacttagttttccgtttaaccgggtccgttaccggtacggtaccggaacggtaacgaccgtagtacgaaaggttactaacggttaactaggtcggtctagtaccg

SEQ ID NO: 223972 - DNA, 683 bp, Homo sapiens
  misc_feature: GYAE6OF01ENNIK.48.30.C08.1.454.CMB.1.raw
  modified_base (185)..(185): a, c, t, g, unknown or other
  misc_feature (185)..(185): n is a, c, g, or t
  modified_base (297)..(297): a, c, t, g, unknown or other
  misc_feature (297)..(297): n is a, c, g, or t
  modified_base (530)..(530): a, c, t, g, unknown or other
  misc_feature (530)..(530): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcatttgggtttctgctgcttcgtgggttccagcctccgaggggtnaattgtgctgactcacttcccagtacttcagtctgtgacctaccgaaaggagaacgtcaccactccaccgtcggcccgggccacgccagagctagttcgtggttacttaacnctaggtaccagcaagaaccagctacagtccaccaagcctacctataactacgtaagttgtaccgtccttaccgacgtaccctagttccgtacccgggttccggggtcccctacgggtaacggtttccgagggttacggacctaaggtcggtactcgggtaacgggactaagttaccctttaccgacccttacctaacccagtacaactcggaccgtaggtaacgccgtaaganagtcgactacgtaacctaccttatctactacactacgttacgtttaccgttttacggttaccgtacccggttaccgtttaacccgggacggtaacggtaccgtaggaaccgtagggaacgtaaccgttaaacgtagtcggtacgtcgtaaccg

SEQ ID NO: 223973 - DNA, 837 bp, Homo sapiens
  misc_feature: GYAE6OF01CS8G7.48.30.C08.1.454.CMB.1.raw
tcagagtatacatacacgaccggtgctcgatttagtctgacgtcaaagggaaagggggtatcttaaaaagaggttctttctctgggatgtggcatgagcaaaaactgacaagtcaaggcaggaagatgttgccatcacaactcattgggtttctgctgctctgggttccagcctccgaggggtgaaattgtgctgactcacttccccagtactttcagtctgtcgacctaccaaaggagaacgtcaccactccaccgtcggccggccacgaccagagctagttcggtaggttagtttaaccacgtaggtacccaagccgaacgaaacccgagaactaccacgtcctaaccgaaacgtcctcctactacgtactaaacggttctcgtaccgttacccgacggttaccctaacgttcccttcccgggtccggggttcccccgttagggttacggtttaccggtaagggtcggacgtaggtacgggtacttaccgggtagggtaacctacgtttaaccttcccctaaccccgtcccaaactacgttaaaccgtaaagttaccggacccgttaagggaaaccgtcggtaaggaaacggtacgttcgaacccgttaacgtaccccttaaaccttttaacggtttaccgttaactcgtaacctttaaccggtttaacggttttaaacccgtttttttacccgggtttaaaccggttcccgggttaaccccgtacccgggttaaccccggggaaagttaaacccggccgggtaaacggttacgggaaaaccgtttacggtaaaaacccggttacggttacgggtccggtaaccggttaaccccg

SEQ ID NO: 223974 - DNA, 856 bp, Homo sapiens
  misc_feature: GYAE6OF01DHV57.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcatttgggtttctgctgctctgggttccagcctccgaggggtagtaattgtgctgactccacttccccagtactttcagtctgtcactaccgaaaggagaaacgtccaccatccaccgtcggccggccacgccaagacgtactagtttccggtaggtttaacgtttaccgtaacgttacggtaaccctaagaccaaacgtaaaccgacgtactacgacgttacctaccgaaacgtcccttacctcaactaccgtaaagttactcgtaccttccgtacgttaccctacttccgttcccggttccggggttcccccttacggttacggtttacgacggttcggacgtacggttaggtacgttaccgggtagggaaccgttacgttacccttttccccctaacccccttacccgaaccccttactaaccgttaaacgtaccggttacccgtaagggaaaccgttcggttaagtaaacgtgtcggttaaccgttaaccggaaccgtttaaaccctttaacgttttaaccgtcttaacccgttaacgtttacccgttacggttttttaaccgtttttaacgggttttacccgggtacccggttaacccggttacccggggtaaaccggaaaccggggttaccggtaaacccgtaacgggtaacggttaaacggttaaaccggttaaaaccgttcggtaaccgggttgcccggttaaacccg

SEQ ID NO: 223975 - DNA, 646 bp, Homo sapiens
  misc_feature: GYAE6OF01AM2W3.48.30.C08.1.454.CMB.1.raw
  modified_base (179)..(179): a, c, t, g, unknown or other
  misc_feature (179)..(179): n is a, c, g, or t
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattggtttctgctgctctggttccagcctccaggggtnaaattgtgctgactnacttccccagtactttcagtctgtgactacaaagganaagtcacactcacctgccggcagccagancattcgtggttattaccgactggtaccagacaacaaccagactacacgtctaccaaagtcctactacactactaagtactcgtccttacggactacccacttcgttccgtccggggttaccccctagggtaacgttcggaacggtcggactaaggtgacttcggtaggactagtcttccacccgtcacatactaagtcgacgttgaacacgtcgaagtagtgctacgaacctaacctttgtaaccgtttcgaacctacgttacgtaccgtttaacgtttaccgttacccgtcccgggttaaccgtccggaacccgtaacggtccgaacggtaacccggtagtaaaccgttaagtaaaccggtaaccgttggtacgtcgtaacccgg

SEQ ID NO: 223976 - DNA, 761 bp, Homo sapiens
  misc_feature: GYAE6OF01BFDTX.48.30.C08.1.454.CMB.1.raw
  modified_base (185)..(185): a, c, t, g, unknown or other
  misc_feature (185)..(185): n is a, c, g, or t
  modified_base (725)..(725): a, c, t, g, unknown or other
  misc_feature (725)..(725): n is a, c, g, or t
  modified_base (747)..(747): a, c, t, g, unknown or other
  misc_feature (747)..(747): n is a, c, g, or t
  modified_base (754)..(754): a, c, t, g, unknown or other
  misc_feature (754)..(754): n is a, c, g, or t
tcagagtatacatacacgaccggtgctcgatttagtctgacgtcaaagggaaagggggtatcttaaaagaggttctttctctgggatgtggcatgagacaaaactgacaagtcaaggcaggaagatgttgccatcacaactcattgggtttctgctgctcgtcgggttccagcctccgaggggtntaacttgtgctgacctcacttccccagtactttcacgttctgtacgacctaccgaaaggacgtaaacgtccaacctacttaccaccgtcgggacccggacacggaccgtagacgtacgtacgtttcggtacgttacgttacctacgtacggtaaccacggacaacggaaacctagtactacgacgtacctaccgtaacgtcctcctacactactaacgtctacgtaccgttaccgacgtacctacgttccgtccggtcccgggttccctaggttacggtacgagggtcgtacgtacggttaggtacgttacgtacgggtactacgtttccttacccgacccttaactaccgaacgttaaccgtaaacggttccggtaaccgggtaaggtaaccggttacgtaacgggtaaatcccgttagggtaccctaaacggtaccctttaaaaccgttttcgacgttacgttaccttaagtacggtttaacgtttccgtttaccgggtaacgtcccgttaacgtacgggaacgtacgacggtaacgngaaccgttaagtacccgttaanggtacgntcggtac

SEQ ID NO: 223977 - DNA, 872 bp, Homo sapiens
  misc_feature: GYAE6OF01BY2BG.48.30.C08.1.454.CMB.1.raw
  modified_base (274)..(274): a, c, t, g, unknown or other
  misc_feature (274)..(274): n is a, c, g, or t
  modified_base (320)..(320): a, c, t, g, unknown or other
  misc_feature (320)..(320): n is a, c, g, or t
tcagagtatacatacacgaccggtgctcgatttagtctgacgtcaaagggaaagggggtatcttaaaagaggttctttctcgtgggatgtggcatgagacaaaactgacaagtcaaggcaggaagatgttgccatcaacaactcatttgggtttctgctgctcgtgggttccagcctcgaggggtataattgtgctgactctacttcccagtctttcagtctgtagacctacgaaaggagaacgtcaccatccaccgtggccggcacgccaganctagttcggtggttacgttacacgtacgtaccagacgaacgaaacngactcgacgtaccctaaccgaaacgtccttaccctacgtaactaacgtaaacggttactcggttacccgtttaccggtaaccgttccctaacgtttccggttaccggggttaccccggggttccccctaacggggttacggtttacggaacggggttcgggacgttacggggttacggtacttacgggtacggggtaactacggttaaccgttttaccctaaccccccgtacaacccgtaataacccgtaagttaacccggtcggttaacgggaaacgtaccgttaggtaaacgtcgtacgggtaccgtaaccggtaaccctttaaaccgtttaacgtttaacccggttattaacccgttaacgtttaaccgtttaccgtttttaaaccggtttttaccgggtttaacccgggttaccccggttaaccggttaccccgggtaaacccgggtaaacggggttaacccggtaaacccgggtaaggtttaaacccgggtaaaagttaaaacccggttaaacggtaacggtttacggggtaccgtaggttaacccg

SEQ ID NO: 223978 - DNA, 915 bp, Homo sapiens
  misc_feature: GYAE6OF01DG1SR.48.30.C08.1.454.CMB.1.raw
  modified_base (711)..(711): a, c, t, g, unknown or other
  misc_feature (711)..(711): n is a, c, g, or t
  modified_base (903)..(903): a, c, t, g, unknown or other
  misc_feature (903)..(903): n is a, c, g, or t
tcagagtatacatacacgaccggtgctcgatttagtctgacgtcaaaggggaaagggggtatacttaaaagaggttctttctctgggatgtggcatgagacaaaactgacaagtcgaaggcaggaagtatgttgccatacaacaactctagtttgggtttctgctgtcttcgtcggttccacgtccgtacggaggggtataagttgtgtcgtagaccttactaccttaccccgagttaccgtttcgtacgttcgtaggtacgtaaccgtaaaccggaaaaggtaagtaacgtacctaaccttactacccgtaccggtccgggaccccggaccgaaccgaccgacggactacgttacgttacggttacggtttaacgttaccgacggtacgtaaccgaacgacgaaacgtaaccgagtaactacgtaacttaccgtaaccgtaactcccttacctactaacgtaacgtaagttaccggtaccgtaccgttaccggtacctacccgttacgttcccggttacccggggttacccgggttacccgtaaggttaccgggttacggtagggtaccgtaacgggtaggttacggtacgttacgggaacggttaacctacggtttacccttaacccctaaccttccgtaaacctaaacggttaacctaacgggtacccggttaccggaagggtaaacctcgggttaaacggacgtttnaaccgtttaccgtacccgtaactttaaccgttacgtacctcgtaactaacgtttaacggttttaacccgtttaacgggtttaccgttacccggtaccggttaaacccggtacggaaaccggtaaccggttaacgtaccgggttaagtaaaggtaaaaccccgttaaacggttacccgggagttacccgggtntaccgtaaccgg

SEQ ID NO: 223979 - DNA, 799 bp, Homo sapiens
  misc_feature: GYAE6OF01DEU6N.48.30.C08.1.454.CMB.1.raw
  modified_base (136)..(136): a, c, t, g, unknown or other
  misc_feature (136)..(136): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcanaactcattgggtttctgctgctctgggttccagcctccgaggggtgaaattgtgctgactcacttccccagtactttcagtctgtgactaccgaaaggagaaagtccaaccatccacctggcccgggccacggaccagagctagttcggttaggtagtttacacgtggtaccagcaacgaaaaccagatccagtcctaccgaaacgtcctacctacattaccaagttatacgtccttaccacggtaccctaagttccgttccggtccgggggttcccccttacggtaaccgggttccgtaaggttcgggtacgtaagggttcgggtaacggttccggtaacgggggtaacgtaacgtttaccgttttacccgacccccttaccaacccctaattacccaaacgttacggtacccgtaagggaacgtaccgtaaggaacgtagttacgcctacggtacctaaaccgttactttaaccgttacggttactaacttacgtaacgttttaccgtttttaaacgggtttacccgttacccgggttaacccgttacccgggtaaccccggtaaaggggttaacccgtaacggaaacccgggttagggttaaaaccggttaaagtttaaaaacccggttaggttaacgggttggtaccccggttaaccgg

SEQ ID NO: 223980 - DNA, 783 bp, Homo sapiens
  misc_feature: GYAE6OF01EQQ1P.48.30.C08.1.454.CMB.1.raw
  modified_base (315)..(315): a, c, t, g, unknown or other
  misc_feature (315)..(315): n is a, c, g, or t
tcagagtatacatacacgaccggtgctcgatttagtctgacgtcaaagggaaagggggtatcttaaaaagaggttctttctctgggatgtggcatgagcaaaactgacaagtcaaggcaggaagatgttgccatcacaactcattgggtttctgctgctctgggttccagcctccgaggggtgaaattgtgctgactcacttccccagtactttcagtctgtgactaccgaaaggagaaacgtcaccatcaccgtcggccggccagccagagctattcggtggttacgttacacgtggtaccagacaagaaaccngatcacgtccacgaatcctcctacgatactaagtactcgtaccttccgagtacccagttacctcgggtccgggtccctcggtacgggttcaaggtcggacgtaggtaggtacgtacggtacggggtactaacgttacgtttacccaccccgtacaaccctacgtaacaacgtaaccggtccgtaagggaaccgtcgtaaggtaacgtagttaccgcgttaacgaacccgttaaaccttaaccgtttaccgttacgtaacgttaacttaccgtttaaaccggttttaacggtttttttaaccggttaacccgggtttacccggggttaaaccccgtttaccggggaaaccccggttaaaacggggtaaccgtaaaacccggggtaacccggttaaaggggtaaaaccggtttaaaaccgttaaaaccgggttaaccggtttaccgggttcgggaacccgttaacccggg

SEQ ID NO: 223981 - DNA, 739 bp, Homo sapiens
  misc_feature: GYAE6OF01EKQ0G.48.30.C08.1.454.CMB.1.raw
  modified_base (183)..(183): a, c, t, g, unknown or other
  misc_feature (183)..(183): n is a, c, g, or t
  modified_base (238)..(238): a, c, t, g, unknown or other
  misc_feature (238)..(238): n is a, c, g, or t
  modified_base (512)..(512): a, c, t, g, unknown or other
  misc_feature (512)..(512): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctcgtgggttccagcctccgaggggtntaattgtgctgactcacttcccagtctttcacgttctgtcgactaccgaaagganaacgtcaccactccaccgtcggaccgggccacgaccgagacgactagtttcggtaggttacgtttacgacgttacggtaccaacgacaacgaaaccagactaccgtacgtaccaccaacgtcctcctacgtactacgtaaagtcgtacgtccgtaccgtacgtaccctacgtccgtccggttcccgggttccccgtacggttacggttcgacgggtcggtacgtaggtacgacgttccgggtaggtaccgtacgttcctttacccgaccccttnaaccctaacgttaacaacgttacccggtcgtaacggaacggtacctaggtaacgtcgtactaccgacgtaaccttacttacgttgtacgtacctacgttacgttaacgtttttcggttttaaccgtccgggttacccgtccgtttaaccggggaaccgtaaccgggtaatacccggcgggttaaagtaaccggtaaacgttaacgacggtttgggcgtacgtacccg

SEQ ID NO: 223982 - DNA, 595 bp, Homo sapiens
  misc_feature: GYAE6OF01DSQVT.48.30.C08.1.454.CMB.1.raw
  modified_base (286)..(286): a, c, t, g, unknown or other
  misc_feature (286)..(286): n is a, c, g, or t
  modified_base (458)..(458): a, c, t, g, unknown or other
  misc_feature (458)..(458): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcacttccccagtacttcagtctgtgactaccaaaggagaagtcacatcactcgccggcagccagagctattgtggtattacactcgacanacagaacagatcagtctaccgaagcctacctcactacaagtactcgtaccttaccgacgtcctactccgttccggtccggggtacccctcggtacggttcgaggtcggacgtaggtcggatcgtgggactagtactttccgaccctacaccatacaatcgtacgtaggaacncgtaagaagcgtcgctacgactaaccgttgtaccgttgtactatacgtactttaacgtttacgttaccgtccgtaccgttccggacgtaaggacctacgaccgtagaacgtaataacggacttacggtcgagtaccg

SEQ ID NO: 223983 - DNA, 910 bp, Homo sapiens
  misc_feature: GYAE6OF01B0T4Y.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcacttcccagtactttcagtctgtgactaccgaaaggagaaagtcaccatccacctcggcccggcacgccagcgctagttcgtaggtagtttacacgtaggtaccagacaacgaaaccagactcgtacgtcctaaccaaagccctacctactaatacgtaaagttactacgtcccttaccgacgtacctacttccgttcccggttacccggggttccccctacgggtacgggtttaccgacgggttcgggaccgtaacgggttacgggtacgttaccgggtacgggggtaaccttaacgggtttaaccctttaccccaacccccgttacaaaccccgtaaccgttaaccgtaaaccggttaccggtacccggtttaacgggaaacggttaccgttaaacgggtaacggtaacgttccggttaacccgttacggtaaacccctttaaaacccgtttttacgtttaaaccgtttacggtaacccttaacggtttacccgtttaaaccggttttaaccggttttttttaaacccggggtttacccggttaccccggggtttaaccccgggttttacccggggaaaaccccggttaaaccggggggaaaccgttaacccggggttaacggttaacggggttaaaaccgggtttaaaaccgtttaaaacccgggtaaaccgggttttaccggggttaccggggtttcccgaaacccggg

SEQ ID NO: 223984 - DNA, 716 bp, Homo sapiens
  misc_feature: GYAE6OF01AHWB0.48.30.C08.1.454.CMB.1.raw
  modified_base (235)..(235): a, c, t, g, unknown or other
  misc_feature (235)..(235): n is a, c, g, or t
  modified_base (351)..(351): a, c, t, g, unknown or other
  misc_feature (351)..(351): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggttctgctgctcgtgggttccagcctccgaggggtagaattgtgctgactcacttccccagtactttcagtctgtgactacgaaagganaagtcacatcacctcggccggcacgccagagctattcggtaggttagtttaccacgtacggtaccagtaccaaacgaaaccagactaccagtaccctaaccgaacgtcctccctanactataacgtatcgtccgtaccgtactcctacgtccgttccggtacccgggttcccgtcggtaggttcgagggtacgcgttaggcggtatcgggtaggtactactacctttccacctacctaactaacgtacaacgttacgacccgtaaggtacacgtagacgtagtcgtccgtacgaccttaacttaccgttacgttacgtacttaacggtttaccttaacggtttaaacgtttttaccggtaccggtttacccgggttaacccgggtttacccggaaccgggtaaccgggtaccggtaacgggtaacggtaacgggttaaacgtaaacgttaaacgggtaacgttcggtacggtccgtaaccg

SEQ ID NO: 223985 - DNA, 831 bp, Homo sapiens
  misc_feature: GYAE6OF01AFN88.48.30.C08.1.454.CMB.1.raw
  modified_base (572)..(572): a, c, t, g, unknown or other
  misc_feature (572)..(572): n is a, c, g, or t
tcagagtatacatacacgaccggtgctcgatttagtctgacgtcaaagggaaaggggtatcttaaaagaggttctttctctggatgtggcatgagcaaaactgacaagtcaaggcaggaagatgttgccatcacaactctagtttgggtttctgcttgccttcgtcgggttcccagcccgttaccggtaggggtataaagtttggtcgacgtcgtacttccgaccttccccgagttacctttcgacgttcgtacggtacgtaccgtaaccgaaaaggtaacgtaaacgtcccacctacgtaccgtacccggtccgggacccgggaccaccgacccgaaggtaccgaccttaacgtttcgggttacggtttaacgtttaccgacgttaccggaaccgtacggacctaaaccggaaacctacgtactccgtaacgtacctaaccgaaccgttcctacccgtatactacgtaacggttacgtccgttaccgtacccgtacgttaccctcgtttaccggttcccgggttaccccgggtcccgtacgggtacgttacgtcgggtacgtacggttcgngggttaacgttcgggtacgttaacggttccttaccgttacccaccccgttacgaccctaacgtaccgacgttccggacccgtaaggacctagtaagacgtacgtcgaaccgtactacgtacttcgaccgttatacgttactacggtacgttttacgtttacggtacgttacccgggttaccgtaccgggaccgtaacggtccgtacgtaaacggtacttaaacggtaaccgttaacggtacgtcggttcgaccttacgg

SEQ ID NO: 223986 - DNA, 862 bp, Homo sapiens
  misc_feature: GYAE6OF01BYRQI.48.30.C08.1.454.CMB.1.raw
  modified_base (181)..(181): a, c, t, g, unknown or other
  misc_feature (181)..(181): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcgaggggtnaaattgtgctgactcacttcccagtactttcagtctgtgactaccgaaaggagaacgtcaccactcacccgtggcccggaccagccgagacgtactagtttcggtaggttacgtttaccacgttacggtaacctacgaccaacgaaaacccaggtaactaccgacgttacctacccgaaacgtcccttaccctactaacttaaccgtaaagttacgttcggtcccgtttacccggaccggttaccctacgtttacccgttcccggttcccgggggttaccccccttacgggttaccgggtttacgtaacggggtttcggggaccctagggttacgggtacgttccgggtaacggggaccgtaacggtttaacccgttttaccccaacccccgttacccaccctaacgtaaccgtaaacgttaccggaccggtttacggaaacgtccgttaaaggaagtcgtaccgtccgtaacgtaacccgttaaaccttacgtttaccgtcggttaacctaacgttaccgttaacggttttaaaccgtttttaccgggtttaacccgggttacccggtaaaccccggtttcccgggaaacccgggtaaccggggtaaccctccggggtaacgtacgggttaaacgttaacgtttaaacccggacggtttcggtacgggttccgtaacccg

SEQ ID NO: 223987 - DNA, 656 bp, Homo sapiens
  misc_feature: GYAE6OF01E0D1K.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcacttccccagtactttcagtctgtgactaccaaaggagaaacgtcaccatccacctggacccgggccagccagacgcattcggtggttaagtttacactcggtaaccaggacaagaaaccagatcacgtacctaccaagcctccgacatctaaagtatcgccttccgactacactctccgtcgggttccctacgtagggttccaggtcgcgtaggtggtactcggtagggtacagtacttccaccctcacgtatacgaactacgaccgtaggtaacgcgtagaagtactgacctacgactaacccttattacgttaccggtactacgttacgttaacgtttaaccgtttttacggttacccggtttaccgggtacccgtttaaccggacggtaaaccgggtaaccgtaccggaacggtacggtaaagtaaccgtaaacggtagtcggtacggtctaacgg

SEQ ID NO: 223988 - DNA, 818 bp, Homo sapiens
  misc_feature: GYAE6OF01BJQTR.48.30.C08.1.454.CMB.1.raw
  modified_base (131)..(131): a, c, t, g, unknown or other
  misc_feature (131)..(131): n is a, c, g, or t
  modified_base (162)..(162): a, c, t, g, unknown or other
  misc_feature (162)..(162): n is a, c, g, or t
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (396)..(396): a, c, t, g, unknown or other
  misc_feature (396)..(396): n is a, c, g, or t
tcagagtatacatacacgaccggtgctcgatttagtctgacgtcaaagggaagggggttagtcttaaaagaggttcctttctcgtgggatgtggcagtgagcaaaacgtcgacaagtcaaggccagggaanactgttgccatcacaactccagttcgggttngctgctcgtcggtcagcctccgagggtcaattcgtcntcgactcacttcccagtacgttcagtcngtcactacaaggactaagccacatccactcggccgcacncagngtctagttcgtaggttacttaacacgtacggtaaccagaccgaacgtaacccagactcgtaggttaccacgtaaacgtctcctactatacctaaggtacttcgtaccgttacggtaccgtaccctnttcccgttcggtccggtaccccgtggtacgtttcgaaggtcggacgaggtacggattacggtaggacctagtttaaccttaccacctaccgaacctacgactaacgtacgttacccgagaaccgtcgtaacggtaacgtcgttaccggtaacgtttaccgaacctttaacgtaaccgttttacgttaacggttacccttaaaggtttaaccctttaacgggtttttaaccccggtttttaacggggtttaaccccgggtttacccggggttaaccccggtaaccggggttaaacccggggttaaaggggtaaccccggttaaaccggttaaccgggttaaaccggggtaaaacccggtttaaacggtttaaaacccggggttaaggttttaccggggaacccggtttaccggtaaacccggg

SEQ ID NO: 223989 - DNA, 751 bp, Homo sapiens
  misc_feature: GYAE6OF01DNB6E.48.30.C08.1.454.CMB.1.raw
  modified_base (432)..(432): a, c, t, g, unknown or other
  misc_feature (432)..(432): n is a, c, g, or t
tcagagtatacatacacgaccggtgctcgatttagtctgacgtcaaagggaaagggggtatcttaaaagaggttctttctctgggatgtggcatgagacaaaactgacaagtcaaggcaggaagatgtgccatcacaactctagtttgggtttctgcgtgccgtcttcgggttccacgccgttccgaggggtagtaaattgtgctgactctacctcccagtactttcgacgtcgttgtacgaactaccgaaaaggaacgtaacgtcaacctactcctaccggtcgacccgggtaccacggtacgacgacgtaccttagtttaccggttaggtttaacgtttaaccacggttacggtaacccagaaccgaaacgaaaccctaggtaacttacgacgtactaaccgaaactccgttaccactatacgtaaagtntaccggtcttacccggactacttcgtaccgttccgttaccgggttccctacggttacggtcgtacggtggacgtagggagttacgtcgggtagtacgtaacgtaccttaccccgacccaacgtacctagtaacgtacgtaccgaggtagtacgtagagtcgtacgtctacgtacctaacgttacttacgtgttactacgttacgttactttacgtttacgttaccgtaccgtaccgttccggaccgtaaacgggacgttaaccgtacggtaacgttaaggttaaacttaaccgttaacgtcgtcggtcgtcgtaacccg

SEQ ID NO: 223990 - DNA, 718 bp, Homo sapiens
  misc_feature: GYAE6OF01CPOPU.48.30.C08.1.454.CMB.1.raw
  modified_base (562)..(562): a, c, t, g, unknown or other
  misc_feature (562)..(562): n is a, c, g, or t
tcagagtatacatacacgaccggtgctcgatttagtctgacgtcaaagggaaagggggtatcttaaaaagaggttctttctctgggatgtggcatgagacaaaactgaacaagtcaaggcaggaagatgttgccatcacaactctagtttgggtttctgctgccttcgttgggttccacgccctccgagggggtagtaaagttgtgctcactcctaccttccccagtactttcagtctgtacgtactaaccgaaagggaagaaacgtccaaccactccaccgtcggcccggccgacgcctaaggacacttacgtttcgtaggttacgtttaaccacggttacggaaccagtaccaacgaaaaccagtacctacgtacgtaccgtaaccaacgtccttactactaacgtacgtaaagtcgttcgtaccctacgtaccgtacctacgtccgtcggtcccggttcccgtggtagttcgacggtgtcgaggtacgtcgtagggtacggtactacgttacctaccctaccttaacactacaactacgcgtacgaagaacgtcgaagngtacgctacctacgtaaccttacttacgtagtcctacgtattacggttattttaacggttaccggtttacgccgttaccggtaaccggaacgtaaggacccgttaagggtacgttaaaggaaacgtttaactaacggtagtcggtacgtctaaccg

SEQ ID NO: 223991 - DNA, 723 bp, Homo sapiens
  misc_feature: GYAE6OF01EDDQT.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcacttccccagtactttcagtctgtgactacgaaaggacgaagtccaccatccacctcggccgggaccacgccagagctacgtttcggtaggttacgtttaccacgtacggtaccagacaacgaaaccagactacgacgtacctaccaaacgtcctacctactactactaagttactcgttcctaccgtataccctacgttaccgttcccggttccggggtccccctacgggtacggttcgacggtcggataggtgacgttcggagggactacgttacttccacctcactactacgtaaactcggtacgtaaggtaacgtcgtaagaacgtattcggaccttacggtaacccttaaaccgtttataaccgttcgttaccacgttacgttaacgtttaacgtttttaaccggttacccggtttaccgggtaacccgtttacgggaacccgggtaacggtaacccacgggtaaccgttaagggaaacgttaaacgttaaacgtaccgggttaggttcccggagtacccg

SEQ ID NO: 223992 - DNA, 717 bp, Homo sapiens
  misc_feature: GYAE6OF01DHLVX.48.30.C08.1.454.CMB.1.raw
  modified_base (194)..(194): a, c, t, g, unknown or other
  misc_feature (194)..(194): n is a, c, g, or t
  modified_base (259)..(259): a, c, t, g, unknown or other
  misc_feature (259)..(259): n is a, c, g, or t
  modified_base (498)..(498): a, c, t, g, unknown or other
  misc_feature (498)..(498): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
tcagagtatacatacacgaccggtgctcgatttagtctgacgtcaaagggaaagggggtatcttaaaagaggttctttctctgggatgtggcatgagacaaaatgacaagtcaaggcaggaagatgttgaccatcacaactcagttggtttctgctgcttcgtgggttccagcctacgaggggtataaagttgngtacctagtaccttactacgttccccgaagtactttacgacgttctgtacgactaaccaaagganaaacgtcaaccgactaccaacgtcggaccgggaccacgaccgaagagtactagttcgtagttacgttaacacgtacgtaccagtacaacgaaacctagaactacgacgtactaaccgaactcctaccggttacaacgtactaaaggtctaacgtccgttacgactcctacgtcgttcgtaccggtcctagacggtacagtcgatggtgagtgacgtacgaatcgttaccactaccgtanacgtaacaacgtacgacgtagaacgtcaggaagtacgngaccgtnaaaccgttacttaacgttacgtagttaccctaagttacgttacgtttaccgtttaacggtttaccggtaccggtaccgtaaccgggtaacgtaaacccgggacgtaaacgggtactacgggaaaccgttaaacggttaaaaccgtccgtttaaggtaacccgtggttaaacccg

SEQ ID NO: 223993 - DNA, 807 bp, Homo sapiens
  misc_feature: GYAE6OF01EVEM6.48.30.C08.1.454.CMB.1.raw
  modified_base (152)..(152): a, c, t, g, unknown or other
  misc_feature (152)..(152): n is a, c, g, or t
  modified_base (178)..(178): a, c, t, g, unknown or other
  misc_feature (178)..(178): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttcngctgctctggtccagcctcgagggtnaattgtgctgactcacttcccgagtactttcagtctgtcgactacgaagganaagtccacnctcgaccgtcggaccgggaccagacccgagacggtacttacgttcggttacggtttaacgttacctaacgttacggtaaccctacggaacaaaacggaaaaccgtaaggtacctaccgtaacggtaccgtaaccgtaaaccgtccctaccgtaactaacgtaacgaagttaacgtccgtacgttacccgagttacccacgttccgtcccggttccgggtacccctagggtacgtttacgaggtacgccggtaggtcgttaacgtcggtacgggtacgtacttaccttaacccaccgtactaacctataaccgtactaacgtaccgtaggtaacgtacgtaggtaagtcgtaccggtactacgtaaacccgttaacttaaccttacgttaccgtaaaccttacgttacgtttaaacggtttttaaccggttttaaccggtttaaccggttaccccggttaaaccgggttacccggtaaccgggttaacggaaaccgggtaaccggttaaccggtaaggtaaaccgttaaacgttaaaccgtaaagtttcggtaacccgttcgtaaccgg

SEQ ID NO: 223994 - DNA, 704 bp, Homo sapiens
  misc_feature: GYAE6OF01C6SQN.48.30.C08.1.454.CMB.1.raw
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (580)..(580): a, c, t, g, unknown or other
  misc_feature (580)..(580): n is a, c, g, or t
  modified_base (670)..(670): a, c, t, g, unknown or other
  misc_feature (670)..(670): n is a, c, g, or t
  modified_base (698)..(698): a, c, t, g, unknown or other
  misc_feature (698)..(698): n is a, c, g, or t
tcagagtatacatacacgaccggtgctcgatttagtctgacgtcaaagggaaagggggtatcttaaaagaggttctttctctgggatgtggcatgagacaaaactgacaagtcaaggcaggaagatgttgccatcacaactcagttgggtttctgctgctcgtggttccagcctcgagggtntaattgngctgactcactcccagtacttcagtctgtcgacctaacgaaaggaacgaacgtccaacactccaccgtcggccggaccacggaccaagcgtacttacggtttcggttagttaacgtttaccgaccggttacggaaccagaccaaacggaaacctagtactacgtaccgtacctaaccgaacgtcccttcactaactacgtaagtactcgttaccgttaccgacgttcctacgttcccgttccgggttacccggggttccctaggtacggttacgacgggtacggtacgtaggtacggtacttcgggtacgggtaacttacgttacctttacccgaccctaccgtaacctaacgttaactaacgtccggtacgtaaggacgtacgtaagtanacgttcgacgtaacctactaaacttgtacgtacacttacgttattaccgttttacgttacgttccgaccgtacgtcggaacgtagtacgngtagtagaacgttaacgtacgtagtcgntcgtac

SEQ ID NO: 223995 - DNA, 901 bp, Homo sapiens
  misc_feature: GYAE6OF01BHORW.48.30.C08.1.454.CMB.1.raw
  modified_base (189)..(189): a, c, t, g, unknown or other
  misc_feature (189)..(189): n is a, c, g, or t
tcagagtatacatacacgaccggtgctcgatttagtctgacgtcaaagggaaaggggtatcttaaaagaggttctttctctgggatgtggcatgagcaaaactgacaagtcaaggcaggaagatgttgccatcacaacgtctagttgggtttctgctgctcgtggtccagtcctcgagggtataattgngactgactctactcccagtactttacgagttcgtagtacgacctaacgaaaagggaacgtaaacgttccaaccgacgtaccgaccgttaggaccccgggtaccaacgggtaccaacggtaccgacgttacggttttaccggtttagggttaacggttttaaaccgaccgttaccgggtaacccgtaaggtacctaaaacggaaaacccgtaggtaacttacccggtaaacggtacctaaccgaaacggtcctaccgtactaacgtactaaacgtattaccgtccgttaccgacgtaccgtacgttcggtaccggttcccggggtacccttacgggtacggtttacggaacgggttacggacgttaggttacggtactacgggtagggtaactacggtttaacctttacccggaaccttccgaacttacgtaacgtaaacgttacggtcccgtaaagggtaccgtacgttaaggaaccgttagtaccgtaccgttaacgtaccgttaaaccgtttagtttacccgttaacgtacccttaaaggttaccctttaacggttttaaacccgtttttaggtaacccgggggacctttaaaccccgggttacgggaaaccggttaaacccgggtaactaaacggttaacccgtaacgggttaaaacgttaacccggttaaaaaggtacccggttggtaaaccgggtcttaaacccggg

SEQ ID NO: 223996 - DNA, 847 bp, Homo sapiens
  misc_feature: GYAE6OF01A132B.48.30.C08.1.454.CMB.1.raw
  modified_base (370)..(370): a, c, t, g, unknown or other
  misc_feature (370)..(370): n is a, c, g, or t
  modified_base (415)..(415): a, c, t, g, unknown or other
  misc_feature (415)..(415): n is a, c, g, or t
tcagagtatacatacacgaccggtgctcgatttagtctgacgtcaaagggtaagggggtatcttaaaagaggttcgtttctctgggatgtggcatgagcaaaactgacaagtcaaggcaggaagatgttgccatcactaacgtctagttgggttctgctgctcgtcggttccacgtccctccggaggggtataaagttcggtacgtccgttagaccttacctaccttacccccgagtaccgtttccaaggttcctcggtacgaaccttaccggaaaaggtaagaaccgtaccaaccgtactaccgaccgtcggcccgggccacgaccagacgactagttcggtaggtacttacgtacgtacggaacccgngacgaacaaaccgtcgtagtaccacgttacaaccaagtccctacnctaatacgtagtactcgtcgttacccggatccgtactcggtaccggtccgggtacccgtgtacggtcctaggggtaccgtcgttagggtaccgtgttacccggtaggtaccgtacgtttacccgttaccccctacctaccccgtaataaccggtacgtaacggttacccggaccgggttaacggtacgtaaccgtacggtacggacttaccgtagtaacccgttccgtaaacccttttacggtaacttaccggttaacccttacggttttaacgttacccgggtttttaacgttttacccgggtaacccccgggtcttaccccgggggtaccccgtaacgggggaaacccggtaacggttacccgggtaaggtttaaaccggagttaaaaacccgggtttaaccggagtttccggggaaacttccggacccg

SEQ ID NO: 223997 - DNA, 734 bp, Homo sapiens
  misc_feature: GYAE6OF01A697J.48.30.C08.1.454.CMB.1.raw
  modified_base (329)..(329): a, c, t, g, unknown or other
  misc_feature (329)..(329): n is a, c, g, or t
  modified_base (562)..(562): a, c, t, g, unknown or other
  misc_feature (562)..(562): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctcgtgggttccacgcctccgaggggtgaaattgtgctgactcacttccccagtacctttcagtctgtgactaccgaaaggaagtaaagtccaccactccaccgtcggcccgggccacgccagagctagttcgtggttattacacgtcggtaccacgacaagaaaccagtacnctaacgtacctaccgaaactccctacctactaagtaccaaaggttaatccggttacccgttacccgacggttaccctacgttccgtaccggggttccccgggggttaccccctcgggtacgggttcgtagggtccggtagtacgggttggacgttcgggtaacgggaccttaaggttaccctttaccaccccgttaccaaccttatacctaaagtcccgacgttaggaacgtntaacggaagtagtcgtactacgtaacctaaccttgtttaacctcgtactactacgtaacgttttacgtttacgtttaccggtaccgttacccggttacggacggtaacggtacccgtaaggtcggtaacgggtaaacttaaacgttaaacggtagtcggtagtcggtaaccg

SEQ ID NO: 223998 - DNA, 751 bp, Homo sapiens
  misc_feature: GYAE6OF01CFY18.48.30.C08.1.454.CMB.1.raw
  modified_base (152)..(152): a, c, t, g, unknown or other
  misc_feature (152)..(152): n is a, c, g, or t
  modified_base (180)..(180): a, c, t, g, unknown or other
  misc_feature (180)..(180): n is a, c, g, or t
  modified_base (277)..(277): a, c, t, g, unknown or other
  misc_feature (277)..(277): n is a, c, g, or t
tcagagtatacatacacgaccggtgctcgatttagtctgacgtcaaagggaaagggggtatcttaaaaagaggttctttctctgggatgtggcatgagcaaaactgacaagtcaaggcaggaagatgttgccatcacaactcattggtttcngctgctcgtggtccagctccaggggtanaattgtgctgacctcacttccccgatactttcagtctgtcgacctaccgaaaggagtaaacgtccaaccatccaccgtcggcccggccacgccaganacttacgttcggtaggttaactttaccacgttaccggtaccaacggactaacgaaaacccgtgaacttaccaggtccctaaccgaaacgtcctttacccgactaagttacgaaacgttactccggttacctttacccggacgtcccagtttacccggttccgggttacccggggttacccctcgggttaaacgggttcgtaacgggttcggtacgtaaggttcggtacttacgggtacggggtaacttacgttacccgttttaacccgacccctaccgtaacctaacgttaaccgtaacgttaccggaccgtacggtaacgtaccgtagaagtacggtcgtaacgtacgtacctaaccttacttacgtctacgtctacgttacgtttaacgtttacggttacgtaccggtacgtacgggacctaacgggactacggtacgtaggaacttaacgtaacgagttcggcgtcgtacg

SEQ ID NO: 223999 - DNA, 723 bp, Homo sapiens
  misc_feature: GYAE6OF01BB9ZF.48.30.C08.1.454.CMB.1.raw
tcagagtatacatacacgaccggtgctcgatttagtctgacgtcaaagggaaagggggtatcttaaaaagaggttctttctctgggatgtggcatgagcaaaactgacaagtcaaggcaggaagatgttgccatcacaactcattgggtttctgctgctcgtgggtccagcctccgaggggtagaaattgtgctgactcacttccccgagtactttcgagttctgtacgtactacgaaaggagaacgtcaccactccaccgtcggcccgggaccacgaccgagacgctacgtttcggtaggtttaacgtttacacgtacggtaaccaggaccaaacgtaaacccagactactacgtacctaaccgaaacgtccctacctacaactaccgaagttacttaccgtccgttaccgacgtacctacgttccgtccgggttacccggggttccctacggtacggttacgaggtacggacgtacggtcggtacgttcgggtacgggaactacggttacctttacccgacccctacaaccctactacgtaacgtacgccgtaaggaacgtacgtaggaacgtctacgactacgtacctaacttagttactcgtactacgtacgttacgtttaaccgtttacggttaccggtaccgtaccggttacgaaccggaaggtccgaacgtacggtacggtaaataaaccggttaacggtagtcggtcgctaccgg

SEQ ID NO: 224000 - DNA, 637 bp, Homo sapiens
  misc_feature: GYAE6OF01A4V81.48.30.C08.1.454.CMB.1.raw
  modified_base (335)..(335): a, c, t, g, unknown or other
  misc_feature (335)..(335): n is a, c, g, or t
  modified_base (455)..(455): a, c, t, g, unknown or other
  misc_feature (455)..(455): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaattgtgctgactcattccccagactttcagtctgtgactccgaaaggagaaagtcaccatcacctgccggccagccagagctattcgtggtagtttacacgtggtaccagcaagaaacccagatcagtcctaccaacgcctcctcatcaagtntgcttccgagtccatcctcgtccgggtcccctcggtaggttcaggtgcaggtgactcgtgggactagttacttccgaccctcgtaaccatacaatccggctagggacgcttaggaacgtntcgactacgtacctaaaccttgttaccgttgtacctagttaccgtacgtttaccgtttttacggttaccgttccgggtaaccccgtttccgggtaaccggtaaccggggtactacccgggtaacgtacgggtaaacggttaaacgttaaaacccggtaagtcgggttacggtcgttacccgg

SEQ ID NO: 224001 - DNA, 867 bp, Homo sapiens
  misc_feature: GYAE6OF01AO900.48.30.C08.1.454.CMB.1.raw
  modified_base (181)..(181): a, c, t, g, unknown or other
  misc_feature (181)..(181): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggagatgttgccatcacaactcattgggtttctgctgctctgggttccagcctccgaggggtnaattgtgctgactcacttcccccagtacctttcgagttctggtacgacctaccgaaaggagtaagtccaccactccgaccgtcggcccgggccacgccgagacgctagttcggtaggttacgtttaccacgttacggtaaccagcaacgaaaccctagactcgacgtcctaccgaaacgtcccttcctacgtataccgaagttacgtcggtaccgtttaccgacgttcctaacttcccgttccgggtacccggggttcccctacgggttcggtttaccgagggttcgggacgtacggtcggtagttccggtaacgggtactaaacggtttcctttaccccgacccccttacctaacccccgtaattaacccggaaacgttaaccggtacccgggttaggtaaaaccgggtcccgttaaaggggtaaccgttacgttaccggtaccgttaacccgggtaacctttaaaaccccgtttagttttaacccgttacgttacccttaacccgtttaacgtttaacccgggtttttaacctttttttaaaccggggtttaccccgggtttaacccggtaccccgggttttaaccgggaaccccgggttaaagggacccgttaaccggtaacggttaacggtaaacgttaaaccgttaaaccggtaccggtggttaaccccggtgtaccccgg

SEQ ID NO: 224002 - DNA, 942 bp, Homo sapiens
  misc_feature: GYAE6OF01ASBNH.48.30.C08.1.454.CMB.1.raw
  modified_base (193)..(193): a, c, t, g, unknown or other
  misc_feature (193)..(193): n is a, c, g, or t
tcagagtatacatacacgaccggtgctcgatttagtctgacgtcaaagggaaagggggtatcttaaaagaggtttctttctctgggatgtggcatgagcaaaactgacaagtcaaggcaggaagatgttgccatacacaactcattgggtttctgctgctcgtcggttccagcctccgaggggtataagttgngctgactcacttcccagtactttcagtctgtgacctacgaaagagaacgtcaacactccaccgtggccggaccgagaccagacgctacgttcgtagttacgttacctacgtacgtaccgagtacaaacgaaaccgagactacgtacgtacctaccgaaacgtcctactacaatacgtaagtactcgtaccgtacctacgtacctacgtccgtccggtacggtccccgtaggtacgttcgtaacgggttacgcggtacggtacggtaacgttacgggtaaccgggaacgttacggttaaccctttaccccgtaaccccttacccgtaaaccgttaaacgtaacccgtaaagttaacccggtaaccggttaacgggtaaccgacggtttaaacggaaacggtaacgtttaccccggtaaccgggtttaaaccttaacccccgttaaaaacggttttaccctttaaaaccggttacccgggttaaacttaaacccgtttaaccgggttaaaccgtttttttaaacccggggttttttaaaaccccgggttttaacccgggtttaaccccccggggttaaaccccgggtttttaacccccgggggaaaacccgggtaaacccgggggttaaccctaaaaacccgggggtttaacggttaaaacccggggtaaaacgtttaaaaaccccgggtttttaaaaccgggaaaccggtttttacggggtaaaccgggttaacccgttaaaccccgggg

SEQ ID NO: 224003 - DNA, 688 bp, Homo sapiens
  misc_feature: GYAE6OF01DE8NW.48.30.C08.1.454.CMB.1.raw
  modified_base (181)..(181): a, c, t, g, unknown or other
  misc_feature (181)..(181): n is a, c, g, or t
  modified_base (190)..(190): a, c, t, g, unknown or other
  misc_feature (190)..(190): n is a, c, g, or t
  modified_base (460)..(460): a, c, t, g, unknown or other
  misc_feature (460)..(460): n is a, c, g, or t
tcagagtatacatacacgaccggtgctcgatttagtctgacgtcaaagggaaagggggtatcttaaaagaggttctttctctgggatgtggcatgagacaaaactgacaagtcaaggcaggaagatgttgccatcacaactcagttggttctgctgctctgggttccagcctcgagggtanaagttgtgntcgactcactcccagtactttcagtctgtacgacgtaccgaaaggtagaacgtcacctactaccgaccgtcggaccgggaccacgaccgaacgtacgacgtacgttcggttacggttaacgtttaacgtacgttacggtaacccgaagaccgaacgaaacgtaacggtactacgtacggtacctaaccgaaacgcctacctactaacgtactaagtactcgtctacgacgtctactcgtacgtcggtccctagtacgtcgaggtcgtcgnggtacgtgtcggtagggacttacgtacctttaccgacctaccaacgtactaaccgtaagtccgacgtagaacgtagtacgaatcgtcgacgactacctaacggttacttacgtgtactattaccgtagtttacgtttaaccgttagtcccggtacctaccgggaccgaaggtaccgtaacgtacgtaacgtaacgttaaacgttacagggtttacgccgtacgtaacg

SEQ ID NO: 224004 - DNA, 732 bp, Homo sapiens
  misc_feature: GYAE6OF01C729K.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggttctgctgctctgggttccagcctccgagggtgaaattgtgctgactcacttccccagtacttcagtctgtgactacgaaaggagaaacgtcaccataccaccgtcgcccgggacacggccagtacgctagttcgtaggttatttaccgacgtcggtaaccacgacaacgtaaaccagactacgtacgtcctaccgaaacgtcctacctacaacttacgaaagttctacgtcccgttacgtacgttaaccctcgttccgttacccggtcccggggttacccctcggttaacgggttacgtaacggtcggtacgaagggttacggtacgtacggttacggggtaacttaacggttactttaccccgaaccccttacgtaaccccgtaataacctaaacggttacgaccccggtaaggtaaacgtccgttaaagggacgtaacgtaggtacctacgtaacctaaccgttacttacgttcgaacttcgtaacgttacgttacttttacggttaccgtaccggttaccgtacggacggtaaggaccacgtagtaacgtaacgtaaacgtaaacgtgtacgtggcctacg

SEQ ID NO: 224005 - DNA, 701 bp, Homo sapiens
  misc_feature: GYAE6OF01CXCCI.48.30.C08.1.454.CMB.1.raw
  modified_base (180)..(180): a, c, t, g, unknown or other
  misc_feature (180)..(180): n is a, c, g, or t
  modified_base (368)..(368): a, c, t, g, unknown or other
  misc_feature (368)..(368): n is a, c, g, or t
  modified_base (592)..(592): a, c, t, g, unknown or other
  misc_feature (592)..(592): n is a, c, g, or t
  modified_base (695)..(695): a, c, t, g, unknown or other
  misc_feature (695)..(695): n is a, c, g, or t
tcagagtatacatacacgaccggtgctcgatttagtctgacgtcaaagggaagggggtatcttaaaagaggttctttctctgggatgtggcagtgagacaaaactgacaaggtcaaggcagggaagatgttcgccatcacaactcattggttctgctgctctggtccagcctcgagggtnaattcgtgctgactcacttcccagactttcagtcctgtagacctaccgaaaggataaacgtccacaatcctaaccgtcggaccgggccagaccgaggtacgactagttcgttaggtaacgtttacacgtggtaaccaagcgaacgaaacagatcgacgtactacaaacgctacctacactacgaagtntacgtcttaccgagtctataccgtcgtaccgggtcccaggttacgtcgtagtcggactaggtacggtacttacggtcgggtaactaacggtttaccttaacccctaaccgtaaccctaaccctaagtaaacctaaaacgtacggtacccgtaagggtaacgtacgttaacgggaaacttaacgtcgtaacgtacgtaaaccggtaaacctttaacgttaacgtnttaaccgaacttacgtacgtttaacgtttaccgttacgtaccgttacgtaccggtacgaacggactacggtacgtagtaacgtaactaaacgtattggacgtntaaccg

SEQ ID NO: 224006 - DNA, 869 bp, Homo sapiens
  misc_feature: GYAE6OF01C8L6N.48.30.C08.1.454.CMB.1.raw
tcagagtatacatacacgaccggtgctcgatttagtctgacgtcaaaggggaaagggggtatacttaaaagaggttctttctctgggatgtggcatgagacaaaactgacaagtcaaggcaggaagatgttcgccatcaacaactctagtttgggtttctgctgctcgtcgggttccacgcctccgagggtagtaaattgtgctgactcacttcccagtacttcagtctgtgactacgaaaaggaacgaaacgtaccaaccactaccgacccgtcggacccgggaccacggaccaaggacgtacctagtttacggttaggttacgttacgtacgttacggaaccaggacaaacgaaaccaagaacctacaacgtacctaaacccaagtcctacctacaatacgaaagtctacgtcctacgtacgtacctacgttcggtaccggtacccggggtaccccgttacgggacggttaccgtagggtaccggtaccggtaagggttacggtaacggtttacgggtaaccggggttaaccctaaggtttaaaccccgtttacccgtaaacccccctaactaaacccggtaaaccgttaaacctaaaacgttaccggaacccgtttaaggggaaaccggtacctaaagggaacgtaacggtcggtaaccctaccggttaaacctaacttaacctttaacgtacggttacttaacttacgttaaacgttttcgtttttaaaacccgggtttacggtacccggttaacccggtttaaccggaaacccggaaacgggttaacccgacggtaaccggtaaaccggggtaaaattaaacccggtaaaacggttaaggtacggtttcccgggagttaaaccc

SEQ ID NO: 224007 - DNA, 697 bp, Homo sapiens
  misc_feature: GYAE6OF01DR1XJ.48.30.C08.1.454.CMB.1.raw
  modified_base (223)..(223): a, c, t, g, unknown or other
  misc_feature (223)..(223): n is a, c, g, or t
  modified_base (361)..(361): a, c, t, g, unknown or other
  misc_feature (361)..(361): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgcctctcgggttccagcctccgaggggtgtaaagttgtgctgactcactcccagtacttcagtctgtnactaccgaaaggagaaacgtcaccatccactcggccgggacacgacagacgctagtcgtagtacgttacacgtacgtaccacgacaacgtaaacagactcgacgtacctacaacgtcctcctactactacaagttacncgtctaccgtactccgtattccgttacggtccgggtccccgtacgggtaacggtcgtaggtcggtacgtgggttacgtacgtacggttacgggaaccgttagttaccctttacccgacccctacctacctaactaacaacgtacgtaccgtaggaacgtacgtagaacggttcacggtacctacggtaaccttaaccggttaacttacgtacgtactactttaccgtacgttttaacgtttacggttaacggtccggtacccggttcggaaccgtaaaggtccgaacgtacggtaaggtaacgttaaacggtaaacgtagtcggcgtaccgtaccg

SEQ ID NO: 224008 - DNA, 823 bp, Homo sapiens
  misc_feature: GYAE6OF01EDQID.48.30.C08.1.454.CMB.1.raw
  modified_base (228)..(228): a, c, t, g, unknown or other
  misc_feature (228)..(228): n is a, c, g, or t
  modified_base (385)..(385): a, c, t, g, unknown or other
  misc_feature (385)..(385): n is a, c, g, or t
  modified_base (455)..(455): a, c, t, g, unknown or other
  misc_feature (455)..(455): n is a, c, g, or t
tcagagtatacatacacgaccggtgctcgatttagtctgacgtcaaagggaaagggggtatcttaaaagaggttctttctctgggatgtggcatgagcaaaactgaacaagtcaaaggcaaggaagattggttgccatcaacaacttcagtttcgggtttctgctgtcctcgttgggtccacgcctccgaggggtataagttgtgctgactcacttcccagtcttacngtctgtcgacctacgaaaggtaagaacgtccacactccgaccgtcggccggcaacgccaggatctagttacggtaggttacttaccgtgttacggaacctagacaaaccgtaaacgagaaccgtcgtaaccgtacctaacgaaacgtcctaccctanacgacttaacgtacgtcgtaccttaccggatcctacgttcgtaccgggtccggtacccgtgtcggttacnggttaccggattaggtcggtaacctcggggaacgtacgttaccgttacccttacccgaccccgttacctaaacccgtacgtaaccgtaacggttaccggttaccgggttaacggaccgtaagggttaaccgaagtacggttacggtacctaaccgtactttaaaccgttccggtaactttacctaaccgttacgttaaccggtttaactttttacccgggttaaaccgggtttcccgttacggttaaccccgggttaccgggtaaacccgttaagggtaaacccggtacccgggttaaggtaaccggggtaaaacttttaaccggtaaaaccgggtttacggtacgggttcccgtaaggttacccccg

SEQ ID NO: 224009 - DNA, 799 bp, Homo sapiens
  misc_feature: GYAE6OF01A1T7S.48.30.C08.1.454.CMB.1.raw
  modified_base (182)..(182): a, c, t, g, unknown or other
  misc_feature (182)..(182): n is a, c, g, or t
tcagagtatacatacacgaccggtgctcgatttagtctgacgtcaaagggaaagggggtatcttaaaagaggttctttctctgggatgtggcatggagcaaaactgacaagtcaaggcaggaagatgttgccatacacaactcattgggtttctgctgctctgggttccagcctcgagggtnaattgtgctgactcacttcccccagtactttcagttcgtgtcgacctaccgaaaggagaaacgtccgaaccactaccaaccgtcggacccgggaccacggccgaagacgtctacgtttcggtaggttacgttttaccaccgttacggtaaccacggtacctaaacggaaaccctaggacttacgacgttacctaacccgaaacgtccctacctacacttacgtaagttactacgtccgttaccgacgttaccctacgttccgtcccggttccggggttacccctagggtaacggtttccgaggttcggagtacggttaggaccgtttacggtacgggtaacgtacgttacctttaccgacccctacacccgtatacgtaactacgaccgtaaggactacgtagaacgtcgtacgcttaacggaaccttaaccgttacgttacgttacgtaccgttaactacgtttaaccgttttaccggttttacggtttaccgggttacccggttaaccgtttaaccccgggacgtaaacccggggtaccttaaccggttaccggtaaggttaaacgttaacccgttaaacgggtaaccgttcgggttaccggtaccgttaaccgg

SEQ ID NO: 224010 - DNA, 518 bp, Homo sapiens
  misc_feature: GYAE6OF02IEYKG.48.30.C08.1.454.CMB.1.raw
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (499)..(499): a, c, t, g, unknown or other
  misc_feature (499)..(499): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccagagcattcgtggtagtttacactggtaccagcagaaaccagatcagtctccaaagctcctcatcaagtatgcttccgagtccatctctcggggtcccctcgaggttccagtggcagtggatcgtgggacagatttcaccctcacatcaaatgcctggaanctagaanatgctgcaacctnttactgtcatcagtacttttagttactcggtaccttcggaccaagggcaaccgactgganaattaaacgactgtggctg

SEQ ID NO: 224011 - DNA, 545 bp, Homo sapiens
  misc_feature: GYAE6OF02J2YTI.48.30.C08.1.454.CMB.1.raw
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
tcagagtatacatacacgaccggtgctcgatttagtctgacgtcaaggaaaggggtagtcttaaagaggttctttctctggatgtggcatgagcaaactgacaagtcaaggcaggaagatgttgtcatcacaactcattgggtttctgctgctctgggttccagcctccagggtgaattgtgctgactcattccccagactttcagtctgtgactccaaaggagaaagtcaccatcacctgccgggccagccagagcattcgtggtagtttacactggtaccagcagaaaccagatcagtctacaaaagcctcctcatcaagtatgccttcgagtcccatcctctggggtcccctgacggttcagtcggcagtcggatcgtgggacngatttcaccctnaccatcaatgcctggaanctagantnctgcactattacngtcatcagtacctttttagttacgtccggtacctttccgggacccgtaagggaccaaccggtcgtaggaacggtacttaaaccggaactcgggttacggcttaccgg

SEQ ID NO: 224012 - DNA, 514 bp, Homo sapiens
  misc_feature: GYAE6OF02I8VSV.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctgggtcccctgaggttcagtgcagtggatcgtgggacagatttcaccctcaccatcaaatgcctggaagctagaagatgctgacaacctattactgtcatcagtacttttagttacgtcgtacttcggccaagggacacgactggactattaaacgactgtggctcg

SEQ ID NO: 224013 - DNA, 524 bp, Homo sapiens
  misc_feature: GYAE6OF02HIWDA.48.30.C08.1.454.CMB.1.raw
  modified_base (521)..(521): a, c, t, g, unknown or other
  misc_feature (521)..(521): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctaccaaagctcctcatcaagtatgcttccgagtccatctctcggggtcccctggaggttcagtgcaggtgatcgtgggacagtactttcaccctcaccatcaatcgcctaggaagctagaagatgctgctaaccttatactgtacatctagtacttttagttacgtcgtaccttcggaccgaaggacacgactggacgtataacgactgtcgntcg

SEQ ID NO: 224014 - DNA, 516 bp, Homo sapiens
  misc_feature: GYAE6OF02G9SED.48.30.C08.1.454.CMB.1.raw
  modified_base (421)..(421): a, c, t, g, unknown or other
  misc_feature (421)..(421): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgtcatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctgagttcagtggcagtggatcgtgggacagtatttccaccctcaccatccaatagcctggaanctagaagatgctgacaacctattacctgtcaatcagtacttttagttacgtcgacttcggccaagggcacgatggatattaacgactggtgctcg

SEQ ID NO: 224015 - DNA, 615 bp, Homo sapiens
  misc_feature: GYAE6OF02J0XY7.48.30.C08.1.454.CMB.1.raw
  modified_base (330)..(330): a, c, t, g, unknown or other
  misc_feature (330)..(330): n is a, c, g, or t
  modified_base (385)..(385): a, c, t, g, unknown or other
  misc_feature (385)..(385): n is a, c, g, or t
tcagagtatacatacacgaccggtgctcgatttagtctgacgtcaaagggaaaggggtagtcttaaagaggttctttctctgggatgtggcatgagcaaaactgacaagtcaaggcaggaagatgttgccatcacaactcattgggtttctgctgctctgggttccagcctccagggtgaaattgtgctgactcattccccagactttcagtctgtgactccaaaggagaaagtcaaccatcacctgccgggccagccagagcattcgtggtagtttacactggtaccagcagaaaccagatcagtcaccaaagcctcctcatcaaagtntgcttccgagtccatctcgtcggggtcccctgaggttcagtgcaggtggactcgngggacagtactttccaccccttcaaccgtactacaaacttacggccctagggaaacgtccgtagaaacgtagtcggccttaggaccaaacccttatttaccgtagtccctattccgtaagttaacctttttacgtttaccgttccggtaccttttaccgggaccttaaacgggacctaaccgacgttagggaacgttaactaaaaccgtaacgttcggttacgcttacgg

SEQ ID NO: 224016 - DNA, 529 bp, Homo sapiens
  misc_feature: GYAE6OF02I6KGT.48.30.C08.1.454.CMB.1.raw
  modified_base (415)..(415): a, c, t, g, unknown or other
  misc_feature (415)..(415): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtatttacactggtaccagcagaaaccagatcagtctccaaagctcctcatcaagtatgcttccgatccatctctgggtcccctgagttcagtgcagtggatcgtgggacagtactttcaccctcaccatcaaatgcctggaanctgaagatgctgacctaaccttattactgtcatcagtacttttagttaccgtcgtaccttcgggccaagggaccacgtacgtaggaataacttaaacgaactcggtaggctacg

SEQ ID NO: 224017 - DNA, 564 bp, Homo sapiens
  misc_feature: GYAE6OF02I8H11.48.30.C08.1.454.CMB.1.raw
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtattacactggtaccagcagaaaccagatcagtcctaccaaagcctcctacatcaagtatgcttccgagtccatctcgtcgggtcccctcgacggttcaggtcggcgtaggtcggtatcgtaggggactagtactttccacccctcacctatcaatcgcctggaanctagaagntcgctgacctaaccttattactgtactatctaagttacttttagttcgtccgtaccgttcggaccaagggtaccaggtaccgtagggaactacgttaaacgaacgttcggtagctacg

SEQ ID NO: 224018 - DNA, 556 bp, Homo sapiens
  misc_feature: GYAE6OF02GDWMV.48.30.C08.1.454.CMB.1.raw
  modified_base (435)..(435): a, c, t, g, unknown or other
  misc_feature (435)..(435): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcacttccccagtactttcagtctgtgactccaaaggagaaagtcaccatccacctgcccgggccagccagagcattcgtggttagtttacactggtaccagcaagaaaccagatcagtctaccaaagcctcctcatacaagtatgtcttccgagtccatctcgtcgggtcccctggaggttcagtgcaggtggatcgtgggacagtactttccaccctcaccatacaatcgcctggaanctagaagatgctgaccaaccttattactgtacatcagttactttttagttacgtcgtaccttcggacgtaacgggacacggtacgtggaacgtaacgttaaaccgacgttggtacgctacg

SEQ ID NO: 224019 - DNA, 526 bp, Homo sapiens
  misc_feature: GYAE6OF02FHWYH.48.30.C08.1.454.CMB.1.raw
  modified_base (424)..(424): a, c, t, g, unknown or other
  misc_feature (424)..(424): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgcccgggccagccagagcattcgtggtagtttacactggtaccagcagaaaccagatcagtctccaaagctcctcatcaagtatgcttccgagtccatctctcggggtcccctcgaggttcagtggcagtggatcgtgggacagactttcaccctcaccatcaatacgcctaggaanctagaagatgctgccaaccttattactgtcatcagtacttttagttacgtcgaccttcggccaagggcacgactggacgtacttaaacgactggtaggctcg

SEQ ID NO: 224020 - DNA, 551 bp, Homo sapiens
  misc_feature: GYAE6OF02GM6NT.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgccttccgagtccatctctcggggtcccctgaggttcagtggcaggtggatcgtgggacagtatttccacccctcaccatcaatacgcctaggaacgctaggaagatgctgaccaaccttattactgtcatctaagttacttttagttacgtcgtacctttacggcctaagggaccacgtacgtaggaagtaacttaaaccggaacttggtggtaccgtcg

SEQ ID NO: 224021 - DNA, 535 bp, Homo sapiens
  misc_feature: GYAE6OF02IFY4E.48.30.C08.1.454.CMB.1.raw
  modified_base (298)..(298): a, c, t, g, unknown or other
  misc_feature (298)..(298): n is a, c, g, or t
  modified_base (381)..(381): a, c, t, g, unknown or other
  misc_feature (381)..(381): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccagagcattcgtggtattacactggtaccagcagaaaaccngatcagtctaccaaagctcctcatcaagtatgcttccgagtccatctcgtcggggtcccctgaggttcagtgcaggtgatcgngggacagtactttccaccctcacatcaatcgcctggaanctagaantgctgacctaactatactgtcatcagttacttttagttaccgcggtaccttcggacctaagggccaacgtacgtggaactaacgttaaacgaacgttgacggtctacg

SEQ ID NO: 224022 - DNA, 548 bp, Homo sapiens
  misc_feature: GYAE6OF02GRUJR.48.30.C08.1.454.CMB.1.raw
  modified_base (331)..(331): a, c, t, g, unknown or other
  misc_feature (331)..(331): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccagagcattcgtggtagtttacactggtaccagcagaaaccagatcagtcctaccaaagcctcctcatcaagtntgcttccgatccatcctcgtcgggtcccctgaggttcagtggcagtggatcgtgggacagtatttccaccctcaccatcaatacgcctaggaanctagaagntgctgacctaaccttattactgtcatctagttacttttagttaccgtcggtaccttcgggaccgtaagggaccacggtactaggacgtaacgttaaaccgactggtacggctacg

SEQ ID NO: 224023 - DNA, 530 bp, Homo sapiens
  misc_feature: GYAE6OF02HJ3R7.48.30.C08.1.454.CMB.1.raw
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagttacactggtaccagcagaaaccagatcagtctccaaagctcctcatcaagtatgcttccgagtccatctcgtcggggtcccctgaggttcagtggcagtggatcgtgggacagtactttccaccctcaccatacaatacgcctaggaanctagaagntgctgctaaccttatactgtcatcagtacttttagttacgtcggtaccttcggccaagggacacgtacgtaggataacttaaacgactggtggctcg

SEQ ID NO: 224024 - DNA, 517 bp, Homo sapiens
  misc_feature: GYAE6OF02IWW3H.48.30.C08.1.454.CMB.1.raw
  modified_base (370)..(370): a, c, t, g, unknown or other
  misc_feature (370)..(370): n is a, c, g, or t
  modified_base (426)..(426): a, c, t, g, unknown or other
  misc_feature (426)..(426): n is a, c, g, or t
  modified_base (514)..(514): a, c, t, g, unknown or other
  misc_feature (514)..(514): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgaatccaaaggagaaagtcaccatcacctgccgggcagccagagcattcgtggtagtttacactggtaccagcagaaaccagatcagtctccaaagctcctcatcaagtatgcttccgagtccatctcgtcgggtccctcgagttcagtgcngtggatcgtgggacagatttccaccctcaccatcaatagcctggaacgctagaagntgctgccaacctattactgtcatcagtacttttagttacgtcgtaccttcggacctaagggacacgactggacgtataacgatgtggntcg

SEQ ID NO: 224025 - DNA, 534 bp, Homo sapiens
  misc_feature: GYAE6OF02I6A2Y.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctcgaggttccagtggcaggtggatcgtgggacagtactttccacccctcaccataccaatacgcctaggaagctagaagatgctagaccaaccttattactgtcatcagttacttttagttacgtcgtaccttcggcctaaggcacgacgtaggagacttaaaccgatgtcgctcg

SEQ ID NO: 224026 - DNA, 603 bp, Homo sapiens
  misc_feature: GYAE6OF02H19Y4.48.30.C08.1.454.CMB.1.raw
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctggttccagcctccagggtgaattgtgctgactcattccccagactttcagtcgtgtgactccaaaggagaaagtcacatcactgccggccagccagngcattcgtgtatttacactggtaccagcagaaaccngatcagtctaccaaagctcctcatccaagtntgccttaccgagtcccattcctacgtcggggttcccctggacggttcaggtggcaggtggatcgtggacagtactttccaccctcaaccatacaatcgccgtaggaacgctagaagtatgcctagaccctaaacttactttaacgtcgtacctaacgttccgtaagttaaccgttttttacgttaccgttcggtaccccgtttacgggaaccgtaacgggaccaaccggtacgtagggaacgttaacgttaaaccggtaacgttggtacggccttacgg

SEQ ID NO: 224027 - DNA, 513 bp, Homo sapiens
  misc_feature: GYAE6OF02GBFTK.48.30.C08.1.454.CMB.1.raw
  modified_base (420)..(420): a, c, t, g, unknown or other
  misc_feature (420)..(420): n is a, c, g, or t
  modified_base (510)..(510): a, c, t, g, unknown or other
  misc_feature (510)..(510): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctgaggttcagtggcagtggatctgggacagtatttccaccctcaccatcaatagcctggaanctagaagatgctgactaacctattactgtcatcagtacttttagttacgtcgaccttcggccaaggtcacgctgacgataacgatggtgntcg

SEQ ID NO: 224028 - DNA, 528 bp, Homo sapiens
  misc_feature: GYAE6OF02IDKKL.48.30.C08.1.454.CMB.1.raw
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcatcccagactttcagtctgtgactccaaaggagaaagtcaccatcacctgccgggccagccagagcattcgtggtagtttacactggtaccagcagaaaaccagatacagtctaccaaagctcctcatcaagtatgcttccgagtccatctctcggggtccctgaggttcagtgcagtgatcgnggganagatttcaccctcaccatcaatgctagganctgaantgctgacctaaccttnttactgtgattacagttaacttttagttaccgtcgtaccttacggccaagggacacggacgtaggatacgttaaaccgatggttggctacg

SEQ ID NO: 224029 - DNA, 523 bp, Homo sapiens
  misc_feature: GYAE6OF02INZS7.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtactccaaagctcctcatcaagtatgcttccgagtccatctctcggggtccctgagttcagtgcagtggatcgtgggacagtatttccaccctcaccatcaatacgcctaggaagctagaagatgctgaccaaccttattactgtcatcagtacttttagttacgtcggtaccttcggctaacggcacgactaggataacgttaacgactgtgctcg

SEQ ID NO: 224030 - DNA, 562 bp, Homo sapiens
  misc_feature: GYAE6OF02GVFJL.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccagggtgaaattgtgctgactcattccccagactttcagtctgtgactccaaaggagaaagtcaccatcacctgccggccagccagagcattcgtggtatttacactggtaccagcaagaaaccagatcagtctccaaagctcctcatcaagtatgcttcgagtccatctctcggggtccctgagttcagtggcagtgatcgtgggactagtactttcaccctcacctatacaactacgccgtaggaacgcgtagaagagtgctacgacctaaccttattactgtactattcagttacgtttttagttaccgttaccgtacctttccgggacctaagggtacctaacggacgtacggaagtaacgttaaacgacgttggtacgtctacg

SEQ ID NO: 224031 - DNA, 531 bp, Homo sapiens
  misc_feature: GYAE6OF02JDR2C.48.30.C08.1.454.CMB.1.raw
  modified_base (327)..(327): a, c, t, g, unknown or other
  misc_feature (327)..(327): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccagagcattcgtgtagtttacactggtaccagcagaaaccagatcagtctccaaagctcctcatcaagtntgcttccgagtccatctctcgggtccctcgagttcagtggcagtggatctgggacagtactttccaccctcaccataccaatagcctggaagctgaagntnctgctaacctattactgtcatcagttacttttagttaccgtcgtaccttcggaccgtaaggacacgtactaggacgtaattaaaccggactggtacggctacg

SEQ ID NO: 224032 - DNA, 692 bp, Homo sapiens
  misc_feature: GYAE6OF02FHFB8.48.30.C08.1.454.CMB.1.raw
  modified_base (530)..(530): a, c, t, g, unknown or other
  misc_feature (530)..(530): n is a, c, g, or t
tcagagtatacatacacgaccggtgctcgatttagtctgacgtcaaagggaagggggtatcttaaaagaggttctttctctgggatgtggcatgagacaaaactgacaagtcaaggcgaggaagatgttgccatcacaactctagttgggtttctgctgctcgttgggttccacgccctccgaggggtagtaaattggtgctgactcacttccccagtactttcagtctgtgacctaccgaaaggagaaacgtccaccatccaccgtcggcccggggccacgccgagacgctacgttcggttaggttacgttttaaccacgttacggtaaccacgacgaacgaaacccgagactacacgttcctaaccaaagtccttcctacactactaaagtactcgtccttaccggacgtacccattcctccggtccgggggttcccctcggtacggtttcaggtcggacgtaggtggtactcggtacgggactagtactttccacccctaccaccactacaactacgccgtaggacncgttagaacgtatcgtctcgacctaacttacttacttcgtactactcgtaacgtttacgttttacgttaccgtaccggtaccgttaccggaaccggaacgggaacctaccggtacggtacggtaacgtaacgttaaaccgtacgtcggtacggtactaccgg

SEQ ID NO: 224033 - DNA, 551 bp, Homo sapiens
  misc_feature: GYAE6OF02HURG5.48.30.C08.1.454.CMB.1.raw
  modified_base (299)..(299): a, c, t, g, unknown or other
  misc_feature (299)..(299): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccagagcattcgtggtagtttacactggtaccagcagaaaccngatcagtctccaaagcctcctcatcaagtatgccttccgagtccatcctcgtcggggtcccctggaggttcaggtcgcaggtggatcgtgggacagtactttccacccctcaccatcaatacgcctaggaatctagaagatgctgacctaacctattactgtcatcagtactttttagtaccgtcgtaccttcggaccgaagggacaacgtacgtagggaactactttaaaaccggagttggtaggctacgg

SEQ ID NO: 224034 - DNA, 539 bp, Homo sapiens
  misc_feature: GYAE6OF02FVZFH.48.30.C08.1.454.CMB.1.raw
  modified_base (422)..(422): a, c, t, g, unknown or other
  misc_feature (422)..(422): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctcgtcggggtcccctgaggttcagtgcagtggatcgtgggacagtatttccaccctcaccatcaatacgcctggaanctagaagatgctgacctaactattactgtacatcagttacttttagttaccgtcggtaccgttcggacctaagggacacgactaggagtaacttaaaccggaactcggtaggctacg

SEQ ID NO: 224035 - DNA, 523 bp, Homo sapiens
  misc_feature: GYAE6OF02ISNSO.48.30.C08.1.454.CMB.1.raw
  modified_base (326)..(326): a, c, t, g, unknown or other
  misc_feature (326)..(326): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (518)..(518): a, c, t, g, unknown or other
  misc_feature (518)..(518): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccagggtgaaattgtgctgactcattccccagactttcagtctgtgactccaaaggagaaagtcaccatcacctgccggcagccagagcattcgtggtagtttacactggtaccagcagaaaccagatcagtctccaaagctcctcatcaagtntgcttccgagtccatctctcggggtccctgaggttcagtgcagtggatcgtgggacagattcaccctcaccatcaatacgcctggaanctagaagntgctgctaacctattactgtcattccattacgtttagttacgtcgtaccttcggcctaagggcaacgactggacgtacttaaacgactggtacggntacgg

SEQ ID NO: 224036 - DNA, 656 bp, Homo sapiens
  misc_feature: GYAE6OF02G4NSN.48.30.C08.1.454.CMB.1.raw
  modified_base (176)..(176): a, c, t, g, unknown or other
  misc_feature (176)..(176): n is a, c, g, or t
tcagagtatacatacacgaccggtgctcgatttagtctgacgtcaaagggaaaggggtatcttaaaagggaggttactttctctgggattggtcggcagtacgagcgaaaaactccgacaagtcaaagggcctaggaacgtacttcgttgccatcacgaactccattgggtttccnggctagtcttcgttgggttccagcctccagggtgaacttcgtgcttgactcggaattcccagacctttcacgtctgtggacctccaaaggactaagtcaccaatctaccgtcgccgggaccaagaccgaagacgcgacttcggtcggttacgttacgactcggtaccagcagaaccagactcagtaccgtccaaacgcgtcctcactcaacgtacttgacgttccggacgtccgtagtctcgtcggggtaccctcgtacgtcagtcgcagtgactcgtcggacacgtactttcgaccttctactactacttaatacgtacgtaggaacgtacctaggaacgtagtcgctacgactaactttacttactcgtacgtacgtaccaagttacgtttacgttacgttaccgtaaccgtttacgaaccggtacggtacacgacgtacggactaacgttaacgtacgttacggtactccgttaccg

SEQ ID NO: 224037 - DNA, 540 bp, Homo sapiens
  misc_feature: GYAE6OF02HX6OW.48.30.C08.1.454.CMB.1.raw
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaattgtgctgactcattccccagactttcagtctgtgactccaaaggagaaagtcaccatcacctgccggccagccagagcattcgtggtagttacactggtaccagcagaaaccagatcagtctaccaaagctcctcatcaagtatgcttccgagtccatctcgtggggtccctggagttcagtgcagtgatcgtgggacngtatttcaccctnacatcaatcgcctaggatctagaagntgactgacctaactattactgtcattcagttactttttagttaccgtcggtacctttcgggaccctaagggaccaacggacgtagggaactagttaaaccgaacgtcggtggactacg

SEQ ID NO: 224038 - DNA, 629 bp, Homo sapiens
  misc_feature: GYAE6OF02J24WR.48.30.C08.1.454.CMB.1.raw
  modified_base (228)..(228): a, c, t, g, unknown or other
  misc_feature (228)..(228): n is a, c, g, or t
tcagagtatacatacacgaccggtgctcgatttagtctgacgtcaaagggaaggggtatcttaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaagganaaagtcaccatcacctgccgggccagccagagcattcgtggtagtttacactggtaccagcagaaccagatcagtctccaaagctcctcatcaagtatgcttccgagtccatctctggggtcccctcgaggttcagtggacaggtcggatccgtggggacaggtacttttccgaaccctcacccattaccaaattacggcccttagggaaacgccttagaaagtactggccttaggaccaaacccttatttacccgtggtacctaatcgtaagtaccgttttttagttaaccggttccggtaccttttaccggggaccctaaacggggtacctaaccgggtaccgttacgggtaacgttacgtttaaaaccggaaccggtttacggtacggtacctaccgg

SEQ ID NO: 224039 - DNA, 636 bp, Homo sapiens
  misc_feature: GYAE6OF02G4QLC.48.30.C08.1.454.CMB.1.raw
  modified_base (503)..(503): a, c, t, g, unknown or other
  misc_feature (503)..(503): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccagagcattcgtggtagtttacactggtaccagcaagaaccagatcagtctaccaagctcctcatacaagtatgctccgagtccatctcgtcgggtccctcgacggttcagtggcaggtggtactacgtggggaactacggtacttttcccgaaccccctcgaccctaattaccaaattacggcccgttagggaaagtccgttagaaaggacttcggccttcggaacctaaacccttagtttaccngttacctaacttcgtaacgtttaaacttttttcggttaccggtccggttacccgtttacgggacccgtaaacggggacctaaccgtacgttagggaacgtaaactttaaaccggaaccgtggtcggactaccg

SEQ ID NO: 224040 - DNA, 523 bp, Homo sapiens
  misc_feature: GYAE6OF02GMFEM.48.30.C08.1.454.CMB.1.raw
  modified_base (378)..(378): a, c, t, g, unknown or other
  misc_feature (378)..(378): n is a, c, g, or t
  modified_base (421)..(421): a, c, t, g, unknown or other
  misc_feature (421)..(421): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcgggtccctgagttcagtgcagtggatcgngggacagtactttccaccctcaccatacaatacgcctaggaanctagaagatgctgactaaccttattactgtcatcagtacttttagttacgtcgtaccttcggctaagggacacgactggatagttaacgactggtcgctacg

SEQ ID NO: 224041 - DNA, 571 bp, Homo sapiens
  misc_feature: GYAE6OF02JZCQE.48.30.C08.1.454.CMB.1.raw
  modified_base (180)..(180): a, c, t, g, unknown or other
  misc_feature (180)..(180): n is a, c, g, or t
  modified_base (328)..(328): a, c, t, g, unknown or other
  misc_feature (328)..(328): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (565)..(565): a, c, t, g, unknown or other
  misc_feature (565)..(565): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccagggtnaattgtgctgactcattccccagtactttcagtctgtgactccaaaggagaaagtcacatcacctgccggcagccagagcattcgtggtattacacgtggtaccagcaagaaccagatcagtcctaccaaagcctcctacatcaagtntcgcttccgagtccatctcgtcggggtcccctggtaggttcagtcggctaggtcggntcgnggggaccagtactttccaccctcacctatacaatacgccgtaggaatctagacgatcgactgactaactacttactgtactatcgtaagtttacttttacgttaccggtccgtaccgttccggaacgaacggtacaacggtacgtaggtaacgtaacgttaaaccgagtggtacgngtaccg

SEQ ID NO: 224042 - DNA, 529 bp, Homo sapiens
  misc_feature: GYAE6OF02F4SU4.48.30.C08.1.454.CMB.1.raw
  modified_base (380)..(380): a, c, t, g, unknown or other
  misc_feature (380)..(380): n is a, c, g, or t
  modified_base (419)..(419): a, c, t, g, unknown or other
  misc_feature (419)..(419): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctgaggttcagtgcagtgatcgngggacagatttcaccctcaccatcaatagcctaggaacnctagaagatgctgccaacttattactgtcatcagtacttttagttacgtccggtaccttcggaccaagggaccacgtacgtggagtacgttaaaccgatggtggctacgg

SEQ ID NO: 224043 - DNA, 538 bp, Homo sapiens
  misc_feature: GYAE6OF02IB4OA.48.30.C08.1.454.CMB.1.raw
  modified_base (370)..(370): a, c, t, g, unknown or other
  misc_feature (370)..(370): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcaagaaaccagatcagtctaccaagcctcctcatcaagtatgcttcgatccatctcgtcgggtcccctgagtcagtgcngtgatcgtgggacagtactttccaccctcaccatcaatcgcctaggaagctagaagtatggactgaccaaccttattactgtcatctagtacttttagttacgtcgtaccttcggacgaagggcaacgtactggtaactaacgttaaaccggacttggtacggctacg

SEQ ID NO: 224044 - DNA, 546 bp, Homo sapiens
  misc_feature: GYAE6OF02GI9SH.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctcggaggttcagtggcagtggatctgggacaggtatttccaccctcacccatacaatacgcctggaacgctagaagatgctgacaaccttattactgtcatctacgtactttttagttacgtcgtaccttcggacccaagggtccaacggactggaagtaacgttaaaccggacttggtacgtctacg

SEQ ID NO: 224045 - DNA, 676 bp, Homo sapiens
  misc_feature: GYAE6OF02IXN0Q.48.30.C08.1.454.CMB.1.raw
  modified_base (230)..(230): a, c, t, g, unknown or other
  misc_feature (230)..(230): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccagggtgaaattgtgctgactcattccccagactttcagtctgtgactccaaagganaaagtcaccatcacctgccgggcagccagagcattcgtggtagtttacactggtaccagcaagaaaccagactcagtctaccaaagctcctcatccaagttatcgtcttcgagtccatctcgtcgggtccctgacgttcagtgcagtggatcgtgggactagtatttccaccctcaaccctatacaaatacgacccgttagggaaactcgttaacggaaagtacgttcgccttacggacccttaaaaccctttagtttaaaccgttcgtttaccaacgtttaccgtaaacgttttaaccgtttttttaaccggtttaacccgggttacccgggttaaccccgttttaccggggaaccccgtaaacgggggtaaccctaaacgggtaacgtacgggaaacggtttaacgttaaaaccggaaccgttgggtttaccggacgttaccgg

SEQ ID NO: 224046 - DNA, 566 bp, Homo sapiens
  misc_feature: GYAE6OF02HKDVS.48.30.C08.1.454.CMB.1.raw
  modified_base (325)..(325): a, c, t, g, unknown or other
  misc_feature (325)..(325): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtatttacactggtaccagcaagaaaccagactcagtcctaccaaagcctcctnactacaagtatgccttccgagtccatctcgtgggtcccctgagttcagtggcagtgatcgtggacagtattcaccctcaccatcaatagcccgtggaacgctagaagatcgctcgacctaactattactgtactactctaagttacttttacgttacgttccgtaccgtttccggaaccgtaacgggaccgtaacgacgtaggaacgtaaacgttaaaccgtaacgttaggtggacgtacg

SEQ ID NO: 224047 - DNA, 565 bp, Homo sapiens
  misc_feature: GYAE6OF02G3281.48.30.C08.1.454.CMB.1.raw
  modified_base (262)..(262): a, c, t, g, unknown or other
  misc_feature (262)..(262): n is a, c, g, or t
  modified_base (308)..(308): a, c, t, g, unknown or other
  misc_feature (308)..(308): n is a, c, g, or t
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccagancattcgtggtagttacactggtaccagcaagaaaccagatcagtcnccaaagcctcctcatcaagtatgcttcgagtccatctcgtcgggtcccctgagttcagtggcaggtgatcgngggacagtacttaccaccctcacctatacaactacgccgtaggacgctagaagntagctgaccaaccttatactgtcatcctagttaacttttagttaccgtcggttacccgttcggtacccgaagggtaccaaccggtacgtacggaacgtaacgttaaaccgaacgttggtacggtctaccgg

SEQ ID NO: 224048 - DNA, 549 bp, Homo sapiens
  misc_feature: GYAE6OF02GESPR.48.30.C08.1.454.CMB.1.raw
  modified_base (330)..(330): a, c, t, g, unknown or other
  misc_feature (330)..(330): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactcaaaggagaagtcaccatcacctgccgggccagccagagcattcgtggtagtttacactggtaccagcaagaaaccagatcagtcctacaaagcctcctcatcaagtntgcttccgagtccatcctcgtcggtcccctgagttcagtggcaggtgatcgtgggacagtctttccaccctcaccataccaatacgcctaggaacgctagaagatcgctcgactaacctattactgtacatacgtattacgttttagttaccgtcggtacccttcggaccgtaacggaccacggtacgtaggaagttactaaacgactggtacgctacg

SEQ ID NO: 224049 - DNA, 539 bp, Homo sapiens
  misc_feature: GYAE6OF02FPONX.48.30.C08.1.454.CMB.1.raw
  modified_base (391)..(391): a, c, t, g, unknown or other
  misc_feature (391)..(391): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctcgaggttcagtggcagtggatcgtgggacagntttccaccctcaccatccaatacgcctggaacgctagaagatgctgcctaaccttattactgtcatcagtacttttagttacgtcgtaccttcggaccgaagggacacgacgtaggacgtaacgttaaaccgactggtacggctacgg

SEQ ID NO: 224050 - DNA, 674 bp, Homo sapiens
  misc_feature: GYAE6OF02GZ9HY.48.30.C08.1.454.CMB.1.raw
  modified_base (326)..(326): a, c, t, g, unknown or other
  misc_feature (326)..(326): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaattgtgctgactcattccccagactttcagtctgtgactccaaaggagaaagtcaccatcacctgccggccagccagagcattcgtggtagttacactggtaccagcagaaaccagatcagtcaccaaagctcctcatcaagtntgcttcgagtccatcctcgtcggggtccctggtacgttcagtcggcaggtggacttcgtagggacacggtactttaccgaccctccaacctatacaaagttacgcccgtagggaaacgtccgttaaggaagtagtacgccttacggaaccctaaacccgtttaatttaccgtgttacctaagttaccgttaaacgtttaaccgttttttaacggtttacccggtttaccgggttaaccccggttttaccgggaaccccggtaaacggggtaccgtaacccggtaacggttacggggtaaacgttaaccgtttaaaaccggaaccggtttcggtacggtacgtacccgg

SEQ ID NO: 224051 - DNA, 594 bp, Homo sapiens
  misc_feature: GYAE6OF02FQ3S5.48.30.C08.1.454.CMB.1.raw
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaaagtatgcttccgagtcccattcctcgtcggggtcccctcggaggttcaggtggcaggtggatcgtgggacagtactttccaccctcacccatacaaatacgcccttgggaacncgtagaagtntgcctcgacctaaccgttactttactacgttcactctaacgttacttttaacggtttaccgtccggtaccgttccggaaccgaacgggtacctaacggtaccgtaggtaacgtaacgttaaaccggacgttggtacggtctacgg

SEQ ID NO: 224052 - DNA, 506 bp, Homo sapiens
  misc_feature: GYAE6OF02FJ5UT.48.30.C08.1.454.CMB.1.raw
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (489)..(489): a, c, t, g, unknown or other
  misc_feature (489)..(489): n is a, c, g, or t
tcagagtatacatacacgaccggtgctcgatttagtctgacgtcaaagggaaagggggtatcttaaaagaggttctttctctgggatgtggcatgagcaaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtccctcgaggttcagtgcagtgatctgggacagatttcaccctcaccatcaatgcctggaanctgaagntgctgcaacttatactgtcatcagtacttttagttacgtcgacttcggccaagggcacgactgganagttaaacatgtgctcg

SEQ ID NO: 224053 - DNA, 733 bp, Homo sapiens
  misc_feature: GYAE6OF02IGG8U.48.30.C08.1.454.CMB.1.raw
  modified_base (313)..(313): a, c, t, g, unknown or other
  misc_feature (313)..(313): n is a, c, g, or t
tcagagtatacatacacgaccggtgctcgatttagtctgacgtcaaagggaaagggggtagtcttaaaagaggttctttctctgggatgtggcatgagcaaaactgacaagtcaaggcaggaagatgttgccatcacaactcattggtttctgctgctctgggtccagcctccgaggggtgaaattgtgctgactcattccccagactttcgagtctgtgactccgaaaggtagaaagtcaccatcacctggccggccagccagacgctattcggtggttaacgtttacacgtggtaccagtcaagaaacccngtatcgtagtcctaccgaaagtcctacctcgaactacgaaagttcttcggccttacccggtagtacccaagttcccgttaccggttcgggggttacccccctagggttaacggttaccgtaggttacggggacctaaaggggtcggtaacggtcgttaacggggaacgtacggttacctttacccgaccccttaccgtaaccctacgtactaacgtacggtccgtaacggaacgtcgttaagaaccggtattcgccgttacgaccgtaaaccttagtttaaccgtaggtacctagttaaccgtaagtttaaccgttttaacgttaccggtacccggtaccgtttacccggaccgtaaaccgggtacgtaccgtaacggttagaacgtaacgttaaaccgagttacgtacgggacttacgg

SEQ ID NO: 224054 - DNA, 589 bp, Homo sapiens
  misc_feature: GYAE6OF02FJ1AA.48.30.C08.1.454.CMB.1.raw
  modified_base (330)..(330): a, c, t, g, unknown or other
  misc_feature (330)..(330): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctaccaaagctcctcatcaagtntgccttcgagtccatctcgtcgggttcccctgacggttcagtgcaggtcgatcgtggacgagtattctaccctacaccactactaactacgaccgtacggaacgctagaagatgctcgacctaaccttacttacttgtacccccccctatactacgttacttttacgtttacgttaccggtaccgttacggtacccggtaacggtacgtaacgtacgtaggacgtaacgttaaaccgtaacgtacggtcggtacgtacg

SEQ ID NO: 224055 - DNA, 596 bp, Homo sapiens
  misc_feature: GYAE6OF02IPOBS.48.30.C08.1.454.CMB.1.raw
  modified_base (182)..(182): a, c, t, g, unknown or other
  misc_feature (182)..(182): n is a, c, g, or t
  modified_base (327)..(327): a, c, t, g, unknown or other
  misc_feature (327)..(327): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggttttctgctgctctgggttccagcctccaggggtnaaattgtgctgactcattccccagactttcagtctgtgactccaaaggagaaagtcaccatcacctgccggccagccagagctattcgtggtagtttacactggtaccagcaacgaaaccagatcagtcctaccaaagcctcctnatcaagtatgccttccgagtccatcctcgtcggggtccctggtacgttcagtgcgagtggatcgtggactagtacttccaccctcacactacaatacgccgtaggaacgcgtagaagtctgctgacctaaccttattactcgtacacttacgtactttaacgttttacgtttaccgtaccggtacccgttacgggaaccgtaacgggacctaaccggtaaccgttaggtaacgtaacgttaaaccggacgttacggtacggacgtacgg

SEQ ID NO: 224056 - DNA, 603 bp, Homo sapiens
  misc_feature: GYAE6OF02GAKWU.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtatttacactggtaccagcacgaaaccagatcagtcctaccaaacgctcctcatacaagttatgccttcgacgtccatcctcgtccggggttcccctcggtacggttcaggtcggctaggtggacttcgtcggggtactaggtactttaccacccctcaccctatactaactacgaccgtaggaagcgttagaaagctcgtctacgactaaccttattacctgtactaagtctacgtttacttttacgttaccgtccggtaccgttcggaaccgtaaggtaaccgacgtaacgtggaacgttaacgtaaaccgtagtacggtaggcctacg

SEQ ID NO: 224057 - DNA, 515 bp, Homo sapiens
  misc_feature: GYAE6OF02IJ3FT.48.30.C08.1.454.CMB.1.raw
  modified_base (421)..(421): a, c, t, g, unknown or other
  misc_feature (421)..(421): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcgggtccctgagttcagtgcagtgatcgtggacagatttcaccctcaccatcaatagcctaggaacgctgaanatgctgacaacctatactgtcatcagtacttttagttacgcgtaccttcggcctaagggacaacgacgtggacgaattaaacgaactgtgctcg

SEQ ID NO: 224058 - DNA, 696 bp, Homo sapiens
  misc_feature: GYAE6OF02H3HZG.48.30.C08.1.454.CMB.1.raw
  modified_base (300)..(300): a, c, t, g, unknown or other
  misc_feature (300)..(300): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctcgccgggccagccagagcattcgtggtattacactggtaccagacagaaaccngatcacgtcaccaaagcctcctcatacaagtactgccttaccgagtcccattctcgtcgggtcccctggtaggttcaggtcgctaggtgatcgtggactagtactttccgaccctcaactactacgaactgaccgtaggaacgtacgtagaagtactggacctagaacccgtaaaccttagttaacccttagttacctacgtttccgtaaagtttaacccgtttttttaacgggtttaacccgggttacccggttaaccccggttttaccggggaaccccggttaaaccgggggtaacccgtaaacccgggttaacggttaccgggtttaaacgtaaacggttttaaaaacccggtaacccgggttacgggtttaccggggtacccttaacccggg

SEQ ID NO: 224059 - DNA, 607 bp, Homo sapiens
  misc_feature: GYAE6OF02F17XQ.48.30.C08.1.454.CMB.1.raw
  modified_base (330)..(330): a, c, t, g, unknown or other
  misc_feature (330)..(330): n is a, c, g, or t
  modified_base (452)..(452): a, c, t, g, unknown or other
  misc_feature (452)..(452): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattggggtttctgctgctctgggttccagcctccaggggtgaaattgtgctgactcattccccagactttcagtctgtgactccaaaggagaagtcaccatcactgccggcagccagagctattcgtggtatttacacgtcggtaccagcaagaaaccagatcagtctaccaagctcctcatacaagtntcgtcttccgacgtccatctccgtcgggtcccctcggtacggttcagtggctaggtggactcgtggactagtactttccaccctcacctatacaatacgccgtaggtaactcgtagtaaagntcgtactcgacctaaccttaattacttcgtactattccgtaatttaccgttttagttaccggtccggtaacccgttccggaaccgtaaggtacccaacggtacgtagggtaaacttaacggttaaaaccggaacgttacggtacggtaccgtacg

SEQ ID NO: 224060 - DNA, 633 bp, Homo sapiens
  misc_feature: GYAE6OF02G1IHY.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagtactttcagtctgtgactccaaaggagaagtcaccatcacctgccgggccagccagagcattcgtggtatttacactggtaccagcagaaaccagatcagtctccaaagcctcctcactcaagtatgcttcgagtccatctcgtcgggtccctcgagttcgagtggcaggtggatcgtggggactacgtactttccacccctcgaaccctactactaaagtacgtacccgtaggaaacgtctaggaagatcgacctagacccgtaaaccttatttaccgtagttaccaattccaacgtttaccgtttttagtttacccggtaccggttaccggtttacccgggacccggtaaagggacccgtaaccggtaacgttacgggaacgttaacggttaaaacccggtaagttacgggtaggaccgttaccgg

SEQ ID NO: 224061 - DNA, 556 bp, Homo sapiens
  misc_feature: GYAE6OF02I5C1Y.48.30.C08.1.454.CMB.1.raw
  modified_base (233)..(233): a, c, t, g, unknown or other
  misc_feature (233)..(233): n is a, c, g, or t
  modified_base (317)..(317): a, c, t, g, unknown or other
  misc_feature (317)..(317): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
  modified_base (423)..(423): a, c, t, g, unknown or other
  misc_feature (423)..(423): n is a, c, g, or t
  modified_base (447)..(447): a, c, t, g, unknown or other
  misc_feature (447)..(447): n is a, c, g, or t
tcagagtatacatacacgaccggtgctcgatttagtctgacgtcaaagggaaagggggtatcttaaaagaggttctttctctgggatgtggcatgagcaaaaactgacaagtcaaggcaggaagatgttgccatcacaactcattgggtttctgctgctctgggttccagcctccaggggtgaaattgtgctgactcattccccagacctttcagtctgtgactccaaagganaaagtcaccatcacctgccggccagccagagcattcgtggtagtttacactggtaccagcaagaaaccagatcagtcaccaaancctcctcatcaagtatgacttccgatccatctcgtcggtccctgaggttcagtgcngtgatcgtggacagtcttccaccctnaccatcaaatcgaccgtaggaacnctagaagatgacctgactaacctnttactgttcattcaagttacttttaagtaccgtccgtaccgttccggaaccgaacgggtaactaccggtaactggtaagtaaccgttaaacgacgttggaggtctaacg

SEQ ID NO: 224062 - DNA, 617 bp, Homo sapiens
  misc_feature: GYAE6OF02FWXFI.48.30.C08.1.454.CMB.1.raw
  modified_base (261)..(261): a, c, t, g, unknown or other
  misc_feature (261)..(261): n is a, c, g, or t
  modified_base (328)..(328): a, c, t, g, unknown or other
  misc_feature (328)..(328): n is a, c, g, or t
  modified_base (405)..(405): a, c, t, g, unknown or other
  misc_feature (405)..(405): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggcagccagancattcgtggtagtttacactggtaccagcagaaaccagatcagtctaccaaagctcctcatcaagtntgcttccgagtccatctcgtcgggtcccctgagttcagtgctaggtggatcgtagggacagtactttccaccccttnacccataccaaatacgcccttaggaacgctagaaagtatggacctgaccctaaaccgttattaaccgtgtacctattccaagttttaacctttttaggtttaccgttccgggtaccgtttacccgggtaaccgtaaacggggtacctaaaccggtaccgttaagggtaacgtaaacggtttaaaaccggaacgttcggtacggaccttacgg

SEQ ID NO: 224063 - DNA, 570 bp, Homo sapiens
  misc_feature: GYAE6OF02F0FKB.48.30.C08.1.454.CMB.1.raw
  modified_base (440)..(440): a, c, t, g, unknown or other
  misc_feature (440)..(440): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcattccccagactttcagtctgtgactaccaaaggagaaagtcacatcacctgccggccagccagagcattcgtgtagtttacactggtaccagcaagaaaccagatcagtctaccaaagcctcctcatacaagtatgcttccgagtccatcctcgtcgggtccctcggtagttcagtgcaggtggatcgagggacagtactttccaccctcaccatacaatcgcctaggaacgtcgtagaagntgactcgacctaacctagttactgtacactactacgttactttttacggttaccgtccggtaccgtacggaccgtaagggtaccctacggtacgtaggaacgtaacgttaaacgacgttggtacgctacg

SEQ ID NO: 224064 - DNA, 630 bp, Homo sapiens
  misc_feature: GYAE6OF02HKE0P.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagactcagtcctaccaaagcctcctcatcaaagtatgccttccgagtccatcctcgtcggggtcccctggtacggttcaggtcggctagtggatcgtagggaactagtactttccgacccctcaacccattaccgaaattcgacccgtagggtaaacgtcgtaagaagtactggaccttgacctaacccttagttacctgtacaacttcgtacgttaacgtttttaacgttaccggttccggttaaccggtttcccggaccgtaagggtaccaaccggtacgtagggtaacgtaacgttaaaccggaacgttacgggtacggtactaccgg

SEQ ID NO: 224065 - DNA, 792 bp, Homo sapiens
  misc_feature: GYAE6OF02IQXIH.48.30.C08.1.454.CMB.1.raw
  modified_base (155)..(155): a, c, t, g, unknown or other
  misc_feature (155)..(155): n is a, c, g, or t
  modified_base (178)..(178): a, c, t, g, unknown or other
  misc_feature (178)..(178): n is a, c, g, or t
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
tcagagtatacatacacgaccggtgctcgatttagtctgacgtcaaagggaaaggggtatcttaaagaggttctttctctgggatgtggcatgagcaaaactgacaagtcaaggcaggaagatgttgccatcacaactcattggttctgctgctntggtccagctcagggtgaattgngctgactcacttccccagtactttcacgtctgtgactacaaaggtagaaacgtcaaccatcaccgtgccggacacgccagacgctagttcgtaggttacgttacncgtggtacctaggaccaaggaaacccngtaactcgtacgtacctaacccgaaagccttacccgtactaacgttacaaacggtttcncggttaccgttaccgtaaaccggttccccagttacccgttcccgggttaccggggggttaccccccctttaaagggtcccggggttttaactaccggggtttaccgggtacccgaaaggggttttccggggtaacgtttcccgggttaacgggggtaacctaacgggttaaccctttacccgtaaccccgtacccgtaacccttaacgtaccttaaacgtaccgtaccggttaacggaacggtcgtaacgtaacgtacttcgtacgtcgtaaacctaccgtttaacttaccgttacgttaccgtaacgttaccgtacgtttaacgttttacgtttaccggtacccgttacgttacccggaaccggttacgacccgtacgttacggtagtaacgtaacgtaaccgtacgtaggtcgtacgtacg

SEQ ID NO: 224066 - DNA, 586 bp, Homo sapiens
  misc_feature: GYAE6OF02H3ICP.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgagggtgaaattgtgctgactcattccccagactttcagtctgtgactccaaaggagaagtcaccatcactgccgggccagccagagcattcgtggtatttacacgtggtaccagacaagaaaccagactcaagtcctaccaaacgtcctcctacactacaagtatcgcttccgatccatctcgtcgggtccctggacgttcagtgcaggtgatcgagggacagtactttccaccctcaactatacaatacgtccgtaggaacgtctaggaacgtactcgtactacgacctaaacgttacttacctagtactatctaagttaccgtttttagttaccggtacgtaccgttcggaaccgtagggaactaaccggtacgtaggaactaacggttaaacgacgtggtcggctacg

SEQ ID NO: 224067 - DNA, 630 bp, Homo sapiens
  misc_feature: GYAE6OF02ID839.48.30.C08.1.454.CMB.1.raw
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagtactttcagtctgtgactccaaaggagaagtcaccatcactgccggccagccagagcattcgtggtagtttacactggtaccagcagaaaccngatcagtctaccaaagctcctcatcaagtntgcttccgagtccatctcgtcgggtccctgaggttcagtgcagtgatcgtgggacagtactttccaccctcacctatacaaatcgcctaggaacgtcgtagaaagtactggtactacggtacctaaaccttatttaccttcgtactaacttcgtaaacggtttaaccttttttaagggtttacccgttaccgggtttaccccgtttaccggggaacccgtaaacggggtaaccgtaaccggtaacgttacgggtaacggtaaacgtttaaaaccggaacggtttaggtaccggccttaccgg

SEQ ID NO: 224068 - DNA, 655 bp, Homo sapiens
  misc_feature: GYAE6OF02F0U56.48.30.C08.1.454.CMB.1.raw
  modified_base (229)..(229): a, c, t, g, unknown or other
  misc_feature (229)..(229): n is a, c, g, or t
  modified_base (451)..(451): a, c, t, g, unknown or other
  misc_feature (451)..(451): n is a, c, g, or t
tcagagtatacatacacgaccggtgctcgatttagtctgacgtcaaagggaaagggggtatcttaaaagaggttctttctctgggatgtggcatggagcaaaactgacaagtcaaggcaggaagatgttgccatcacaactcattgggtttctgctgctctgggttccagcctccagggtgaattgtgctgactcattccccagactttcagtctgtgactccaaaggngaaagtcaccatcaccgtgccgggccagccagagcattcgtgtagttacactgtaccagcagaaccagatcagtctccaaagcctctacatcaagtatgcttccgagtcccatctaccgtcggggttccccctggacggtttcaggtcgcacgtggactcgtgggaccaaggtactttaccaccccgtctaccgaattaccaaactacgccttagggaaacncgtacgtaagagtccgacgtgtaccgaaaccttagttaccgttgttaccgtaacttccgtaacgtttaacctttttacgggtttaaccgttcccggtaacccgtttaccggggacccgtaaaacgggtacccgtaacggtacccgttagggtaacggtaaccgttttaaaaccggaactttcgggttacggaccgttaaccggg

SEQ ID NO: 224069 - DNA, 719 bp, Homo sapiens
  misc_feature: GYAE6OF02H2MMW.48.30.C08.1.454.CMB.1.raw
  modified_base (212)..(212): a, c, t, g, unknown or other
  misc_feature (212)..(212): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcgaggggtgaaattgtgctgactcattccccagtactttnagtctgtcgactacaaaggagaagtcaccatcactgccgggccagccagagcattcgtggtagtttacncgtaggtaccagcaagaacngatcacgtctaccaaacgcctacctacacttacaagtactcgtccttccgacgtcctacttcgtacggttccgggggttacccccttcgggtacgggtttaccacgggttcgggaccgtaagggttcgggtactttcggtaggggacgtagtaacgttttcccaaccccttcaacctacgtaacaaacgttcggacgtagggaacgtccgtaggaaacggtactacggccgttaacgacccttaaaccgttattaaccgttcgtaactacttaacggtaactttaacggttttttacgtttaacccggtccggttaacccggtttccgggaaacccggaaacgggttacccgaaccggttaacgtagggtaaccggttaaacgtaaacccggttaacgttacggtcggtaccgtaccg

SEQ ID NO: 224070 - DNA, 647 bp, Homo sapiens
  misc_feature: GYAE6OF02JI78X.48.30.C08.1.454.CMB.1.raw
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (373)..(373): a, c, t, g, unknown or other
  misc_feature (373)..(373): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggttctgctgctctgggttccagcctccaggggtgaaattgtgctgactcattccccagtactttcagtctgtgacctccaaaggagaaagtcaccatcacctgcccgggccagccagagcattcgtgtacgttacnctggtaccagctagaaaccngatcagtcctaccaaagtcctcctcatcaatatcgcttccgagtccagtctacgtcgggtccctgtggtcnggtcgcagtgatcgtagggacagtacttccgaccctcgacctagtaccaactacggtacctacgggtaagtccgtaaggaacgtatccgactcgaacccttaacgttacttacgtacgtacctacttacgtacgtttaacgttttacggtttacccggtccggtttaacccgtacgggtaaccccggtaacggggtaacctacccggttaacggtacgggtaaacgttaacggtttaaccggtaaccggtttggtacccggtacgttaaccggg

SEQ ID NO: 224071 - DNA, 730 bp, Homo sapiens
  misc_feature: GYAE6OF02HMUKU.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagccctccaggggtgaaattgtgctgactctacttcccccagtactttcagtctgtgactaccaaaggagaaacgtcaaccatccacctcgccgggccacgccagagcattcgtggtacgttacactggtaccagcaagaaaccagatcagtcctaccaaagcctacctctaataccaagttactcgtccgttccgacgttacccacttccgtccggtccggggttcccctacggtacggttcgaggtcggtctaggtggacttcggtacgggactaggttactttacccacccctacaaccctatacctaaacgtcgcccgtaagggtaaccgtcgtaggaacgtagtcgaccgttacgaacctaaaccgtttacttaccgttgttaccgaagtttacccgttaaacggtttaaccgttttttaacggtttcccgggttaacccgggttacccgtttacccgggaaccccggtaaaggggtacccgtaaaccggtaccggttaagggtaaccgttaaacgttaaaacccggaacggtttacggttacggacccgttaaccgg

SEQ ID NO: 224072 - DNA, 648 bp, Homo sapiens
  misc_feature: GYAE6OF02HE6BY.48.30.C08.1.454.CMB.1.raw
  modified_base (437)..(437): a, c, t, g, unknown or other
  misc_feature (437)..(437): n is a, c, g, or t
  modified_base (500)..(500): a, c, t, g, unknown or other
  misc_feature (500)..(500): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccgaggggtgaaattgtgctgactcacttccccagtactttcagttctgtgactacgaaaggagaagtcacactcacctcgccggccagccagagctagttcggtaggttactttacacgtggtaaccagacaacgaaaccagactctacgtacctaccaaacgtcctacctacactactaagttatcgtaccttaccgactcccgtactccgttacggtccgggttcccctagtacggttcacgggtgacgtaggtgtctcggngggactgttacttacctacccgtactaccactacaacttgacctaggaactacgtagaaagtntcggcttacgacctaaaccttgtacctgtactatacgttagttacttttacggttcgtaccggtacgttccggtaaccggaaggtacctaaggtaccgtaaggtaaccggttaacgttaaacccgtacggtcgtacgggcccttacgg

SEQ ID NO: 224073 - DNA, 743 bp, Homo sapiens
  misc_feature: GYAE6OF02JH7IS.48.30.C08.1.454.CMB.1.raw
  modified_base (165)..(165): a, c, t, g, unknown or other
  misc_feature (165)..(165): n is a, c, g, or t
  modified_base (552)..(552): a, c, t, g, unknown or other
  misc_feature (552)..(552): n is a, c, g, or t
tcagagtatacatacacgaccggtgctcgatttagtctgacgtcaaagggaaaggggtagtcttaaagaggttctttctctgggatgtggcatgagcaaaactgacaagtcaaggcaggaagatgttgccatcacaactcattggttctgctgctctgggttccngcctccagggtgaattgtgctgactcacttccccagacctttcagtctgtgactccaaaggacgaaagtcaaccgatcacctggcccggcacgccagagcattcggtggttacgtttacacgtcggtaccagccaaggaaccagactcacgtactaccaaacgcctaccctacgaactacgaaagttactacgtccgtttaccccggagttcccaacttccgttacccgttccggggggttcccccttacggtacgggtttccgaaggttcgggaccgtacgggtcggttaaactccggttaggggaccgtagttacgttttacccaacccccggttcaaccctacgtaactaacgtacgtcccgtaaggaacgtcctaacgggaanacgttcgaccgtagtaccctaaacctttacgtttaccgtagttccgaatttaccgtaaacggttttacctttttaaggttacccggttaccggttaacccgttccgggaaaccccgttaaggggaacctacccggtaagttaacgggacgttaaacgttaaacccgtagtaccggtaggtcccgtaaccgg

SEQ ID NO: 224074 - DNA, 606 bp, Homo sapiens
  misc_feature: GYAE6OF02JI8GS.48.30.C08.1.454.CMB.1.raw
  modified_base (324)..(324): a, c, t, g, unknown or other
  misc_feature (324)..(324): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctggccgggccagccagagcattcgtggtagttacactggtaccagcacgaaaccagactcagtctaccaaagcctccncactcaagtatcgccttccgagtccatctcgtcgggtccctgaggttcagtcgcaggttggacttcgtaggggaactaggtacttttacccaccctacacctactactaagtacgtccgtaggaacgcgtagacgatcgactcgactaaccgttattacgtcgtacctattacgtaacgttacgtttttaacggttaccgttccggtaccttccgggaaccgaacgggtacaccggtacgtaggtaacgttataaaacccggtagtcgggtacgtactacgg

SEQ ID NO: 224075 - DNA, 558 bp, Homo sapiens
  misc_feature: GYAE6OF02GP0UF.48.30.C08.1.454.CMB.1.raw
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
tcagagtatacatacacgaccggtgctcgatttagtctgacgtcaaagggaaagggggtatcttaaaagaggttctttctctgggatgtggcatgagcaaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccggccagccgagagcattcgtggtagtttacactggtaccagcagaaaccagatcagtctaccaaagctcctcatacagtatgtcttccgagtccatctcgtcggtccctcgagttcagtgcagtgatcgtggacagtctttaccacctccaccatacaatacgcctaggagcagaangngctcactaactattacgtcgtacacttcgacgtttaacgtttacgttacgtaccgtaccgttaccggtacgtaaccgggacaacgtacgtaggtaacgtaacttaaacgtaacgtggtacgtcgtacg

SEQ ID NO: 224076 - DNA, 559 bp, Homo sapiens
  misc_feature: GYAE6OF02G9YSA.48.30.C08.1.454.CMB.1.raw
  modified_base (399)..(399): a, c, t, g, unknown or other
  misc_feature (399)..(399): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagtactttcagtctgtgactccaaaggagaaagtcaccatcacctgcccggccagccagagcattcgtggtagtttacactggtaccagcaagaaaccagatcagtcctaccaaagcctcctcatcaagtatcgccttccgagtccatccgtcgtcgggtccctcggagttcagtcggcaggtggatcgtgggacngtactttccaccctcaccatcaatcgccgtaggaacgctagaagatgcctagacctaaccttattactgtacatctaagttacttttacgttaccgcgtaccgttacgggcgtaaggccacgtactagggaataacgttaaacggactggtcggctacgg

SEQ ID NO: 224077 - DNA, 760 bp, Homo sapiens
  misc_feature: GYAE6OF02IZ9T1.48.30.C08.1.454.CMB.1.raw
  modified_base (184)..(184): a, c, t, g, unknown or other
  misc_feature (184)..(184): n is a, c, g, or t
  modified_base (221)..(221): a, c, t, g, unknown or other
  misc_feature (221)..(221): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctaccgaggggtanaattgtgctgactcattcccagtactttcagtctgtnactaccaaggagaagtcactatcacctggccggcagccagagcagttcgtaggttacgttacacgtggtaccagtaccgaagaaaccagacttacgacggttacctaccgaaaagtcctaccctactaacgtacgaacgttagtcgtaccgttaccggactacctactcgttaccggttacccggggttccccttacgggtaacggtttacgacgggttcgggtactagggttacggtaccgtttcggtacggggtaacctaagggtacccttttacccgaaccccgttaccaaacccgttaactaccgtaaacgttaccggtaccggttaacgggaaacgttaccgtaagggtaaacctacggtcgtacctaacggaaccctaaaccgtttacgttaccttacgttacaaccgttacgtaacgttttaaccgttttaagtttacccggttacgtaccgtttccggaaaccgggaacgggtaaccacggtaacgttaggaacttaaccgtaaacgtcgttacggtacggtacctaccgg

SEQ ID NO: 224078 - DNA, 658 bp, Homo sapiens
  misc_feature: GYAE6OF02JYXOI.48.30.C08.1.454.CMB.1.raw
  modified_base (182)..(182): a, c, t, g, unknown or other
  misc_feature (182)..(182): n is a, c, g, or t
  modified_base (364)..(364): a, c, t, g, unknown or other
  misc_feature (364)..(364): n is a, c, g, or t
  modified_base (501)..(501): a, c, t, g, unknown or other
  misc_feature (501)..(501): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagagtatacatacacgaccggtgctcgatttagtctgacgtcaaagggaaaggggtatcttaaaagaggttctttctctgggatgtggcatgagcaaaactgacaagtcaaggcaggaagatgttgccatcacaactcattgggtttctgctagctcgtgggttccagcctccaggggtnaaattgtgctgacctcacttccccagtactttcagtctgtcgactaccaaagggaagaaactctaaccgatcacctggccgggaccagccagagcctagttccggtgttaacggtttacaccgttggtaccagaccgaagaaacccagtactaccgacgttccaacctaaagccttcctaanaacgtacagttaagtcctaccgtttcccgaagttccctaggtcctcggttccggggtacccttacgggtagtcgaggttcgcgttaggtgaacgtcgtagacgtagtacctttccaaccctcacctagttactaacnccgtaggaccgttaanacgtagantcgtagtacacttactagtactctagtacttacgtacgtttaacgttacgtttccgacgttaccggtacgaaccggtaacgtactaccggacgtacggtaacgttaacgaaaccggtcgttgaccgtcgtacg

SEQ ID NO: 224079 - DNA, 609 bp, Homo sapiens
  misc_feature: GYAE6OF02FS91O.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcggtggtagtttacactggtaccagcagaaaccagatcagtcaccaaagcctcctcatcaagtatcgcttccgagtccatcctcgtcggggtcccctgacggttcaggtggcaggtggatcgtgggacagtactttccaccctcaccatacaagtacgccgtaggaacgtctagaagatcgctacgacctaaccttagttactacgtactactacgtacgtttaactttttacggttaccgttaccgggtacccgttcggaacccggtaaacggacccgtaaccggtacgttagggtaacgttaacgtttaaaacccggagtttacggtacggtcgtaccgg

SEQ ID NO: 224080 - DNA, 610 bp, Homo sapiens
  misc_feature: GYAE6OF02HNBGF.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcacatcacctgcccggccagccagagctagttcgtggttatttacactcggtaccagcaagaaaccagactcagtcctaccaaagcctcctacatacaagtatcgtcctaccgagtcccattcctcgtcggggtcccctaggtacggtttcaggtcggcaggtgtactcgtagggacagtacgtttacccaccctctaaccgactactaaagtacgccgttaagggaactacaaggtaacgatcgctagacctaaccttagtctgtactatcgtaattaccgtttttagtaccgtccggtaaccgttccggaaccgtacgggtaacacggtactagggacttaacgttaaaccgaacggttgtcggtacctacg

SEQ ID NO: 224081 - DNA, 637 bp, Homo sapiens
  misc_feature: GYAE6OF02IYSKL.48.30.C08.1.454.CMB.1.raw
  modified_base (236)..(236): a, c, t, g, unknown or other
  misc_feature (236)..(236): n is a, c, g, or t
tcagagtatacatacacgaccggtgctcgatttagtctgacgtcaaagggaaaggggggtatcttaaaagaggttctttctctgggatgtggcatgagcaaaactgacaagtcaaggcaggaagatgttgccatcacaactcattgggtttctgctgctctgggttccagccctccgaggggtgaaattgtgctgactcacttccccagtactttcagtctgtgactacaaagganaaagtcaccatccaccgtggccgggcagccagagcagttcgtgtacgttacacgtgtacagacacgaaaccagatctacgtactacaacgcctacctacactactaagtagcgtcctcgacgtccatccttcggtccggtcccgtggtacggtacgtagtggccgagtcggtagtcggtagggacacgttacttaccgtaacccctcctaacccgtatacaaactaccggaccgtaaggaagtaccagtaacgagttccgcgtacaacgtaactattaacgtcgtacctactacttaacgttaccgttttacggttaccggttaccgtaccgttacggtaaccggaacggtacgaccggtagtacggtaagtaacggttaaacgacgtcggtagactaccg

SEQ ID NO: 224082 - DNA, 813 bp, Homo sapiens
  misc_feature: GYAE6OF02IIUG5.48.30.C08.1.454.CMB.1.raw
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
tcagagtatacatacacgaccggtgctcgatttagtctgacgtcaagggaaagggggtatcttaaagaggttctttctctgggatgtggcatgagcaaaactgacaagtcaaggcaggaagatggtgccatcacaactcattgggttctgctgctctggtccagcctcgaggggtnaattgngctgactcacttccccagtactttcagtctgtcgactaccaaagggacgaaacgtcacctatcctacgtcggacccggggccagcccaagaggactaacgttccggagtttacggtttaaccacgttcggtaaaccgtacgaccgaaacggtaaaaccccaaggttacttaaccgacggttaacccgtaccctaaaaaacggtcccgtacccttaccccttaaattaccccgtaaaaggtttaaccttccggttaccgttaaccccggggtattaaaccccttcggttaaccgtttccggggtaacccgggggtttccccccgttaaggacccgggttttaccgaacgggttcgggtacccttaggggtacggtacgttacggttacgggggaacctagggttaacctttaccgaaccccttacggaaaccctagtacctaaaccgtaggtaccttaacgggacgtacgtagtaaccgaggttcacggttccaaccgtaacttacggttactacgttacaacgttcggtaaacttacgttttacgttacgacccgttacgtaccggtacggtaccggaaatccgtagtaaccggacgtaaaacgtacctacgggtacgtacgtactacggg

SEQ ID NO: 224083 - DNA, 628 bp, Homo sapiens
  misc_feature: GYAE6OF02FTUXX.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagccctccgaggggtgaaattgtgctgactcattccccagactttcagtctgtgactaccaaaggagaaagtcaaccatccacctgcccgggccacgccagagcattcgtggtatttacactggtaccagcaagaaaccagactcagtcctaccaaagcctcctcatacaagtatcgtccttccgacgtccatcctcgttccggggtcccctcggtacggttcaggtggcaggtggacgtcgtcgggactagtactttccacccctcaccatacaacgtacgccgtagggaactccgtaggaacgatcgtctacgtaacctaccttagtttacgtcgtactactacgtacgtttacgttttacgttaccggtcccgtacccgttcgggtaaccgaacgggtaaccctacggtaacgtagtaacggtaacttaaaccggtaacgttcgggtacgacgtaccg

SEQ ID NO: 224084 - DNA, 738 bp, Homo sapiens
  misc_feature: GYAE6OF02IH20A.48.30.C08.1.454.CMB.1.raw
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctggtccagcctcagggtgaattgtgctgactcattccccagactttcagtctgtcgaactccaaaggagaaagtcaacatcacctgccggcagcagancattcgnggttagttacactaggtaccagcagaaaaccngaatcaacgtctaaccaagtacctcctcatacaagttactcgtccttccgaagtccaagttctaccgtcggggttcccccctaggaacggtttcgaacgtcggcctagggttacggacttccggtaagggtacaacggttaaacctttttcccgaaaccccgtttccgaaacctaaacgtaccgtaaaaacgttcggaaccccgtttaaggggtaaaccgtaccgttaggaaaacgttaacgtcggacccgttaagacccttaaaaccgtttaacttaaccgttcgtactaactacgtaaacgttttaacctttttaacggttaccgtttaccgggtaacccgttttccgggaaacccggtaacgggttaaccaaccgggttacgtaagggtaacgttaaaaccgttaaaacggttaacgtacggttacggacttaacccgg

SEQ ID NO: 224085 - DNA, 599 bp, Homo sapiens
  misc_feature: GYAE6OF02IJE01.48.30.C08.1.454.CMB.1.raw
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagttctgtgactaccaaaggagaaagtcaccatcacctcgccgggccagccagagcattcgtggtagttacacgtgtaccagcagaaaccagactcagtccaccaaagcctcctcatcaagtntgcttcgntctatctcgtcgggtccctgtacgttcagtgcagtgatcgtgggacagtacttccgaccctcacctactacaatcgccgtaggaagtctaggaagtctacggcctagaacccttaacttacgttactgttaccattcgtaacgttttaacgtttttacggttaccggttaccggtacccgttaccggaccgtaaacgggcctaaccggtacgtaaggtaacgtaacgttaaaccggaccgttaggtcggacgtaccg

SEQ ID NO: 224086 - DNA, 586 bp, Homo sapiens
  misc_feature: GYAE6OF02GL5MR.48.30.C08.1.454.CMB.1.raw
  modified_base (449)..(449): a, c, t, g, unknown or other
  misc_feature (449)..(449): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcaagaaaccagatcagtcctaccaaagctcctcactacaagtactcgcttccgacgtccatcctcgtcgggtcccctgacggttcagtggcaggtggatcgtggggactagtactttcaccctcaccatcaatacgacctaggaacgtctaggaagtntcgctacgactaaccttattactgtactatcgtaagttacgttttacgtttacgtaccgtaccgttaccggaccggtaacggacctacggacgttaggtaacggtaacttaaaccggtaacggtacggtaggctacg

SEQ ID NO: 224087 - DNA, 780 bp, Homo sapiens
  misc_feature: GYAE6OF02IT9Z5.48.30.C08.1.454.CMB.1.raw
  modified_base (181)..(181): a, c, t, g, unknown or other
  misc_feature (181)..(181): n is a, c, g, or t
  modified_base (261)..(261): a, c, t, g, unknown or other
  misc_feature (261)..(261): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtnaaattgtgctgactcacttcccagtactttcagtctgtgactacaaaggagaagtcaccatcacctgccggccagccagngcagttcgtggtatttacacgtggtaccagacaacgaaaccagacttcgacgttacctaccaaaacgtccttcctacattaccgaaaacgtttagtccgaccttttacccggaacgtacccctaacgttcccgttcccggttaccggggggttcccccctttacgggttacgggttttacccgtaaggggtccgtacggttaacgggtcggggtaaccttttccgggtaacggggggtaaccctaaggttaaccgtttttaccccgaaccccccgtttacctaacccctaaacttacccgtaaacgttacggtaccccggtaaggggtaaacgtccgtaaaggaaacgttacgtacggtaccgtacggtaacccttaaccttaacgtttaacgttcggtaacctagtttaaccgtaagtttaaccgtttttaacggttaccggttaccggttacccgttaccggtaccggaaggtaccgacgtacgtaggaacttaagtaaccgtagtgtacgtctacg

SEQ ID NO: 224088 - DNA, 682 bp, Homo sapiens
  misc_feature: GYAE6OF02H3E4Y.48.30.C08.1.454.CMB.1.raw
  modified_base (181)..(181): a, c, t, g, unknown or other
  misc_feature (181)..(181): n is a, c, g, or t
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtnaattgtgctgactcattccccagtactttnagtctgtcgactcaaagganaaagtcacatccactgccggccagccagagctattcgtggtagtttacactggtaccagcaagaaaccagactcacgtactaccaaagcctacctacataccaaagttatcgtccttaccgacgtacccacttcctcggttcggggtcccccttaggtacggtttcaggtcggacgtaggttcggatcgtagggactacggtacttttacccacccgtccaacctaacgtactaaagtacgaccgttaggaacgtctaggaacgtagtcgcgttacgacctaaacctttacgttacgttacgtacgtacttacgtaaacgtttaccgtttttaacgttaccggttaccgtacccgttttaccgggaaccggtaacggtaccgtaaccggtaaccgtgggttaaacgtaacggttaaaaccgtaacggtttacggtaccggtactaacccgg

SEQ ID NO: 224089 - DNA, 720 bp, Homo sapiens
  misc_feature: GYAE6OF02HC6SE.48.30.C08.1.454.CMB.1.raw
  modified_base (329)..(329): a, c, t, g, unknown or other
  misc_feature (329)..(329): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagtactttcagtctgtgactaccaaaggagaaagtcaccactcacctgccgggccacgccagagcagttcgtggtacgtttacactcggtaccagacagaaaccagatcatcctaccaagcctccncatcaagtatcgcttaccgagtcctatcgtcgtccggggtacccctcgtacggttcaggtgtacgaggtaggtacgtcgtagggtaccgagttactttacccgacccctcgtaaccctagtacctaaagtaccggcctagggaaacgtccgttaggaaagactcgggtacttacggaccttaaacccgttactttacccgtaggttcctaacgttaccgttaacgttttaaacccggttttttacgttaacccgggttaccccgggtttaaccggtttcccgggtaaccccggtaaacggggtacccgtaaccgggttaaccggttacgggttaaagggttaaccgtttaaaaccgggaaccgttttacggggttacgtaccgttaacccg

SEQ ID NO: 224090 - DNA, 715 bp, Homo sapiens
  misc_feature: GYAE6OF02HHDIB.48.30.C08.1.454.CMB.1.raw
  modified_base (183)..(183): a, c, t, g, unknown or other
  misc_feature (183)..(183): n is a, c, g, or t
tcagagtatacatacacgaccggtgctcgatttagtctgacgtcaaagggaaagggggtatcttaaaagaggttctttctctgggatgtggcatgagcaaaaactgacaagtcaaggcaggaagatgttgccatcaacaactcattgggtttctgctgctctgggttccagcctcgaggggtnaattgtgctgactcacttcccagtactttcagtctgtgactacgaaagagaaagtcaccatcacctcggccggcagccagagcagttcgtggttattacactggtaccagaccgaacgtaaaccagactactacgtacctaccgaaacgtcctacctacgtactacgaagttactcggtacctttaccgggacttccctaacgttccgtccggtttccggggggttccccctttacgggtaaccggttttccgtaaggttccgggtaccgtagggtgggtaaccttcgggtacgggtaacgtacgttacctttacccgtaacccctacctaaccctaacgtacctaaacgttaccgtacccgttaaggaacgtacgtacggtaaagactcggacttacgacctaaccgttacttactcgtactactacgtactttacgttttaccgtaccgttaccgtaccgttaccggtacgtaacggacctacgaacgtggtaaacgtacgttaaaccggtacgttcggtacggctacgg

SEQ ID NO: 224091 - DNA, 793 bp, Homo sapiens
  misc_feature: GYAE6OF02JX1YN.48.30.C08.1.454.CMB.1.raw
  modified_base (772)..(772): a, c, t, g, unknown or other
  misc_feature (772)..(772): n is a, c, g, or t
tcagagtatacatacacgaccggtgctcgatttagtctgacgtcaaagggaaaggggtagtacttaaagaggttctttctctgggagtgtggcatgagacaaaactagacaagtcaaggcaggaagatgttgccatcacaactcattgggtttctgctgctcgtcgggttccacgcctccgaggggtagaattgtgctgactcacttcccagtaccttcagtctgtgactaccgaagacgaagtccaccatacaccgtcggccggaccagccagacgtactacgttcgtggttacgtttacgacgtggtacacgacgaagaaaccaggaactcctaagtcctaaccaaacgtcctacctactaacacgtaacgtacgtaggtcctaaccgggtaactcctaaccgtccgttttccgggtccgggttaccccgttcggtaacgggtttccacgggttcgggtacgtacggtacgggttccttacgggcgggtaacgtaaccgtttacctttacccgtacccccgtacctaacccgtaacctacgtaaaccgtccgggttaaccctacgggtaacgtaacggttacgaaaccgtaggttacgtcgggttaaacctaccgtaaccttaacgtttaccgttccggtaacttacggtacccgttaagttttaaccgtttttagggtttaccccggttacggttaacccgtttacccgggaccggtaaaccggtccgtaaaccggtaccggttaggtaacggtaaacgtttaaaccgngtaccggtagtccctaaccgg

SEQ ID NO: 224092 - DNA, 780 bp, Homo sapiens
  misc_feature: GYAE6OF02JRX7G.48.30.C08.1.454.CMB.1.raw
  modified_base (182)..(182): a, c, t, g, unknown or other
  misc_feature (182)..(182): n is a, c, g, or t
  modified_base (288)..(288): a, c, t, g, unknown or other
  misc_feature (288)..(288): n is a, c, g, or t
  modified_base (744)..(744): a, c, t, g, unknown or other
  misc_feature (744)..(744): n is a, c, g, or t
tcagagtatacatacacgaccggtgctcgatttagtctgacgtcaaaggaaagggggtagtcttaaaagaggttctttctctgggatgtggcatgagcaaaactgacaagtcaaggcaggaagatgttgccatcacaactcattgggtttctgctgctctgggttccagcctccgaggggtnaaattgtgctgactctacttccccagtcctttcagtctggtgacctaccgaaaggagaacgtcaccatccacctcggcccggccacgccgagacgctacgtttcgngggtttaacgttactaccggttaccggtacgtacggaccaacgaaaaccctaggacttccgaacgttccgtaacccgaaacgtcccttacccctacgtaacttacgaacggttattaccggtccttacccggacgttccttaacgtccgtttccgggttccccggggtaccccttacggttacgggttaacctcgggttacgggaccgttaagggtccggtatttaccccggggagggtaaaccgtaggtttaccctttccccgaaaccccccgttttcggaaccctaaggttacccaaacggttaacccggtcccggtaaagggttaacgtacccgtaagggtaacgtacgtaccgtacggtacttaacccggttaaaccttacgttacgttaacgctaagtacccttaagtttaacgtttacggtcccgtacgttacgccggtacgaccggtanaccgtagcggtaactaagtaccgtatcgcggtctcg

SEQ ID NO: 224093 - DNA, 610 bp, Homo sapiens
  misc_feature: GYAE6OF02IYI5H.48.30.C08.1.454.CMB.1.raw
  modified_base (160)..(160): a, c, t, g, unknown or other
  misc_feature (160)..(160): n is a, c, g, or t
  modified_base (300)..(300): a, c, t, g, unknown or other
  misc_feature (300)..(300): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgcttntgggttccagcctccaggggtgaaatgtgctgactcattccccagctttcagtctgtgactccgaaagagaaagtcaccatcacctgaccggccagccagagcattcgtggtattacactggtaccagcagaaaccagancagtctaccaaagcctcctcaatcaagtactgccttacgactcatctccgtcgggtcccctacgaggtttcagtgcgagtggacttcgtagggactaacggtactttacaccccttcaaccctatccgaaagtactcccgttaagggaacgtccgtaaggaatacgtacgtacgtcgaactaaaccgttattacgtcgtacacttactaagtttaaccgttttagttacgtaccggtaccttccggaccgtaaacgggtaccacgacctgggtaacctaagttaaaccgaaccgttggtacggcctacgg

SEQ ID NO: 224094 - DNA, 609 bp, Homo sapiens
  misc_feature: GYAE6OF02ISEAJ.48.30.C08.1.454.CMB.1.raw
  modified_base (510)..(510): a, c, t, g, unknown or other
  misc_feature (510)..(510): n is a, c, g, or t
tcagagtatacatacacgaccggtgctcgatttagtctgacgtcaaagggaaagggggtatcttaaaagaggttctttctctgggatgtggcatgagcaaaaactgacaagtcaaggcaggaagatgttgccatcacaactcattgggtttctgctgctctgggttccagcctccgaggggtgaaattgtgctgactcattccccagtactttcagtctgtgactaccaaaggagaaagtcaccatcacctcgccgggccagccagagctattcgtaggtagttacacgtggtaccagacaacgaaaccagactcgagtcaccaaacgctacctacactacaagttatcgccttacgactcctactcgtccggtccgggtcctaggtacgttacgaggtcgcgtaggtcgtacgtcggaggtacgtacgttacttccgtaaccctcaacctgtaactacgtacacgtaggtaacacgtacgagctcgactcgaacctaaccttatacgtntactactacgtacgtttaagtttacgttacgtccgtaaccgttcggaacggtacggacgtaacgtggtaagaactaacgtaacgacggtgcggtactcg

SEQ ID NO: 224095 - DNA, 647 bp, Homo sapiens
  misc_feature: GYAE6OF02H0JWG.48.30.C08.1.454.CMB.1.raw
  modified_base (328)..(328): a, c, t, g, unknown or other
  misc_feature (328)..(328): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagtactttcagtctgtgactccgaaaaggagaaaagtcaaccatccacctgccggccagccagagcattcgtggttattacactggtaccagacaagaaccagatcagtacaccaagcctacctnatcaaagtctcgcttacgagtccatctcgtccgggtccctaggtacgttcaggtcgacaggtggactcggtagggaactagtactttccacccgtccaactaatccgaaatccggaccgtaaggaaccgtgttaacgaagtactcggccttagacccttaaaccttattaccgtgtacctaacttacgtaaaggtttaccgttttttaacgttaccggttaccgtaacccggtttaccgggaaccgtaaacgggacctaaccggtacgtacgggtaaacgtaacgtttaaaacccggaacggtggtaccggacctacgg

SEQ ID NO: 224096 - DNA, 640 bp, Homo sapiens
  misc_feature: GYAE6OF02HMTVX.48.30.C08.1.454.CMB.1.raw
  modified_base (595)..(595): a, c, t, g, unknown or other
  misc_feature (595)..(595): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcacttccccagactttcagtctgtgactaccaaaggagaagtcaccatcacctcgccggccagccagagcattcgtgttaacgtttacacgtaggtaccagacaagaaaccagactacagtaccaccaaacgtcctcctcatacaagtatcgtcttaccgagtccacttcgtccgtcggtccccgtcgtacggttcgagtcgacaggttacggatcggtacggactacgttacctttacccgacccctaccgaacctagttaacaacgtaccgtaccggtacggaaacgtgttaacgaagtactgcctacgacctaacccgttattacctgttactacttacgtacgtttacgtttttacgttaccggtaccgttaccgttaccggaacgtaccggtaanaccgtacgtaggaacgttaataaaccgtagtgtacggacgtaccg

SEQ ID NO: 224097 - DNA, 655 bp, Homo sapiens
  misc_feature: GYAE6OF02GMCX2.48.30.C08.1.454.CMB.1.raw
  modified_base (266)..(266): a, c, t, g, unknown or other
  misc_feature (266)..(266): n is a, c, g, or t
  modified_base (504)..(504): a, c, t, g, unknown or other
  misc_feature (504)..(504): n is a, c, g, or t
  modified_base (532)..(532): a, c, t, g, unknown or other
  misc_feature (532)..(532): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctcgtgggttccagcctccgaggggtgaaattgtgctgactcacttcccagtactttcagtctgtgactaccaaggagaagtccacactcaccgtcggccggcagccagngctagttcgtaggttacgtttacacgtggtaccagacaacgaaaccagactacgacgtcctaccaaagccttcctacactacgtaaacgtctcgtccgttaccgacgttacctagttcctacggttccggggtcccctcggtacggtttcgaggtcgacgtaggtgtacgtcgtagggactactactttcccgaccctcacctactaacaacgtcgaccgtaggatcgtaggaacgtntacggtctcgaactaaccgttactcgtntacctattacgtagtttaacgttttacgtccgttaccgtaccgttccggaaccgtacggtaacctacggtagttacgggtaacgttaacgttaaaccggtaacggttcgtagggtccttaccg

SEQ ID NO: 224098 - DNA, 690 bp, Homo sapiens
  misc_feature: GYAE6OF02FOABD.48.30.C08.1.454.CMB.1.raw
  modified_base (281)..(281): a, c, t, g, unknown or other
  misc_feature (281)..(281): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggttctgctgctctgggttccagccctccaggggtcaaattgtgctgactcacttccccagtactttcagtctgtgacctaccaaaggagaaacgtcaacctatccgacctgccgggccagccagacgcagttcgnggttaatttacgactggtaccagctaagaaaccagacttcacgttactaccgaaagtcctccgtacacgtacaagtactcggccttacggacgtccagttccgtcgttcggggtcccctaggtacggtactacgtggccgtaaggtcggtaacttcggtacggggaacgtacggtactttaccgacccctaccgtacctatacgaaacttacgaccgttaggaaacgcgttggaactacgtcgtaccgtagtaccgtaaccgttacttacgtacgtacctagttaaccgtagtttaacgttttaacgttacggtaccggtaccgttaccggtacggtaacgggtacctaacggtaaccgtaagggtaacgtaacgttaaaccggaacgttcgggtacgtacgtacccgg

SEQ ID NO: 224099 - DNA, 652 bp, Homo sapiens
  misc_feature: GYAE6OF02FZWGF.48.30.C08.1.454.CMB.1.raw
  modified_base (181)..(181): a, c, t, g, unknown or other
  misc_feature (181)..(181): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtnaaattgtgctgactcacttccccagactttcagtctgtgactaccaaaggagaaagtcaccatcacctggcccgggccagccagagctagttcgtaggtagtttacactaggtaccagcaagaaaccagatcagtctaccgaaancctacctacatacaaagttncgtacttccgacgtccagttccttcgtccggggttacccctggtacggtttcgaggtacggctaggtgggtactcgtagggacagtactttccaccctcaccataccaataccgacgtaggaacgtcgtaggaactgtcgtactacgaccaaaccttgtttacctagtactaagttactaacggtttaactttttaacggttacccgtacgttaacccgttacggtaacccggaaacggtaccctaaccggtagtaaccggtaagtaaacggtttaaacccgaaggttacggtacggtcgtaaccg

SEQ ID NO: 224100 - DNA, 793 bp, Homo sapiens
  misc_feature: GYAE6OF02JAXXI.48.30.C08.1.454.CMB.1.raw
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (215)..(215): a, c, t, g, unknown or other
  misc_feature (215)..(215): n is a, c, g, or t
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
tcagagtatacatacacgaccggtgctcgatttagtctgacgtcaaagggaaagggggtatcttaaaagaggttctttctctgggatgtggcatgagcaaaactgacaagtcaaggctaggaagatgttgccatcaacaactcattgggtttctgctgctctggttccagcctcgaggggtnaattcgngctagactcacttcccagtacctttnagtcgtacgtgactaccgaaagggacaaactcgacatccaccgtggccggccagccgagacgcagtttcggtggttaacgtttaccactacggtacccaaggactaagaaaacccngtattaccaacggttccaaaccgaaacgtcctacccgttanaacttaccgaaagttcgtccgtaccgtttaccgggaaactcctacgttccggttccgggtaccggggttccccctaaggttccgggttacaaccgggtttacggccgtaagggttggaccgtaacggttccgggacttaacgggtaccctttaccgaaacccccgttcaaacccttacgtaactacggtaacgtacccggtacggtaacgtaccgaacggtaaagttactccgggtaaccttaacggaccgttaacttaaccgttcggtaacgtactccgttaaacggtcgttttaaaccgtttaacgggtttaccccgacgggtttaacccgtagggtaccggaaaacggttaacgacccggttaacggtaaggtaaacggttaaccgtaaacggtaaccgtgggtaccgtaccgtaacg

SEQ ID NO: 224101 - DNA, 798 bp, Homo sapiens
  misc_feature: GYAE6OF02HPF6J.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcatttgggtttctggctgtcttcgtcgggttccacgccctccggtaggggtagtaaagtttggtgtctgacctctacttcccctagtctttcagtctgtcactacgaaaggagaacgtccacatccaccgtcggccggccacgccgagacgctacgttcggtcggttaacgtttacgtacgttacggtaccacgtacgaacgaaaccagtaactacgacgtacctaaccgaaaccgtcctaccgtactacgttaacgtaagttactcgtacctttaccgacgtaccctacgttccgtccggttacccgggttccccgtaggtacggtttccgtaggtcggtacgtaggtcggtactcgggttacgggattaacgttccttaccacccgtctaacctactacgtaacgttcgaacggtacggaacgtcgtaaaggtacgtacgtcgtaccgtacggttaaaccctaaacgttttaaccgtcgttacggtaacttaacgttccgttaaacgtttttaccggttttaaccggtttaccggtcccccggtttaacgtaccccggggtaaacgttaaccggtaaccccggtaaggttaccggtaaacgggttaacggttaaaaccgtaacccgggttaggtcgggttaccgtacgttaacccg

SEQ ID NO: 224102 - DNA, 554 bp, Homo sapiens
  misc_feature: GYAE6OF02GYW4O.48.30.C08.1.454.CMB.1.raw
  modified_base (262)..(262): a, c, t, g, unknown or other
  misc_feature (262)..(262): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (454)..(454): a, c, t, g, unknown or other
  misc_feature (454)..(454): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagngcatcgtggtagttacactggtaccagcagaaaccagatcagtctaccaaagcctcctcatacaagtatgcttccgatccatctcgtcggggtccctcggacggttcagtcggctaggtggatcgtgggacagtnttccncctcacatacatacgctaggagctagagatcgctgcaaccttattactctanactcaagttacttttacgttaccgttcggtacctcccggtaccgaagggtacaacggtacgtaggtaagaacgttaaaccggaattcggttacgccgtcg

SEQ ID NO: 224103 - DNA, 646 bp, Homo sapiens
  misc_feature: GYAE6OF02FW5XR.48.30.C08.1.454.CMB.1.raw
  modified_base (284)..(284): a, c, t, g, unknown or other
  misc_feature (284)..(284): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatccacctgcccgggccagccagagcattcgtggtagtttaccnctggtaccagacagaaaccagatcatcaccaaacgctcctcatacaagtatcgtcttccgagtccagtcctcgtcggggtcccctcggtacggtttcaggttgcgtaggtggactcgtgggactaggtactttccgcccctcacccatacaaagtacgccgtaggaacgctaggaaatatcgaccttagtaccctaaactttattaccgtcgtaccttagtactaacgtttaacctttttacgtttacccggttaccggtaccccgttacgggtacccggtaaaggggaccctaaccgggaccgttaacgggtaaggttaaaccgttaaaacggtaaccggttacggtcgggtaccctacgg

SEQ ID NO: 224104 - DNA, 792 bp, Homo sapiens
  misc_feature: GYAE6OF02I9UXU.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcaggggtgtaattgtgctagacctcacttccccagtactttcagttctgtacgactaccgaaaggagaaacgtccaaccatccacctcggccgggccagccagagctagttcgtaggtactttacactggtaaccagacaagaaaccagtactacacgttacctaacccgtaaagcctacccttacaacgttaaccaaaagggtttagtccgtacctttcccggaaagttacccctaacttcccgttacccggttcccgggggttaccccctggttaacgggtttccaggggtttcggcctaaggggtcggtaacgttccgggtagggacctacggtttaaccttttcccaaccccgttccaacctactaactaaccgtacgtccggtaacggaagtcgtaacggaagtcgtacgccgttacgtaacctaccgtttaattaccgttactaccgttaactttccgttaaaattttttcccgttttaagggttttaacccggtttccgggttaacccgtttaaccgggggaccccgtaaaagggggtccctaaaccggttacggtaggttaaacggtaaaccgttttaaaccggtacgtcgggtttagtaccccgttaacgg

SEQ ID NO: 224105 - DNA, 790 bp, Homo sapiens
  misc_feature: GYAE6OF02I4WKY.48.30.C08.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagctccgagggtgaattgtgctgactcattcccngtactttcacgtctgttnactacaaggagaaagtcacctaatcaccgtcggccggacacgccaggacgctagttcggttggttaatttaccgaacgttacggtaccgtaggaccgaaacgaaaccaggtactacgtaaggttaccaacccgtaaaaggtcccttacccacgtaatttaaccgaacgttacttcggtacctttaaccggtacgttaccaacttccggttccgggtttacccggggtaccccgtttcggttaacggttcgtaaccgggtttcgggaccttaggggttacggtaacggtttcccggtaacggggtaacgttacgttaacgttttccccgaacccgttcctaaccggttacaaccgttaacgttaccggaccgttacggtaaacgtacggttaacgaacgttacgtaccgtaccgttagtaacccgtaaccttttagtacgttacgacttaccgttacgtaacgttttaagtttacgttaacgttaccgggttacccgttacgggaaccgtaacgtacgaaccggttagtaaccggtaacgttaacggtaaccgtaggtcggtactacgtacg

SEQ ID NO: 224106 - DNA, 799 bp, Homo sapiens
  misc_feature: GYAE6OF02GWFMK.48.30.C08.1.454.CMB.1.raw
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcgaggggtnaattgngctgactcacttcccagtactttcagtctgtnactacgaaggataactcactnctaccncggccggcagccagagctagttcggtgttacttaccacgtacgtaccagacaaacgaaacctagtactacgtacgtcctaacccgaaagtccttaccctataacgtaccgtaaaggtttctaccggtccgttaccgaccgtttcctaacgttccgttcccggggttcccgggttaccccgttaaggttacggtttaccggagggttacggtaccgtagggtttacggacgtttccgggtaacggggtaacttaacggttaacccttttaccccgaaccccgtttaaccaaacccggttaataaccgtaacgtacccgggtaacgttaacgggacggtacgttaaaggaacttacgtccgtaaccggtacctaaaccggttaaaccttttacggtttacctaccggtatttaaccgggttaactttaacggttttaaaccgttttaccggtacccgtttaccggtccggttaacccgggaacgttaaccgggaccgttagaaccggttagtaaacggttaacgttaaacgccggttcggttacgccgtaaccgg

SEQ ID NO: 224107 - DNA, 887 bp, Homo sapiens
  misc_feature: GYAE6OF02I90V1.48.30.C08.1.454.CMB.1.raw
  modified_base (330)..(330): a, c, t, g, unknown or other
  misc_feature (330)..(330): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcgaggggtgaaattgtgctgactctacttccccagtactttcagtctgtcgactaccaaaggagaaagtccaccactcaccgtcggccgggccacgccgagagctattcggtaggttacgtttacacgttcggtacacgtacaacgaaaaccagtaancctaacggtaccttacccggaaaacgtcccttaccccttacaacgttacctaaaggttactacggtacccgtttaccggaacggttccctaactccttccggttcccggggttccccctacgggtacggttttccgagggttcggacgtacggtggacttcggtacggggactacggttactttaccccgaaccctacctaacccgtaataacccgtaacgttaccgaccggtaacgggtaaacgtccgttaagggaaaacgtacgttagggtacccttaacgggtaacccttaaaacccgtttacgttacccgtttaaccggttaacttaaacccgttaaccgtttaaacggtttttttaaacccgggtttttttaaccgggttttaaccccggggttaccccgggtttaaacccccggttttaccccgggtaaacccggggaaaacggggttaaccccgtaaaccgggtaaccgggtttaacgggtaaaaccggtttaaacggtttaaaacccgggtacggttttaaccggggttccgggtaccgttaacccggg

SEQ ID NO: 224108 - DNA, 781 bp, Homo sapiens
  misc_feature: GYAE6OF02FIC9U.48.30.C08.1.454.CMB.1.raw
  modified_base (179)..(179): a, c, t, g, unknown or other
  misc_feature (179)..(179): n is a, c, g, or t
  modified_base (186)..(186): a, c, t, g, unknown or other
  misc_feature (186)..(186): n is a, c, g, or t
  modified_base (269)..(269): a, c, t, g, unknown or other
  misc_feature (269)..(269): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggttctgctgctctgggttccagcctcaggggtnaaattgngctgactctacttccccagtactttcagtctgtgactacgaaaggagaaacgtcaccatccacctggcccgggcacgccaganctattcggtaggttatttaccacgttggtaccaggaccaacgaaaccgagactacgacgttaccaaccgaaagtcccttacctacaacttacgtaaacgttacgttcggtacctttaccggtaacttcctaacgtttccgtaccgggtttcccgggggttacccccttacgggttacgggtttaccaaggggttcggaccgtaagggttcgggtaactttcggtaacgggtactaacggttacctttacccgaaccccttaccaacctaacgtacctaacgtacggtaccggtaaggtaacgtacgtaacggtaacgtacgtcgtacggttaccgtacctaaaccgttaccgtttaacgttcgtaacttacgtaacgttaaccgttttaacgtttttaacggtttaccggtaccggtaccgttacccgggtaaccgtaacggtaccgtaaccggtacggttaacggtaacgttaacggttaaaaccgtcggtacggttacggacgttaaccg

SEQ ID NO: 224109 - DNA, 660 bp, Homo sapiens
  misc_feature: GYAE6OF02HCKSY.48.30.C08.1.454.CMB.1.raw
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (233)..(233): a, c, t, g, unknown or other
  misc_feature (233)..(233): n is a, c, g, or t
  modified_base (266)..(266): a, c, t, g, unknown or other
  misc_feature (266)..(266): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtnaattgngctgactctacttccccagactttcagtctgtgactaccaaagganaaagtcaccatcacctggccggccagccagacnctagttcggtaggttatttaacacgtgtaccagtccaagaaaacccagactaccaagttcctaaccaaaacggtcctaccctacctataccaaagttacttgaccgttcccgagtccctatccgttccggttccggggtaccccttcggaggtttccagtcggactaggtacgatccggaggggacagtacttccaaccgtcctacctactactactagtaccgtacggacgtacgtcgaaatcgtacggctaacggtacctaaacgtattaccgttacgtactattcggtaactttagttttaacgttcggtacccgtcgtttaccggacgtaacggtcaccggtacgttaaggaacgttaacggtaaccctaggtacgttacgactacccgg

SEQ ID NO: 224110 - DNA, 824 bp, Homo sapiens
  misc_feature: GYAE6OF02I1ETN.48.30.C08.1.454.CMB.1.raw
  modified_base (609)..(609): a, c, t, g, unknown or other
  misc_feature (609)..(609): n is a, c, g, or t
  modified_base (774)..(774): a, c, t, g, unknown or other
  misc_feature (774)..(774): n is a, c, g, or t
tcagagtatacatacacgaccggtgctcgatttagtctgacgtcaaagggaaagggggtatcttaaaagaggttctttctctgggatgtggcatgagacaaaactgacaagtcaaggcaggaagatgttgccatcacaactcattgggtttctgctgctctgggttccagcctccgagggtgaaattgtgctagactcacttccccagtactttcagtctgtgactccgaaaggagaaacgtcaaccataccacctacggccggaccacgaccgtacgacgacgtacgtttacggttacgggttaacgtttaacgtaccgtacggtacccgtaacggaccaacggtaaaaccgaacgtactacgtaacgtacctaaccgtaaacggaccttccctaactaactacgtaaagttacgtacgtaccgtttaccgtacggttaccctacgttaccgtccggttaccggggtccccgttaccggttacggtttacggtacgtcggtccgtagtcgggtacgttcggtacgggaactaaggtttaccttaccctaccctaccacttaacgtacgtaaacgttccggacgttacgggtaaagtcgtaaggtaaancgtttacgaccgttagtaccctaaacgtttacttacggttacgtaccgaattaccggttaaacttttacccggttttttaaagttccccgggtacccggttaaaccgtttccgggaaccggtaaacgggtaaacccggtacgttaaccggacggggttttaaaanaaccggttttaaaacccgggactttacggggttaccggccgtttaaccgg

SEQ ID NO: 224111 - DNA, 748 bp, Homo sapiens
  misc_feature: GYAE6OF02IEIRR.48.30.C08.1.454.CMB.1.raw
  modified_base (319)..(319): a, c, t, g, unknown or other
  misc_feature (319)..(319): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctcgtgggttccagcctcgaggggtgaattgtgctgactcacttccccagtactttcagtctgtcgactaccgaaaggagaagtccaaccatccacctcggccggccagccgagacgctagtttcgtggttacgtttacacgtggtacccagcaacgaaaccngatcgacgtctaccgaagcctcctcactacaatcgtactccttacgacgtcctatccgtcggtccggggttcccctggtacggttcagtcggctagggttcgacgttcggtacgggtactaggtttacctttaccccgaacccgttacaaccgtactaccaaacgtacggtaccgtacggtaacgccgttaggaacgttacgttacggaccgttacgaaccctttaaaccccgtttagttttaaaccgtcgttaaccgttaaacgtttaccgttaaccggttttaaacgtttttttaaacggtttaccccggttacccggtttaaccccggtttacgggaaacccggtaaccgggaaccgtaacccggtaacggttaacgggacgtttaaaaccggttaaacggtacgttacggtccggacttacccgg

SEQ ID NO: 224112 - DNA, 839 bp, Homo sapiens
  misc_feature: GYAE6OF02F4WXP.48.30.C08.1.454.CMB.1.raw
  modified_base (825)..(825): a, c, t, g, unknown or other
  misc_feature (825)..(825): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctcgtgggttccagccgtccgaggggtagtaattgtgctgactctacttcccagtactttcgagtctgtacgacctaccgaaaggaagaaacgtccaaccactaccaccgtcggccccgggaccacgaccgaagacgactagtttcggttaggttacgttttaccacgttacggtaccgacgaccgaaacgaaaccagtaactactacgtaccaaccgaacgtccttccctacgtactacgtaaagttacgttacgtacctttacccgacttacccgtacgttccgtttacccgggttcccggggttaccccgttacgggttacgggtttaccgtaacggggttacgggtacgtagggttacgggttacgtttaccgggtacggggtaacttacggtttacccttttaaccccgacccctaccgtaccttaaactaacccgttaaaggtacccggtacccgttaaggggtaactacgggtttaaacggaacgttccgtacggtaccttaaccgttaacccgttaaacccgtttttagtaccgttacgttacgttaaccgtttaacgtttacggtttttaaccgtttttaacggggtttcccgtaccggtaccgttaccggggaaacgaccgggtacctacggtaacggtactaacggtaagttaaccgnggttcgcgtacacg

SEQ ID NO: 224113 - DNA, 604 bp, Homo sapiens
  misc_feature: GYAE6OF02ICQR9.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaattgtgctgactcattccccagtactttcagtctgtgactccaaaggagaaagtcaccatccacctgccgggccagccagagcattcgtggttagtttacacgtggtaccagcaagaaacagatcagtctaccaaagctcctcatcaagtatgtccttccgatcccattctcgtcggggttcccctggtacggttcaggtgccgtaggtaggacttcgtagggacacggtactttcccaaccctctaaccatacaactacgccgtaggaacgtctaggaagtatgactgacctaacctatttactcgtacattctaagttacgtttttacgttacgtaccgtaccgtttcggaaccgtaacgggacaccggtacgtaggtaacgtaacgttaaaaccggtacgttacggttacggctaccgg

SEQ ID NO: 224114 - DNA, 659 bp, Homo sapiens
  misc_feature: GYAE6OF02FIL31.48.30.C08.1.454.CMB.1.raw
  modified_base (273)..(273): a, c, t, g, unknown or other
  misc_feature (273)..(273): n is a, c, g, or t
  modified_base (409)..(409): a, c, t, g, unknown or other
  misc_feature (409)..(409): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacactcattgggtttctgctggctcttgggttccagcctccaggggtgtaaattgtgctgactcacttcccagtactttcagtctgtacgactaccgaaaggagaacgtcaccactcacctcggcccggacacgccagngctagttcgtggtatttacacgtcggtacagacgaacgaaccagatacacgtacctaccaaaccgcctcctacactactaagtactcgtctccgactccacttcgtaccggtcgggtaccccgtcgtaggttaccnggtacgtcgtaggtcggtaacttcggtaacggtacgtaacgtacctttccgtaaccccgtaccaccctaactacgtaaactcggacgtaggacgtactagaacgtagtcgactcgaacctaacgttctttacgacgtactctaacgtaccgtttatttaacggttaccgttccggaccgttccggaacttaacgggacctccggtagtaacggtacaaccggtttaagaacggttcgacggttactacgg

SEQ ID NO: 224115 - DNA, 811 bp, Homo sapiens
  misc_feature: GYAE6OF02F12SG.48.30.C08.1.454.CMB.1.raw
  modified_base (185)..(185): a, c, t, g, unknown or other
  misc_feature (185)..(185): n is a, c, g, or t
tcagagtatacatacacgaccggtgctcgatttagtctgacgtcaaagggaaagggggtatcttaaaagaggttctttctctgggatgtggcatgagcaaaactgacagtcaaggcaggaagatgttgcatcacaactcattgggtttactgactgctacgtgggttccagcctccgaggggtanaaattgtgctgactactatcccagtactttcagttctgtcgactacgaaaggtagtaaacgtccacgtataccaccgttggacccggaccacggaccagacgcgtagttacggtagttagtttacacgttaggtacccgatacgaacgaaccaggtaacttacaacggttacctacccgaaagtccgtaccttaacgaacgtacgtaaaacggttctacggtacccgtttaccggtaccgtaccgttaacgttcccgtaccggttaccccgggggttaccctacggtaacgggttttaccaacgggtttccgggacgttaacgggtagggtaaccgtttcggtaacgggtaacgtaacggttacttttccccgaacccctacgacctaacggtacctaaacgggttaccgaccgttaaggacgttacctaagggtaataacgtgggaccctaagtaaccttaccgtaaagtttctacggttacctaagtccgtttaaatttaccgttttaggggtttaccctaccgggttaccgttaccggtaacggtaaacgggccctaaacgggtaacgttacggtaacgtaaacggttaaacccgtaaggtttcggtacggtaccctaccggg

SEQ ID NO: 224116 - DNA, 695 bp, Homo sapiens
  misc_feature: GYAE6OF02HDWOP.48.30.C08.1.454.CMB.1.raw
  modified_base (310)..(310): a, c, t, g, unknown or other
  misc_feature (310)..(310): n is a, c, g, or t
tcagagtatacatacacgaccggtgctcgatttagtctgacgtcaaagggaaaggggggtatcttaaaagaggttctttctctgggatgtggcatgagcaaaactgacaagtcaaggcaggaagatgttgccatcacaactcattgggtttctgctgctctgggttccagcctccgaggggtgaattgtgctgactcacttcccagtactttcagtctgtgactccaaaggagaagtcaccatcacctgaccggccacgccagagctattcggtggttagtttacactggtaccagcacgaaaccagacncacgtacctaccaagcctacctcaatacaagtcgtcgtccttaccgacgtccctactccgtccggttccggggtcccttacggtacggtttctaggtcgggaccgtacgggtcggtaacttcggtacggggacttagtactttaccccaccctacctacctataccgtaattacgccgtaagggaaactcgttaagaagtcgtcgtcctacggaacctaacctttaattaccgtgtactaaacttccgttaagttttaaccgtttttaacggttaccggtacccgggtttaaccgttccgggaaacggtaaccgggaacctaacggttaccgtaagggtaacggtaaacgttaaaccggtaagttcgggttacgtacctaaccgg

SEQ ID NO: 224117 - DNA, 744 bp, Homo sapiens
  misc_feature: GYAE6OF02JLBCE.48.30.C08.1.454.CMB.1.raw
  modified_base (177)..(177): a, c, t, g, unknown or other
  misc_feature (177)..(177): n is a, c, g, or t
  modified_base (183)..(183): a, c, t, g, unknown or other
  misc_feature (183)..(183): n is a, c, g, or t
tcagagtatacatacacgaccggtgctcgatttagtctgacgtcaaagggaaagggggtatcttaaagaggttctttctctgggatgtggcgatgagacaactgacaagtcaaggcaggaagatgttgccatcacaactcattgggttctgctgctctggttccagcctcaggggtnaattgngtactgactctattccccagtactttcagtctgtcgactaccaaaggaagtaagtccccactatccacgtcggccgggacctacgaccgacggtacgccgttaacgtttccggtagggtttaacttttaaccgaccgtttacggttaaccccgaacgttaccgaaacggtaaaaccctacggttaacaccgtaacggtaccctaaccctaaaacggccttaccctcgaaactccgtaaagtaacttcgtccgttacccgacgttacctacctcgtttccggtccggggttcccttacggaaggtttccgaggttaggtacacgggttgtaccgttacggtacggtaccgacgtacttacccaaccgtacccacgtactaacgtattaccggcgtagacgactacgatcgcgtcgtacgaccgtaaccttagttactacgtactccttacgtaacgttacttttaaccggtcgttaccgtacggttacccgaaccgggtacgtaccgtacggaccgttaagggaaccttaggttaaacccgaagtcggttacgcgttaccgg

SEQ ID NO: 224118 - DNA, 727 bp, Homo sapiens
  misc_feature: GYAE6OF02F7XH1.48.30.C08.1.454.CMB.1.raw
  modified_base (180)..(180): a, c, t, g, unknown or other
  misc_feature (180)..(180): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggttctgctgctctgggttccagcctccaggggtnaaattgtgctgactcattccccagactttcagtctgtgactcaaagagaaatcacatcacctgccggcagccagagcattcgtggtacgtttacactgtaccagcaagaaccagagtcagtcctacgaaacgcctacctacacttacaagtactcgtaccttacgtaccggtacccagttaccgtccgttccgggggttaccccctcgggtacggtttaccgtaacgggtcggtaccgtaacgggttggtaaccgtttacgtacgggggtaaccctaacgggtaacctttttacccctaaccccgtttacccaacccttaaccgtacgtaaacgtacggtacccgtagggtaaacggtcgtacgaaggtactaggtccgtacggacctaacctttaacgttccgttacgtacttaacggtaccttaacggttactttttaacggttttaccgtaccgggttaacctttaccgggacccgtaaacgggtaccgaaccggttaccgtaggtagttaactaaacggtaccttaggttacggtacgtaccg

SEQ ID NO: 224119 - DNA, 624 bp, Homo sapiens
  misc_feature: GYAE6OF02GS612.48.30.C08.1.454.CMB.1.raw
  modified_base (188)..(188): a, c, t, g, unknown or other
  misc_feature (188)..(188): n is a, c, g, or t
  modified_base (232)..(232): a, c, t, g, unknown or other
  misc_feature (232)..(232): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctccaggggtgaaattgngctgactcattccccagactttcagtctgtgactaccaaagganaaagtcaccatcacctgccgggcagccagacgcattcgtggtagtttacactggtaccagcaagaaaccagatcagtctccaaagctcctcatacaagtatcgcttccgagtccatcctcgtcggggtcccctggacgttcgagtggcaggtggatcgtgggacagtatttccgacctacgacctacgtacaactacgccgtacggaacgcgtacgaagactagacgtacgacgtaaacctactttaactcgtactaacgttactacgttaactttttacgttaaccggttaccggtacccgttaccggtaccgtaaaccgggtaccgtaaccgtaaccgtacgggtaaaccgtaacgttaaaaccgtaacgttggttaccggacgtaccgg

SEQ ID NO: 224120 - DNA, 663 bp, Homo sapiens
  misc_feature: GYAE6OF02FMFDP.48.30.C08.1.454.CMB.1.raw
  modified_base (180)..(180): a, c, t, g, unknown or other
  misc_feature (180)..(180): n is a, c, g, or t
  modified_base (231)..(231): a, c, t, g, unknown or other
  misc_feature (231)..(231): n is a, c, g, or t
  modified_base (547)..(547): a, c, t, g, unknown or other
  misc_feature (547)..(547): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctctgggttccagcctcaggggtnaaattgtgctgactcattccccagactttcagtctgtcgactccaaagganaaaagtcaaccatcacctgcccgggccagccagagcattcgtggtagtttacactggtaccagcagaaaccagatcagtctaccaaagcctcctcagtactaagtatcgcttacccgagtacccatccgtacgttcgggggtccccctacgtaacgggtttccaaggtcggggtaccgtaaggttcggacgtttcccgtagggggacctaagtaccgttttaccaaccccctttacgaaccccttaagtacctaaaatcggtacccgtagggtaacacgttagggaaagtactaggcctacggactaaaccgtttntaacgtcgtacacgttacagttaccgttttagttaccgtacggtaccctttaccggacgaacgggtactacgtacgtacggaagttacctaaaccgacgttaggtagtacctacgg

SEQ ID NO: 224121 - DNA, 770 bp, Homo sapiens
  misc_feature: GYAE6OF02HUG1E.48.30.C08.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcagttgggtttctgctgctcgtgggttccagcctcgagggtgaattgtgctgactctacttcccagtcttnagtctgtanactacgaaaggagtaagtcacctacacctaccgtcggccggccagccaggacgctagtttcggtaggtttaacgttactaccgtaggtaccaggactaaacggaaaccagaactcacgtcctaaccgaaagtcctcccatactacgaagttctccgtacgttccgacttaccgtattaccggtccggttaccgggttccccgtaggtacggttcctaggtcggacagggttcgtacggttcggtacgggtaacgttacgttaccctttaccccgtaccccgttaacacccgttaagttaacaacggtttaacccggcgttaacgggaacgttacgtaagtaacgtacgtacgtactaccgtaaccgttaactttacggtaccttagttaactacgttaacgtttaacttttaaccggtttttacggtttaacccgttaccgggtttaccccgttagggaaaccccggttaaacgggtccgtaaccggttaacgtacggggtaacttaaaccggtttaaacgggtacgttagggtacccgtacgtaaccgg

SEQ ID NO: 224122 - DNA, 691 bp, Homo sapiens
  misc_feature: GYAE6OF02GWI5W.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcagttgggtttctgctgctcgtgggttccagccgtccgaggggtagtaaattgtgctgactctaccttcccagtactttcagtctgtgacctacaaaggagaacgtcaacactccacctcggaccggcacgccgagagactagtttcgtggttacgtttacacgtcggtaccagacgaacgtaaaaccgagtactacgtacgtacctaaccgaaacgtcctaccgttacaactaactaacgttactgtaccgttaccgacgtacctagtccgttccggtccgggttaccctgggtaacgttcgagttcggataggtgtaactcgtacggactacgtactttaccgaaccctacgtaacctatacgaactacgacgttacggaacgtcgtaagaacgtactcggtccttacgaaccttaaccgttaactccgtttaacgcttaacgtacgttacgttttaaccgttttacgttacccgggtacgtcccgttacggaccgtaacggtagtacggtacgtagtacgtaacgtaacgtacgtggtacgagtaccg

SEQ ID NO: 224123 - DNA, 746 bp, Homo sapiens
  misc_feature: GYAE6OF02HEO8Y.48.30.C08.1.454.CMB.1.raw
  modified_base (697)..(697): a, c, t, g, unknown or other
  misc_feature (697)..(697): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactctagtttgggtttctgctgctcgttgggttccagcctcgaggggtagtaaattgtgctgactcacttcccaagtactttcagtctgtcgactaccaaaggacaaacgtccaaccactccacctcgggcccggaccacgccgagcgtactagtttcggtaggttacgtttaacacgtacggtaaccacgaccgaaacgaaaccaagtactacgtacgtaccaaccgaaacgtcctacctctaacgttaacgtaaagttacgttccgtaccgttacccgtacggtacccgtattaccgttcccggttcccggggttccccttacgggtaccggttacgtagggtcggacgtaggtggacttacggtacgggactacgtacctttccacccttacccactaacgtactaacgtacggtaccgtaaggtagtcgttaagacgtaacgtcgacgtacaaccgttaacttacgtttaacgtctacgtacgtttacgtaagttttacgttttaacgttacccgttccgttaacgtacggtaaccggtaacggacgtaacggtanaacgggttaactaaacggttaaccgtacggttcgacggttccgtaaccg

SEQ ID NO: 224124 - DNA, 875 bp, Homo sapiens
  misc_feature: GYAE6OF02JA5SF.48.30.C08.1.454.CMB.1.raw
tcagagtatacatacacgaccggtgctcgatttagtctgacgtcaaagggaaagggggtatcttaaaagaggttctttctctgggatgtggcatgagcaaaaactgacaagtcaaggcaggaagattgttgccatcaacaactcattgggtttctgctgctcgtggttccacgcctccgagggtgtaattgtgctgactctacttccccagtactttcacgtctgctactaccgaaaggagaaacgtcaccactcaccgtcggccgggccacgccgagacgactacgttcggttacggttacgtttacgacgttacggtaccgacgaccgaaaccgaaaccgagtactcctacggtacctaccgaaactccgtacctacctaacgtactaaacggttctacgttccgttaccgtacgttacctacgttaccgttcccgggttacccggggttcccccgtttaagggtcggtttaccggtacggttaccgggtacggttacgggttacggtacgggtttcgggtacggggtaacgttaacgtttaacccgtttacccctaaccccgtaccctaacccgttaaactaaaccgtaaaccggttaaccggtaccggtaaccgggtaagtaacccgtaacggggttaaacgcgttaccgtaccggttaaccgttaacccgttaaacccttttaaccgtttcggttaaaccgttaaccgtaccgtttaaactttaacggtttttaaaccgttttttaccggtttaaccgttacccggttacccggtaaccggggttaaccgacgggttaaccggtaccggtaacggttaaacggttaacgttaaacgttaaaccgttacgggtacggttacgacgtaccgg

SEQ ID NO: 224125 - DNA, 678 bp, Homo sapiens
  misc_feature: GYAE6OF02FGYZB.48.30.C08.1.454.CMB.1.raw
  modified_base (186)..(186): a, c, t, g, unknown or other
  misc_feature (186)..(186): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (323)..(323): a, c, t, g, unknown or other
  misc_feature (323)..(323): n is a, c, g, or t
tcagagtatacatacacgaccggtgctcgatttagtctgacgtcaaagggaagggggtatcttaaaagaggtctttctctgggatgtggcatcgaggcaaaactgacaagtcaaggcaggagatgttgccatcacaacgtccaattgggttctagctgctcctgggttccagtcctccgaggggtnaaattgtagctggactcacttccccagactttcagtctgtgacctaccgaaagganaacgtcaccatcaccngcccggcagcagacncntcgtgtactttcacgtgtaccagcaagaaccagactcagtcctacaancctcctcatcgaatctcgtccttcgactccattccgtcgtccgggtccctaggtacgttcacggtcgactaggcgtactcggtacggactagtacgttcccacccgtactactaactactaacgtacgcgtaggaacgtaccttaggaaccgtcttacgacccgtacgaacccgttaaccgttaacgtttaccgtacgtaccttaaacgtccggttaaacgtttaccgtttttaaccggttaccggtttacccggaacccgtttccgggaaacggtacccggtaaccgtaaccggttaacggtacggtaacgttaacgtaaacccggttacgtacggtttaccggacgtacccgg

SEQ ID NO: 224126 - DNA, 728 bp, Homo sapiens
  misc_feature: GYAE6OF02G79NE.48.30.C08.1.454.CMB.1.raw
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctcgtgggttccagccctccgaggggtagtaaattgtcgctgactcacttccccagtacctttcagtctgtcgacctaccgaaaggagaaagtccaaccactccacccgtcggacccggaccgacgccgaaggcgactagtttcggtaggtttaacgtttaccacgttacggtaccagacgaacgaacctagatctacgtacctaccgaaacgtcctcctactactacgaagttactacgtcccttacgtacctcctacgttcccgtcggttaccggggttcccctagggtcgtttaccggagtcgggactaggtaggagttccggtcgggaacttacgtaccttttaccccaacccgtccaacctacgtaccgtaagtaccgcgtacgggtaactccgttaaggacgagttcgccgtaacgaccttaaccttacttacgttcgtaacctagttaccttacgttttaacgtttaccggttaccggtaccgtaccggttacccggaccggtaacggtactacggaaggttacggaacgttaacgtaaacggtacggtaggttaccggcgtacg

SEQ ID NO: 224127 - DNA, 1081 bp, Homo sapiens
  misc_feature: GYAE6OF02IP6JN.48.30.C08.1.454.CMB.1.raw
  modified_base (170)..(170): a, c, t, g, unknown or other
  misc_feature (170)..(170): n is a, c, g, or t
  modified_base (182)..(182): a, c, t, g, unknown or other
  misc_feature (182)..(182): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcattgggtttctgctgctcgtgggttccancctcgagggtanaattgtcgctgactcattccccagtactttcgagtactcgtgactaccgaaaggtacgaaacgtcgaaccactccaacctcggccgggccaacggacccgaagtacggactacgtttacggttagggttaacgttttaaccgaccgttacgggtaaccctaacgggaccgtaaaacgggaaaaccctaaggtaacgttaccgtaaaggttacccttaaacccgtaaaacgtccccgtttaccccggtactaaacttaccgtaaaacggttaagttccggtacccgtttaccgaacggttacctaaccgttcccgttacggttacccggggttaaccccgtttggtaaaccgggttttacgaacgggttcggtaccggttaaacgggttacgggtaccggtttaaccggttacggggtaaaccgtaacggttttaaaccccgttttacccgtaaacccccgtttacccaaaacccggtttaaccttaaaccggtttaaaacgtaacccgggttaacccgggttaaccgggttaaaccggtacccggttaaaggtaaacgggttaaaacccgttttaccggggtaccttaaaccgggtaaacccccttttaaaacccgttttaaacgttttaaacccgggtttaccgtttaacccgaaaccgtttttaaacccgggttaaacggttttttaaaaaccgggtttttttaccggggttttaaccccggttaccccgggggtttaaccctttacccggggggttaaacccgggtaaaccggggttaaaaccccggtaccgggttaaaaccggggtttaaccggtaaaaccggttaaaccggttttttaaaaacccgggaaaccggtttaacggggtttacccgggtaacccggttaaacccggg

SEQ ID NO: 224128 - DNA, 704 bp, Homo sapiens
  misc_feature: GYAE6OF02IMLUT.48.30.C08.1.454.CMB.1.raw
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
tcagagtatacatacacgaccggtgctcgatttagtctgacgtcaaagggaagggggtatcttaaaagaggttctttctctgggatgtggcatgagcaaaactgacaagtcaaggcaggaagatgttgccatcacaactcattgggtttctgctgctctgggttccagcctccgagggtanaaattgngctgactcattccccagactttcagtctgtgactaccgaaaggagaaaagtccaacctataccgaaccgtcggtcccggggaccaggccgagacgactagttcggtaggttacttttaccacgttggtaaccaggtacaacgaaaccagactcaagtcctaccaaagccttaccncacttacaagttntcgtccttcgagtccactcgtcggccggggttacccctggtacgttcgagtacgacgtaaggtcgggtacttccggtagggaacgtacggttaactttaccgacccctacgaaccctacttacgaaacgtaccgcgtaacgggaacgtacgtacggaactacgtcgtacgtcgtaacctaaccttacgttactacgttactacgtactaacgtttaacgttttacgttaacggttccggtaaccgtttaccgggaccgtaaacgggacctaacggtaccggtaagggtaacgtaacgttaaaccgtacgtacggtttacgcgttaacg

SEQ ID NO: 224129 - DNA, 1009 bp, Homo sapiens
  misc_feature: GYAE6OF02IKG64.48.30.C08.1.454.CMB.1.raw
  modified_base (153)..(153): a, c, t, g, unknown or other
  misc_feature (153)..(153): n is a, c, g, or t
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
tcagagtatacatacacgaccggtgctcgatttagtctgacgtcaaagggaaagggggtatcttaaaagaggttctttctctgggatgtggcatgagacaaaaactgacaagtcaaggcaggaagatgttgccatcacaactcattgggttcngctgtctcgtcgggttccagtcctccgtagggttnaaattgtgcgttanacctctacttaccctagttacctttcagtcttgtcgtacctaacgtaaaagggaagtaaacgtccaaccgtacttacccgtacccgtaccggccggggaccccaacgtaccgacggtaccggtaccttacggtttaccgggttcgggtttaaaccggttttacccgtaaaccgggtttaccgggtaaccctaacggtaacccgaaaacggtaaaaaccccgtaggttaaccttaccggtaaccggtttaaccccttaaacccgtaaaacggttccccttaccgtaacgtaaccgttaaaccgtaaggtttaacctcgggttaccccgttaccggtaccgttaccgtaccgtttccggttaccccgggttcccggggttaccccgtaggttaacgggtttacgacggttcgggtaacggttaggttccggtaagtttcccggggtaacggtactttaccggtttaaacccttcccccgtttaaccccgtaaacccgtaacctttaaacgtacggtaaaccctttaaccggggaccggtttaagggttaacctacgggttaaacgggtaacgttgtacccgtacggttaacccgttaaacccgtttaacccgtttacgtttaacgtccttaacttaaccgttaactttaaaccggtttttttcggtttaaccggttccgggttaacccgtttaacccgttaccggggtaacggtacccgggttaaccgaaccggtttaaccgggtaaacggttaacgttaacccgggtttaaaacggtccgggtttaacggtccccgtaaacttccggg

SEQ ID NO: 224130 - DNA, 740 bp, Homo sapiens
  misc_feature: GYAE6OF02I6NCN.48.30.C08.1.454.CMB.1.raw
  modified_base (134)..(134): a, c, t, g, unknown or other
  misc_feature (134)..(134): n is a, c, g, or t
  modified_base (147)..(147): a, c, t, g, unknown or other
  misc_feature (147)..(147): n is a, c, g, or t
  modified_base (186)..(186): a, c, t, g, unknown or other
  misc_feature (186)..(186): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (570)..(570): a, c, t, g, unknown or other
  misc_feature (570)..(570): n is a, c, g, or t
tcagagtatacatacacgaccggtgctcgatttagtctgacgtcaaagggaaggggtatcttaaagaggttctttctctgggatgtggcatgggcaaaactgacagtcaaggcaggagatgtgcagtcacactnattgggttctgcncgtctcgttcggtcagtcctacgtagggtataagttcgngtctgactacgtactacccagttaacttcgacttcgtacggtctacgtactaaggacgtaagtccacctacgttccaccgtcggccgcgacgccgtagtacgtctaacgttcggtagttagttaccncgttacggaccncgtacgaacgtaacgtacgtacgtctaccggtactaaccgtaaccgtactaccgtacgacttaccgtaacggttctaaccgttccggtaaccgtacgttacctacgttccgttaaccggtcccggttacctacggttacggtacgtacggtacgtcggtacgtacgtaactcggggtaacctagttacggtaccttccgacccgtaactcgacgttactaacggtcgtaaccgtgaccggttaancgtaagtcgaaaccgtgtaactaccgttaacgttacttacgtacttactaacgtcgtttacgttaacgtttcggaccgttaccgtacgttaccggtaacgaccgggtacttaaccggacgttaacgtaacgttaccgttaacggtctaacggtacgtaccgcttaacccg

SEQ ID NO: 224131 - DNA, 853 bp, Homo sapiens
  misc_feature: GYAE6OF02F7IW4.48.30.C08.1.454.CMB.1.raw
tcagagtatacatacacgaccggtgctcgatttagtctgacgtcaaaaggggaaaggggggtatcttaaaaagaggttctttcttctgggatgtggcatgagcaaaactgacaagtcaaggcaggaagatgttgccatcacaactcattgggttctgctgctcgtgggttccagcctccgaggggtgtaaagttgtgctgacctctacttcccccgagtacctttcagtctgtacgacctaccgaaaggagaaagtccaccatccaccgtcggccggccagccagagcagttgtggtattacagtcgtaccagacaacgaaccagtactctagtcctaacccgaaagtccttacctcacttacgaaagttactcggtaccttaccggacgttcccacttcgttccgttccgggggttacccctacggtacggttacgacggttcggacgtaacgggtgtaccggtaccgggttaggggaacccttaaagggttaccctttaccccgaacccccgttacccaacccggtaaacttaccgtaaaacggtcccggtaaccggttaagggaaaccgtcggtttaaggaaaggtacgttccgtaaccggtttacccgaaccgttaaaaccctttaaccggtttacgttaccgtacccgttaagttaacccgtaaaccggttttttacgttttttaacccggggttaccgtttacccgggggttacccgttaacccgggggtaaacccgtaaacggggtaaccccccgtacggggttaaaccgttaagggttaaaccgggtttaaacctttaaaacccgggtaacgggtttccggggttaccgttaaccggtaacccgg

SEQ ID NO: 224132 - DNA, 715 bp, Homo sapiens
  misc_feature: GYAE6OF02I1PAL.48.30.C08.1.454.CMB.1.raw
  modified_base (395)..(395): a, c, t, g, unknown or other
  misc_feature (395)..(395): n is a, c, g, or t
  modified_base (536)..(536): a, c, t, g, unknown or other
  misc_feature (536)..(536): n is a, c, g, or t
  modified_base (707)..(707): a, c, t, g, unknown or other
  misc_feature (707)..(707): n is a, c, g, or t
tcagagtatacatacacgaccggtgctcgatttagtctgacgtcaaagggaaagggggtatcttaaaagaggttctttctctgggatgtggcatgagcaaaactgacaagtcaaggcaggaagatgttgccatcacaactcagttgggtttctgctgctcgtggttccagccctcgaggggtgaaattgtgactgactcacttcccagtacctttcgagttctggtacgacctaccgaaaggaataacgtccacctactaccaccgtcgggccgggaccacggccctaaggacgaccttagttcgggttaggttaaacgtttacaccgttacggtaccgacgaccaaacggaaaccctagaagtcgtacgttccaaccgaagtcctaccccgtanaacgtactaagttcttcgaccgttacgaccttccagttccttcggtcccggttccaggttacttcgagcggtcagggtcgtacgtcggtaacggacgtaacggttcttcccgaacccttcgaaaccttatacaacgttacnccggttagaaccgtgttaacgacgtatcgcgtaaccgtacttaacgttcttacgcgtacacggttaacttcgttaaccgttttacgtttacgccgttacgttccgggaaacttacggaccgttacgtacggtaacggtaactaacgggtaaaccctggttacgggttaccncggtaccg

SEQ ID NO: 224133 - DNA, 432 bp, Homo sapiens
  misc_feature: GYAE6OF01CEQ7W.29.70.G04.1.454.CMB.1.raw
  modified_base (427)..(432): a, c, t, g, unknown or other
  misc_feature (427)..(432): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtctccccctggccgccctgcctccaggagcacctccgagagcacagcggccctgggctgcctggtcaaggactacttccagtactctatctgagcgggctggcaaggcgcatagnnnnnn

SEQ ID NO: 224134 - DNA, 429 bp, Homo sapiens
  misc_feature: GYAE6OF01EQQB2.29.70.G04.1.454.CMB.1.raw
  modified_base (424)..(429): a, c, t, g, unknown or other
  misc_feature (424)..(429): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttcccctggcgccctgctccaggagcacctccgagagcacagcggccctgggctgcctggtcaaggctacttccagtactctatctgagcgggctggcaaggcgcatagnnnnnn

SEQ ID NO: 224135 - DNA, 436 bp, Homo sapiens
  misc_feature: GYAE6OF01AQ0DM.29.70.G04.1.454.CMB.1.raw
  modified_base (425)..(425): a, c, t, g, unknown or other
  misc_feature (425)..(425): n is a, c, g, or t
  modified_base (430)..(436): a, c, t, g, unknown or other
  misc_feature (430)..(436): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgagactggggccagggaaccccggtcaccgtctccccagcctccaccaagggccccatccggtccttccccctggccgccctgctcccgaggagccacctccgagagcacagccggccctgggctgcctggtcaaggactactccagtactctatctgagcgggctggcaggcncatgnnnnnnn

SEQ ID NO: 224136 - DNA, 432 bp, Homo sapiens
  misc_feature: GYAE6OF01DT53G.29.70.G04.1.454.CMB.1.raw
  modified_base (427)..(432): a, c, t, g, unknown or other
  misc_feature (427)..(432): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttccccctggcgccctgctccaggagcacctccgagagcacagcggccctggggctgcctggtcaaggactacttccagtactctatctgagcgggctggcaaggcgcatagnnnnnn

SEQ ID NO: 224137 - DNA, 437 bp, Homo sapiens
  misc_feature: GYAE6OF01B5OH9.29.70.G04.1.454.CMB.1.raw
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (425)..(437): a, c, t, g, unknown or other
  misc_feature (425)..(437): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacagggcatctactactgcgcgacatcggtgacccagtggcagttgttccttgaagactggggccagggaaccccggtcaccgtctcccagcctccaccaagggcccatcggtctccccctggccgccctgctccaggagcacctccgagacgcacagcggccctgggctgcctggtcaaggctacttccagtactctatctgagcgggntggcaaggcncatgnnnnnnnnnnnnn

SEQ ID NO: 224138 - DNA, 437 bp, Homo sapiens
  misc_feature: GYAE6OF01ED6M7.29.70.G04.1.454.CMB.1.raw
  modified_base (425)..(437): a, c, t, g, unknown or other
  misc_feature (425)..(437): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgtccttgaagactggggccagggaaccccggtcaccgtctcccagcctccaccaagggcccatcggtcttccccctggcgccctgctccaggagcacctccgagagcacagcggccctgggctgcctggtcaaggactacttccagtactcgtatctgagcgggctggcaaggcgcatagnnnnnnnnnnnnn

SEQ ID NO: 224139 - DNA, 509 bp, Homo sapiens
  misc_feature: GYAE6OF01DY4NB.29.70.G04.1.454.CMB.1.raw
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
  modified_base (480)..(480): a, c, t, g, unknown or other
  misc_feature (480)..(480): n is a, c, g, or t
  modified_base (501)..(501): a, c, t, g, unknown or other
  misc_feature (501)..(501): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccggggcagtccctgagactctcgtgtgaaggctctggattcacattcagtgacgtctggatgagctgggtccgccagactccgagggaagggctagagtgggtgcgnattacaagtcagaggaccagtgggaaagnggactagagtgtaccccgtgaagggcagattctcgtatttcgcgagatgatctagaagatacgtgtatctacatatgagtgcctgcgagccgagacacgaggcatctatacngacgcgacagtcggagacccngtggtacg

SEQ ID NO: 224140 - DNA, 431 bp, Homo sapiens
  misc_feature: GYAE6OF01D4ME6.29.70.G04.1.454.CMB.1.raw
  modified_base (425)..(431): a, c, t, g, unknown or other
  misc_feature (425)..(431): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttccccctggcgccctgctccaggagcacctccgagacgcacagcggccctgggctgcctggtcaaggctacttccagtctctatctgagcgggctggcaaggcgcatagnnnnnnn

SEQ ID NO: 224141 - DNA, 430 bp, Homo sapiens
  misc_feature: GYAE6OF01D38M0.29.70.G04.1.454.CMB.1.raw
  modified_base (427)..(430): a, c, t, g, unknown or other
  misc_feature (427)..(430): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggccccatccggtcttccccctggccgccctgctccaggagcacctccgagagcacagcgccctgggctgcctggtcaaggactactccagtactctatctgagcgggctggcaaggcgcatagnnnn

SEQ ID NO: 224142 - DNA, 438 bp, Homo sapiens
  misc_feature: GYAE6OF01CQWTL.29.70.G04.1.454.CMB.1.raw
  modified_base (428)..(438): a, c, t, g, unknown or other
  misc_feature (428)..(438): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcacccgtctccccagcctccaccaagggccccatcggtcttccccctggcgccctgctccaggacgcacctccgagagcacagcggccctgggctgcctggtcaaggctacttccagtactctatctgagcgggctggcaaggcgcatagnnnnnnnnnnn

SEQ ID NO: 224143 - DNA, 434 bp, Homo sapiens
  misc_feature: GYAE6OF01A07BK.29.70.G04.1.454.CMB.1.raw
  modified_base (426)..(434): a, c, t, g, unknown or other
  misc_feature (426)..(434): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttccccctggcgccctgctccaggagcacctccgagacgcacagcggccctgggctgcctggtcaaggactactccagtactctatctgagcgggctggcaaggcgcatagnnnnnnnnn

SEQ ID NO: 224144 - DNA, 430 bp, Homo sapiens
  misc_feature: GYAE6OF01B7OH5.29.70.G04.1.454.CMB.1.raw
  modified_base (426)..(430): a, c, t, g, unknown or other
  misc_feature (426)..(430): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttcccctggcgccctgcctccaggagcacctccgagacgcacagcggccctgggctgcctggtcaaggctacttccagtactctatctgagcgggctggcaaggcgcatagnnnnn

SEQ ID NO: 224145 - DNA, 558 bp, Homo sapiens
  misc_feature: GYAE6OF01D3B4W.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccggggagcttggtagagccggggcagtccctgagactctcgtgtgaaggctctggattcacattcagtgacgtctggatgagctgggtccgccagactccgagggagggctaggagtgggttgccgcatacgaagtcaggagggaccagtgggaaagaggactagtgtacgtccccgtagaagggcagtacttctacgtatttcgtcgagtatgatctagaagtaataccgttgtaactctacatagtagagtacgcctagcgacgcggacggacacgaggtactagtcctaactactcggaccgaccgaactacggtaccggtacgaccccgtaggtcggtacg

SEQ ID NO: 224146 - DNA, 434 bp, Homo sapiens
  misc_feature: GYAE6OF01CALXD.29.70.G04.1.454.CMB.1.raw
  modified_base (421)..(421): a, c, t, g, unknown or other
  misc_feature (421)..(421): n is a, c, g, or t
  modified_base (427)..(434): a, c, t, g, unknown or other
  misc_feature (427)..(434): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggccccatcggtcttccccctggccgccctgctccaggagcacctccgagacgcacagcggccctgggctgcctggtcaaggactacttccagtactctatctgagcgggctggcaaggcncatagnnnnnnnn

SEQ ID NO: 224147 - DNA, 720 bp, Homo sapiens
  misc_feature: GYAE6OF01D08H1.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggacgcaccatggagtttgggctgaggtggtattttgcttgttactattttaaaaggtgtccagtgtgcggtgctatttgagtgggagggtccgggggaggtcgttgggtaggacggccggggctacgtcccgtgacgtacctcgtcgtggtagaaggtctcgtggtattcactattcgaagtgacgtctggatgagtcgtcggggtcccaccgtagacctccggaagggaacgggctaggaggtcgggtcgtacggcttagtaggtcggcgtagggtgggtcggcgtacttaagttattaagtttagtcgacgacggtacccggtaccggttagggtaaccggggtccccgtttaccgaaccctttacgtttacccgaaggtaacgtaactaacgtaaccggaaacgtaacgacgtcttagtactcgtaaggactaaaggtggtaagacgtaccgtagacgtacctacgaacgaaccgtaccggtccttactaagtttacgttggttaaggttaaacggcgtaaggtacggtaacggggtaaaccgggtaacccgggggaccccgggttaccctaggtccgggtaaccccgg

SEQ ID NO: 224148 - DNA, 431 bp, Homo sapiens
  misc_feature: GYAE6OF01D4LMW.29.70.G04.1.454.CMB.1.raw
  modified_base (343)..(343): a, c, t, g, unknown or other
  misc_feature (343)..(343): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (427)..(431): a, c, t, g, unknown or other
  misc_feature (427)..(431): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattatcgatttctcgagatgatctgaagaataccgtgtatctacatatgagtggcctgcgagccgaggacataggcatctactactgcgcgacatcggtgaccccagtggcagttgttccttgaagactggggccagggaaccccggtcaccgtctccccagcctccaccaagggcccatcggtcttccccctggccgccctgctccaggacncacctccgagagcacagcggccctgggctgcctggtcaaggctactccagtactctatctgagcgggntggcaaggcncatagnnnnn

SEQ ID NO: 224149 - DNA, 645 bp, Homo sapiens
  misc_feature: GYAE6OF01AG9KG.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcacattcagtgacgttctggatgagctgggtccgcagactccgagggaagggctaggaggtgggttggccgcattacgaagtcaggagggaccagtggggaaagaggacttagtaggtcggttcccccgtagaagggccaaggatttccgtacggtactttttccgaccggtaagtattcggaacttccgtaggtaaacgtaacgttacccggttagttaacttcctaactaatttaactaggtaacggttcggtcccgttaggccgggtaacggaccccgggaagggaccaccggagggacctagtacccttaacgtaccgtcggcccgacggtaccgacgttcgggtaccgacccgtaggttcggtaccg

SEQ ID NO: 224150 - DNA, 508 bp, Homo sapiens
  misc_feature: GYAE6OF01A96QU.29.70.G04.1.454.CMB.1.raw
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgtggtgcatttgatggagtccgggggaggcttggtagagccggggcagtccctgagactctcgtgtgaaggctctggattcacattcagtgacgtctggatgagctgggtccgccagactccagggagggctagagtgggttgccgcattacagtcagagggaccagtgggaaagnggactatagtgtccccgtnaagggcagattctcgatttctcgagatgatctgaagaataccgtgtatctacatatgagtgcctgcgagccgaggacacgaggcatctactactgcgcgacatcggnaccccngtggtac

SEQ ID NO: 224151 - DNA, 434 bp, Homo sapiens
  misc_feature: GYAE6OF01BB6GF.29.70.G04.1.454.CMB.1.raw
  modified_base (420)..(420): a, c, t, g, unknown or other
  misc_feature (420)..(420): n is a, c, g, or t
  modified_base (426)..(434): a, c, t, g, unknown or other
  misc_feature (426)..(434): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgaccccagtggcagttgttccttgaagactggggccagggaaccccggtcaccgtctccccagcctccaccaagggcccatcggtcttccccctggcgccctgctccaggagcacctccgagagcacagcggccctgggctgcctggtcaaggctacttccagtactctatctgagcgggctggcaaggcncatagnnnnnnnnn

SEQ ID NO: 224152 - DNA, 433 bp, Homo sapiens
  misc_feature: GYAE6OF01C1HFX.29.70.G04.1.454.CMB.1.raw
  modified_base (426)..(433): a, c, t, g, unknown or other
  misc_feature (426)..(433): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttcccctggcgccctgctccaggacgcacctccgagagcacagcggccctgggctgcctggtcaaggctacttccagtactctatctgacgcgggctggcaaggcgcatagnnnnnnnn

SEQ ID NO: 224153 - DNA, 430 bp, Homo sapiens
  misc_feature: GYAE6OF01EHIW2.29.70.G04.1.454.CMB.1.raw
  modified_base (419)..(419): a, c, t, g, unknown or other
  misc_feature (419)..(419): n is a, c, g, or t
  modified_base (425)..(430): a, c, t, g, unknown or other
  misc_feature (425)..(430): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttccccctggcgccctgctccaggagcacctccgagagcacagcggccctgggctgcctggtcaaggctacttccagtactctatctgagcgggctggcaagggcncatagnnnnnn

SEQ ID NO: 224154 - DNA, 523 bp, Homo sapiens
  misc_feature: GYAE6OF01CBFPW.29.70.G04.1.454.CMB.1.raw
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
  modified_base (514)..(514): a, c, t, g, unknown or other
  misc_feature (514)..(514): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccggggcagtccctgagactctcgtgtgaaggctctggattcacattcagtgacgtctggatgagctgggtccgccagacctccgagggaaggggctaggagtgggttggccgcattacaagtcagagggaccagtgggaaagaggactatagtgtccccgtgaagggcagattctcgatttcncgagatgatctagaanaataccgtgtatctacatatgagtgactgcgagcgaggacacaggcatctactacgtcgccgacgactagtccggtgaacccnggtggtacg

SEQ ID NO: 224155 - DNA, 577 bp, Homo sapiens
  misc_feature: GYAE6OF01C9PAV.29.70.G04.1.454.CMB.1.raw
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggtattttgcttgttacctaattttaaaaggtgtccagtgtgcggtgcatttgatggagtccgggggaggcttggtagaggccggggcagtccctgagactcgtcgtgtgaaggctctggattcactattcagtgacgtctggatgagcgtgggtccncagactccgaggggagggctagnggtgggtgccgnattacagtcagaggaccagtagggaaagngactatagtcgtccccgtagaagggcaagtactttctacgtatttccacggagtaatgattcgtagaaagaacttaccgttgttaactactaacattaagtggagtcggcctggcgacggccgaaggaccacgaggcacgttactaaccgttactcggacgcgaactacggttaccggtaccgaacccgtggtcgggtac

SEQ ID NO: 224156 - DNA, 549 bp, Homo sapiens
  misc_feature: GYAE6OF01CXW6J.29.70.G04.1.454.CMB.1.raw
  modified_base (534)..(534): a, c, t, g, unknown or other
  misc_feature (534)..(534): n is a, c, g, or t
  modified_base (541)..(541): a, c, t, g, unknown or other
  misc_feature (541)..(541): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctcgtggattcactattcagtgacgtctggatggagcgtcgggtccgccagacctccgaaggggaagggctaggagtgggtcgccgcattacaagtcaagagggaccagtagggaaagaggaactagtaggtcgtcccgtacgaagggcaagtattctcgtatttctcgagtatagattctagtaaacgaataccgtagtatctaacattatagagtgcctgcgagccgaggacacgaggcatcctatactcgacgacgactacgtcggngacccgngtcggacg

SEQ ID NO: 224157 - DNA, 541 bp, Homo sapiens
  misc_feature: GYAE6OF01BMBM7.29.70.G04.1.454.CMB.1.raw
  modified_base (352)..(352): a, c, t, g, unknown or other
  misc_feature (352)..(352): n is a, c, g, or t
  modified_base (466)..(466): a, c, t, g, unknown or other
  misc_feature (466)..(466): n is a, c, g, or t
  modified_base (496)..(496): a, c, t, g, unknown or other
  misc_feature (496)..(496): n is a, c, g, or t
  modified_base (532)..(532): a, c, t, g, unknown or other
  misc_feature (532)..(532): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctattttaaaaggtgtccagtgtgcggtgctatttgatggaggtccgggggagcgttggtagaggccggggcagtccctgagactctcgtgtgaaggctctggattcacattcagtgacgtctggatgagcgtcgggtccgcagacctcgaggggaagggctaggaggtgggttcggccgnattaacgagtcaggacgggacagtagggaaagaggactataggtcgtacccggtagaagggcaagtattcacgtatttcgcgagatgatcgtagaagataccgtagtatctaanatatagagtcggcctgcgacgcgagacagngacatccatacgtgcgagactacgtcggacacccgnggtcggtac

SEQ ID NO: 224158 - DNA, 515 bp, Homo sapiens
  misc_feature: GYAE6OF01DH0G0.29.70.G04.1.454.CMB.1.raw
  modified_base (501)..(515): a, c, t, g, unknown or other
  misc_feature (501)..(515): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgattttctcgagatgatctgaagaataccgtgtatctacatatgagtggcctgcgagccgaggacacaggcatctactactgcgcgacatcggtgacccagtggcagtttgttccttgaagactggggccagggaaccccggtcaccgtctccccagcctccaccaacgggccccagtccggtccttccccccgtggcccgccctcgcctcccgagggacgccacccgtccgagacgcacgacggcccggcccctggggccttcggcccgttgggtaccaaacgggaccttaccttcccaaggtttacctccttaattccgtggaacggccggggtcttcgggaccgaacgggccgacagtaggnnnnnnnnnnnnnnn

SEQ ID NO: 224159 - DNA, 450 bp, Homo sapiens
  misc_feature: GYAE6OF01C3C1N.29.70.G04.1.454.CMB.1.raw
  modified_base (230)..(230): a, c, t, g, unknown or other
  misc_feature (230)..(230): n is a, c, g, or t
  modified_base (326)..(326): a, c, t, g, unknown or other
  misc_feature (326)..(326): n is a, c, g, or t
  modified_base (342)..(342): a, c, t, g, unknown or other
  misc_feature (342)..(342): n is a, c, g, or t
  modified_base (436)..(450): a, c, t, g, unknown or other
  misc_feature (436)..(450): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtnacccagtggctagttgttcctagaagactggggccaggggaaccccggtcaccgtcctccccagccctccaccaacggcccatccggtcttccccngcgccctgctcaggancacctccgagacgcacacgcggccctgggctgcctcggcaaacggactacttccagtactctatcgtgagcgggctggacaaggcgcagtacgnnnnnnnnnnnnnnn

SEQ ID NO: 224160 - DNA, 532 bp, Homo sapiens
  misc_feature: GYAE6OF01CVWQH.29.70.G04.1.454.CMB.1.raw
  modified_base (496)..(496): a, c, t, g, unknown or other
  misc_feature (496)..(496): n is a, c, g, or t
  modified_base (506)..(506): a, c, t, g, unknown or other
  misc_feature (506)..(506): n is a, c, g, or t
  modified_base (514)..(514): a, c, t, g, unknown or other
  misc_feature (514)..(514): n is a, c, g, or t
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggaggtccgggggaggcgttggtagagccggggcagtccctgagactctcgtgtgaaggctctggattcactattcagtgacgtctggatgagcgtcggtccgccagacctccgaaggggagggctaggaggtgggtcggccgcattacaagtcgaggaggaccagtagggaaagaggactagtagtcgtacccgtagaagggcagtattctcgtatttcgtcgagtatgatcgtagaaagtaataccgtgtactactactatatgtagtgcctgcgagcgagacacgngcatcatacngcgcgacngtacggnaccngtgtacg

SEQ ID NO: 224161 - DNA, 443 bp, Homo sapiens
  misc_feature: GYAE6OF01BA8PR.29.70.G04.1.454.CMB.1.raw
  modified_base (431)..(443): a, c, t, g, unknown or other
  misc_feature (431)..(443): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgtccttgaagactggggccagggaaccccggtcaccgtctccccagccctccaccaagggccccatcggtcttccccctggccgccctgcctccaggagccacctccgagagcacagcggccctgggctgcctggtcaaggactacttccagtactctatctgagcgggctggcaaggcgcatagcnnnnnnnnnnnnn

SEQ ID NO: 224162 - DNA, 463 bp, Homo sapiens
  misc_feature: GYAE6OF01BWUC1.29.70.G04.1.454.CMB.1.raw
  modified_base (439)..(439): a, c, t, g, unknown or other
  misc_feature (439)..(439): n is a, c, g, or t
  modified_base (448)..(463): a, c, t, g, unknown or other
  misc_feature (448)..(463): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgtccttgaagactggggccagggaaccccggtcaccgtctccccagcctccaccaacgggccccatccggtccttccccctggccgccctgcctccaggacgccacctcccgagacgcacacgcggccctgggctcgcctggtcaaggactacttccagttactctatcgtgacgcggggctgggccaagggccgnaagtagcgnnnnnnnnnnnnnnnn

SEQ ID NO: 224163 - DNA, 496 bp, Homo sapiens
  misc_feature: GYAE6OF01ATGJF.29.70.G04.1.454.CMB.1.raw
  modified_base (475)..(475): a, c, t, g, unknown or other
  misc_feature (475)..(475): n is a, c, g, or t
  modified_base (479)..(496): a, c, t, g, unknown or other
  misc_feature (479)..(496): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgttccttgaagactggggccaggggaaccccgtcaccgtctccccagccctccaccagggccccagtccggtccttccccctggccgccctgcctccgaggacgccaccctccggacgacgccacgacgccggacccgtggggcctcggcccgtgggtaccaagggtacctaccgttcccagttacctcttactcgtaggacgcggggtctgggaccgaacggcacagtaggntcgnnnnnnnnnnnnnnnnnn

SEQ ID NO: 224164 - DNA, 779 bp, Homo sapiens
  misc_feature: GYAE6OF01CTO21.29.70.G04.1.454.CMB.1.raw
tcagatagagtactcacgaccggtgctcgatttagtgtagtgtgaagggaaaggggagctctgggagaagacgccccagccttgggattcccaagtgctttcattcagtgagcaggactgaacacagaggactcaccatggagtttgggctggaggtggtattttgctttgttacctaattttaaaaggtgtccagtgtgcggtgctatttgagtgggaggtccgggggaggtcgttgggtaggacgggccgggggctacggttcccgtaggagaccttcgtcggtgtaggaaggtctcgtggattcactattcagttgacgttcgtaggatggagtcggtcgggtcccgaccagtacccgtccggaagggggaacgggtcgtaaggtacgggttcgggggttcggcccgtactaagtttaaccgaaagtcggaagggtaacgggaccgaaagggtaagggaaaacgtagggtaacttaagttacggttacccggtaccccgtaggaacgggtctaaggttactttccgtacgttaacttttccggacgtagttagtcgaacttacgtaaggaaacgtaacgttaccgttagttaattactaactaagtttagtacgggtacggttaccgggccttacgggacggtaacccggccgggtaaacggaaccgaaccggacggtaccttaacgttaccgttaacccgtacggtcccggaccgtaaccgaaccgttaccgggttaccgggtaacccgaaaccccgtggggttccggttaaccg

SEQ ID NO: 224165 - DNA, 447 bp, Homo sapiens
  misc_feature: GYAE6OF01C8QSB.29.70.G04.1.454.CMB.1.raw
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (436)..(447): a, c, t, g, unknown or other
  misc_feature (436)..(447): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaaggcccatcggtccttccccnggccnccctgcctccagacgccacctccgagacgcacagccggccctggggctgcctggtcaaaggactacttccagttacctctatctgagcggggctggcaaggcgcatacgnnnnnnnnnnnn

SEQ ID NO: 224166 - DNA, 441 bp, Homo sapiens
  misc_feature: GYAE6OF01D44U3.29.70.G04.1.454.CMB.1.raw
  modified_base (426)..(426): a, c, t, g, unknown or other
  misc_feature (426)..(426): n is a, c, g, or t
  modified_base (432)..(441): a, c, t, g, unknown or other
  misc_feature (432)..(441): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccacgggaaccccggtcaccgtctccccagcctccaccaagggcccatcggtccttcccctggccgccctgctccaggcgcacctccgagacgcacagccggccctgggctcgcctggtcaaggactacttccagtactctatctgacgcgggctggcaaggcncagtgnnnnnnnnnn

SEQ ID NO: 224167 - DNA, 524 bp, Homo sapiens
  misc_feature: GYAE6OF01BJNGU.29.70.G04.1.454.CMB.1.raw
  modified_base (396)..(396): a, c, t, g, unknown or other
  misc_feature (396)..(396): n is a, c, g, or t
  modified_base (417)..(417): a, c, t, g, unknown or other
  misc_feature (417)..(417): n is a, c, g, or t
  modified_base (448)..(448): a, c, t, g, unknown or other
  misc_feature (448)..(448): n is a, c, g, or t
  modified_base (490)..(490): a, c, t, g, unknown or other
  misc_feature (490)..(490): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcacattcagtgacgtctggatgagctgggtccgccagactccgaggggaagggctaggaggtgggtggccgcattacaagtcaggagggaccagtgggaaagaggactagtagtgtccccgtnaagggcagattcgtgatttcncgagatgatcagaacgataccgtgtatctanatatgagtgctggcgagcgaggacacgagcagtcctactacncgccgcgactacgtcggtagaccctggtcggacg

SEQ ID NO: 224168 - DNA, 603 bp, Homo sapiens
  misc_feature: GYAE6OF01CU3ZD.29.70.G04.1.454.CMB.1.raw
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
  modified_base (589)..(589): a, c, t, g, unknown or other
  misc_feature (589)..(589): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgtacctattttaaaaggtgtccagtgtgcggtgcatttgatggagtccgggggagtcttggtagaggccggggnagtccctgagactctcggtgtgaaggctcgtggattcatattcagtgacgtctggatgagcgtcgggtccncgagacctccgaaggggaacgggctaggaggtggggtcggccgctagttacgaagtcgaaggacggaccagtagggaaagaggactagtacgtcgtcccgtagaagggcagtattctcgtatttcgcgagtatagatcgtagaaataacgtaccgtgtaactctaacgattaagtgtacgtcggcctggacgacgaccggaaggtaccacgacggactaacgttacctaaccgtacttcggccgtaaccgacgtaccggttacgggacccgaacccgnggttcgggtacccg

SEQ ID NO: 224169 - DNA, 432 bp, Homo sapiens
  misc_feature: GYAE6OF01B0XN4.29.70.G04.1.454.CMB.1.raw
  modified_base (425)..(432): a, c, t, g, unknown or other
  misc_feature (425)..(432): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgaccccagtggcagttgttccttgaagactggggccagggaaccccggtcaccgtctccccagcctccaccaagggcccatcggtctccccctggcgccctgctccaggagcacctccgagagcacagcggccctgggctgcctggtcaaggctacttccagtactctatctgagcgggctggcaaggcgcatagnnnnnnnn

SEQ ID NO: 224170 - DNA, 538 bp, Homo sapiens
  misc_feature: GYAE6OF01AJUJW.29.70.G04.1.454.CMB.1.raw
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (398)..(398): a, c, t, g, unknown or other
  misc_feature (398)..(398): n is a, c, g, or t
  modified_base (522)..(522): a, c, t, g, unknown or other
  misc_feature (522)..(522): n is a, c, g, or t
  modified_base (528)..(528): a, c, t, g, unknown or other
  misc_feature (528)..(528): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatgggagtccgggggaggcttggtagagccggggcagtccctgagactctcgtgtgaaggctctggattcacattcagtgaccgtctggatgagcgtgggtccnccagactccgaggggagggctagngtgggttgccgnattacaagtcaaggagggaccagtagggaaagaggactagtagtcgtccccgnaacgggcagatctcgtatttcgcgagtatgatcgtagaagtatacgtgtatctaacattatagagtcggtcctagcgagccgaggacacgaggcagtctactactgcgacgactagtcgggtanacccgnggtggtaccg

SEQ ID NO: 224171 - DNA, 441 bp, Homo sapiens
  misc_feature: GYAE6OF01BXUDN.29.70.G04.1.454.CMB.1.raw
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (421)..(441): a, c, t, g, unknown or other
  misc_feature (421)..(441): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccgtcaccgtctccccagcctccaccaaggcccatccggtcttcccccnggcgccctgctcagngcacctcgangcacagcggccctgggctggcctggtcaaggctactccagtactctatctgagcgggctggcaaggcgcagtagnnnnnnnnnnnnnnnnnnnnn

SEQ ID NO: 224172 - DNA, 697 bp, Homo sapiens
  misc_feature: GYAE6OF01C0TI9.29.70.G04.1.454.CMB.1.raw
  modified_base (342)..(342): a, c, t, g, unknown or other
  misc_feature (342)..(342): n is a, c, g, or t
tcagatagagtactcacgaccggtgctcgatttagtgtagtgtgaagggaaaggggagctcgtgggagaagacgccccagccttgggattcccaagtgctttcattcagtgagcaggactgaacacgagaggactcaccatggagtttggcttgaggtggtattttgcttgttacctattttaaaaggtgtccagtgtgcggtgctatttgatgggacgtccgggggagtcgttggtagaggccggggcacgtccctagacgacttcgtcggtgtagaaggtcttcgtggacttcaacgtattcagttagacgttcgtaggtatggacgtcggtcggtcccnccgaagtaccgtccgaagggggaacggctagggaggtgggttcggccgtacgtagttaacaaggtcgaaggacggacgaagtagggaaagaggtacttagtacggtcgtacccgtagaagggactagtacgttcgtacgtacttttcgacgtagtaagtgtaacgttcgtaggtaaaagtaacgttaccggtattaacttacgtaacttaagttacgttaggtaacggtttcgggaccgttggaccggtaacggaccggaaacggaaccctacgggagaccgttaacgtaaccgttatacccggtcgccgtaacccgtacgtacgtccggtacccgaaccgtggtaaccggttcg

SEQ ID NO: 224173 - DNA, 427 bp, Homo sapiens
  misc_feature: GYAE6OF01DH106.29.70.G04.1.454.CMB.1.raw
  modified_base (275)..(275): a, c, t, g, unknown or other
  misc_feature (275)..(275): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (416)..(427): a, c, t, g, unknown or other
  misc_feature (416)..(427): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagctggggccagggaccccgtnaccgtctcccagcctccaccaggcccatcggtctccctgcncctnctcaggacncacctccgagacgcacagccggccctggggctgcctggtcaaggctacttccagtctctatctgagcgggctggcaaggcacatagnnnnnnnnnnnn

SEQ ID NO: 224174 - DNA, 575 bp, Homo sapiens
  misc_feature: GYAE6OF01DFFGX.29.70.G04.1.454.CMB.1.raw
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
  modified_base (565)..(565): a, c, t, g, unknown or other
  misc_feature (565)..(565): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcagtttgatgggaggtccgggggaggcgttggtagaggccggggcagtccctgagactctcgtgtgaaggctctggattcactattcagtgacgtctggatgagcgtcgggtccgccacgacgtccgaaggggaaggggctaggaggtgggtggccgntattacaagtcgaggagggaccagtagggaaagnggactagtagtcgtccccgtnaacgggcagtacttctcgtatttcgtcgagtatgacttcgtagaaacgtaataccgttagtaactacttaacattagtagagtcggactgacgacggcgaggaccacaggctagtcctactactggaccgcgaactagtaccggtacgaccgnggtcggtacg

SEQ ID NO: 224175 - DNA, 423 bp, Homo sapiens
  misc_feature: GYAE6OF01D4V13.29.70.G04.1.454.CMB.1.raw
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (408)..(408): a, c, t, g, unknown or other
  misc_feature (408)..(408): n is a, c, g, or t
  modified_base (415)..(423): a, c, t, g, unknown or other
  misc_feature (415)..(423): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagcaggggccagggaccccggtcaccgtctccccagcctccaccagggcccatcggtctcccctggcnccctgctcagcncacctcgagngcacagcgcctgggctcgcctggtcaaggctactcagtctctatctgagcgggctggcaaggccncatacgnnnnnnnnn

SEQ ID NO: 224176 - DNA, 522 bp, Homo sapiens
  misc_feature: GYAE6OF01B1CS5.29.70.G04.1.454.CMB.1.raw
  modified_base (493)..(522): a, c, t, g, unknown or other
  misc_feature (493)..(522): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagacgtggggccaacggggaacccccggtcacccgtcctccccagccctcccaccaacgggccccagtccggttccttccccccgtggcccgcccctgcctccaggacgccaccctccgagacgcacgacgccggcccgtgggcctcgccgtggtaccaaacggaccttaccttccacgttacctcgtactcgtaggacggccggggtctagggaccgaagggccgctaagtcgctagcnnnnnnnnnnnnnnnnnnnnnnnnnnnnnn

SEQ ID NO: 224177 - DNA, 589 bp, Homo sapiens
  misc_feature: GYAE6OF01CJZJK.29.70.G04.1.454.CMB.1.raw
  modified_base (365)..(365): a, c, t, g, unknown or other
  misc_feature (365)..(365): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaggtgtccagtgtgcggtgcatttgatggagtccgggggaggcgttggtaggaggccggggcagtccctgagactctcgtgtgaaggctctggattcacattcagtgacgtcgtggatggacgcgtcggggtcccgccgagaccgtcccggaaggggaaggggctaggaggttggggttcggccgntatacaagtcaggagggaccagtagggaagaggactagtagtcggtcccgtagaacgggcagtattcgtcgtaatttcacggagatgattacaggaaacgtaactaccgtagtacttctaataatataggtacgtcggcctagggccaggacccgaaggaccgacgacggacacgttctactactcggcctcgactacgtcggtaccggaccctggtcggtacg

SEQ ID NO: 224178 - DNA, 456 bp, Homo sapiens
  misc_feature: GYAE6OF01BIF8C.29.70.G04.1.454.CMB.1.raw
  modified_base (228)..(228): a, c, t, g, unknown or other
  misc_feature (228)..(228): n is a, c, g, or t
  modified_base (352)..(352): a, c, t, g, unknown or other
  misc_feature (352)..(352): n is a, c, g, or t
  modified_base (435)..(435): a, c, t, g, unknown or other
  misc_feature (435)..(435): n is a, c, g, or t
  modified_base (440)..(456): a, c, t, g, unknown or other
  misc_feature (440)..(456): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtnacccagtggctaggttgttccttgaagcgtggggccagggaccccggtcaccgtcctcccagcctccaccagggcccactcggtcttcccctggccgccctgcctccaggacgccacctccganacgcacgacgcggcccgtgggctcgcctggtacaacggcctacgttccagtactctactcgtgacgcgggctggacaaggcgnatagnnnnnnnnnnnnnnnnn

SEQ ID NO: 224179 - DNA, 618 bp, Homo sapiens
  misc_feature: GYAE6OF01CNKUJ.29.70.G04.1.454.CMB.1.raw
  modified_base (279)..(279): a, c, t, g, unknown or other
  misc_feature (279)..(279): n is a, c, g, or t
  modified_base (427)..(427): a, c, t, g, unknown or other
  misc_feature (427)..(427): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatgggaggtccgggggaggcttggtagaggccggggcagtccctgagactctcgtgtgaaggctctggattcanattcagtgacgtctggatggagcgtcggggtcccgccaggacctccgagggggaacggggctagggaggttggggttcggccgactagttaccgaagtcgaaggacgggaccaagtagggaaagaggaactagtagtcggtaccccgngaagggcagtacttcgtcgtatttcgacgagtatagattcgtagaaagtaactaccgtgttaactctaactatagtggacgtcggcccttggacgacggcccggaaggaccacgacggcaacgttcctaactacgtcggaccgacgtaacgtacggttaccgggtacgaaccccgtgggttccgggtaacg

SEQ ID NO: 224180 - DNA, 433 bp, Homo sapiens
  misc_feature: GYAE6OF01C07HV.29.70.G04.1.454.CMB.1.raw
  modified_base (325)..(325): a, c, t, g, unknown or other
  misc_feature (325)..(325): n is a, c, g, or t
  modified_base (422)..(433): a, c, t, g, unknown or other
  misc_feature (422)..(433): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccgtcaccgtctcccagcctccaccaagggcccatcggtcttccccctggccnccctgctccaggagcacctccgagacgcacagcggccctgggctgcctggcaaggctactccagtctctatctgagcgggctggcaaggcgcatagnnnnnnnnnnnn

SEQ ID NO: 224181 - DNA, 427 bp, Homo sapiens
  misc_feature: GYAE6OF01BL3AA.29.70.G04.1.454.CMB.1.raw
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
  modified_base (409)..(409): a, c, t, g, unknown or other
  misc_feature (409)..(409): n is a, c, g, or t
  modified_base (414)..(427): a, c, t, g, unknown or other
  misc_feature (414)..(427): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgagactggggccagggaaccccggtcaccgtctccccagcctccaccagggcccatcggtctcccctggcnccctgctccagcncacctcgagancacagccggcctggctgcctggcaggctactcagtactctatctgagcggcgtggcaaggcanatagnnnnnnnnnnnnnn

SEQ ID NO: 224182 - DNA, 641 bp, Homo sapiens
  misc_feature: GYAE6OF01DDRM0.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggatttgcttgtaccattttaaaaggtgtccagtgtgcggtgctatttgatgggaggtccgggggaggcgttggtaggaggcccggggcacggtcccctgacgtactcgtcgtgtagaggctcgtggattccatattcgagtgacgtctggatgagcgtcgggtcccgccagacctaccgaggggaaggggctaggacgggtgggttcggccgatattaacgaagtcgagaacggaccagtagggaaagagactagtacgtcgtaccccgtagaagggcaagtacttccgtagtatttcccgagagtaacgtgacttacgtagaaagtaacgttaccgttagtacttacgtaacattaagtggaacggttcggccttggacgaacggtaccggaacgaaccaacggaggcctaacgtacccttaacgtacgtcggccggacgtaacctacggttacccgggagaaacccccggtggtcgggtaccg

SEQ ID NO: 224183 - DNA, 442 bp, Homo sapiens
  misc_feature: GYAE6OF01DNG6Y.29.70.G04.1.454.CMB.1.raw
  modified_base (430)..(442): a, c, t, g, unknown or other
  misc_feature (430)..(442): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttcctgaagactggggccagggaccccggtcaccgtctccccagcctccaccaagggccccatccggtccttccccctggccgccctgcctccaggacgcacctccgagacgcacagccggccctggctcgcctgtcaaggctacttccagtactctatctgacgcgggctggacaggcgcatgnnnnnnnnnnnnn

SEQ ID NO: 224184 - DNA, 436 bp, Homo sapiens
  misc_feature: GYAE6OF01AU81B.29.70.G04.1.454.CMB.1.raw
  modified_base (414)..(414): a, c, t, g, unknown or other
  misc_feature (414)..(414): n is a, c, g, or t
  modified_base (420)..(436): a, c, t, g, unknown or other
  misc_feature (420)..(436): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgttccttgaagactggggccagggaaccccggtcaccggtctccccagcctccaccaggcccatcggtctcccctgcgccctgcctccaggagcaccgtccgagagcacagccggccctgggctgcctggcaaggctacttccagtactctatctgagcgggctggcaggcncatcgnnnnnnnnnnnnnnnnn

SEQ ID NO: 224185 - DNA, 438 bp, Homo sapiens
  misc_feature: GYAE6OF01BIPQ8.29.70.G04.1.454.CMB.1.raw
  modified_base (277)..(277): a, c, t, g, unknown or other
  misc_feature (277)..(277): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (394)..(394): a, c, t, g, unknown or other
  misc_feature (394)..(394): n is a, c, g, or t
  modified_base (419)..(438): a, c, t, g, unknown or other
  misc_feature (419)..(438): n is a, c, g, or t
tcagatagagtactcacgaccggtgctcgatttagtgtagtgtgaagggaaaggggctagagtgggttggccgcattacaagtcagagggaccatgggaaagaggactatagtgttcccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaacccggtnaccgtctccccagcctccacaaggcccatcggtctcccctgcncctgctcaggcncacncgagncacngcgccnggctgcctgcaagactactcagtacctctatctagacgcgggngtacggcgaacggcgactagtagcnnnnnnnnnnnnnnnnnnnn

SEQ ID NO: 224186 - DNA, 525 bp, Homo sapiens
  misc_feature: GYAE6OF01DEM5R.29.70.G04.1.454.CMB.1.raw
  modified_base (377)..(377): a, c, t, g, unknown or other
  misc_feature (377)..(377): n is a, c, g, or t
  modified_base (455)..(455): a, c, t, g, unknown or other
  misc_feature (455)..(455): n is a, c, g, or t
  modified_base (481)..(481): a, c, t, g, unknown or other
  misc_feature (481)..(481): n is a, c, g, or t
  modified_base (516)..(516): a, c, t, g, unknown or other
  misc_feature (516)..(516): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagaggccggggcagtccctgagactctcgtgtgaaggctctggattcatattcagtgacgtctggatgagcgtgggtccgccagactccgaggggaagggctaaggaggtgggtggccgcattacagtcaggagggaccagtgggaaagnggactagtagtcgtaccccgtgaagggcagtacttctcgtatttcgcgagatgatctagaagtaatacgtgtatctanatatgagtgctgcgagcgagacacgngcatctactcgtcgcgacgacacgtcggagacccngtcggtacg

SEQ ID NO: 224187 - DNA, 552 bp, Homo sapiens
  misc_feature: GYAE6OF01EKE6V.29.70.G04.1.454.CMB.1.raw
  modified_base (344)..(344): a, c, t, g, unknown or other
  misc_feature (344)..(344): n is a, c, g, or t
  modified_base (414)..(414): a, c, t, g, unknown or other
  misc_feature (414)..(414): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccggggcagtccctgagactctcgtgtgaaggctctggattcacattcagtgacgtctggatgagcgtgggtccgccagactccgaggggagggctaggagtgggttggccgnattacaagtcaggacgggaccagtagggaaagaggactagtagtcgtccccgtagaagggcaggtattcncgtattttcaggagatgattctaggaaactaataccgtgtactctaacatatgagtggcctgcgagccgaggacacgacggcagtcctatacgtcggaccgaccgaacgtacgtccggtacgacccctggtggtaccg

SEQ ID NO: 224188 - DNA, 661 bp, Homo sapiens
  misc_feature: GYAE6OF01A0KJ7.29.70.G04.1.454.CMB.1.raw
  modified_base (508)..(508): a, c, t, g, unknown or other
  misc_feature (508)..(508): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctattttaaaaggtgtccagtgtgcggtgcatttgatggagtccgggggagcttggtagaggccggggcacgtccctgacgactcgtcgtgtgaaggctcgtggacttcactattcagtgacgtctggatgagcgtgggtccgccgacgaccgtccgaaggggagggctaggaggttgggtcggccgcgtaacttacgaacgtcgaaggacgggaaccaggtaagggaaagaggtactagtacgtccgtaccccgtagaagggtcagttacgttctacgtacttttcgacgtaagtataggacttcgtaagaagtaacttacggtagtactactaanagtataggagtcggtaccgtgggaaccgacggtacccgggaagacccgtaacggacggtaccgttaagttaccccttaacgacccggttcggacccggaaccgtaccgttaggttcccggtaccggaaccccgttaggggtccggttacccgg

SEQ ID NO: 224189 - DNA, 432 bp, Homo sapiens
  misc_feature: GYAE6OF01D00M2.29.70.G04.1.454.CMB.1.raw
  modified_base (324)..(324): a, c, t, g, unknown or other
  misc_feature (324)..(324): n is a, c, g, or t
  modified_base (349)..(349): a, c, t, g, unknown or other
  misc_feature (349)..(349): n is a, c, g, or t
  modified_base (398)..(398): a, c, t, g, unknown or other
  misc_feature (398)..(398): n is a, c, g, or t
  modified_base (418)..(418): a, c, t, g, unknown or other
  misc_feature (418)..(418): n is a, c, g, or t
  modified_base (424)..(432): a, c, t, g, unknown or other
  misc_feature (424)..(432): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccgtcaccgtctccccagcctccaccaagggcccatcggtcttcccctggccnccctgctccaggacgcacctccganagcacagccggcccgtggctgcctggcaaaggctacttccagtctctanctgagcgggctggcaaggcncatagnnnnnnnnn

SEQ ID NO: 224190 - DNA, 538 bp, Homo sapiens
  misc_feature: GYAE6OF01EDLCO.29.70.G04.1.454.CMB.1.raw
  modified_base (344)..(344): a, c, t, g, unknown or other
  misc_feature (344)..(344): n is a, c, g, or t
  modified_base (506)..(538): a, c, t, g, unknown or other
  misc_feature (506)..(538): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttccccctggccgccctgctcccaggagcncccctaccgacgagacaccaacgccggcccgtcgggccgtcgccgtcgggttaccaaacggtaacgttaacctttacccgtacggttaaccttaccttacgttaccgttccggaaggccggggtccgttcgggaccggaacggaccgggccaagttaagcgnnnnnnnnnnnnnnnnnnnnnnnnnnnnnnnnn

SEQ ID NO: 224191 - DNA, 543 bp, Homo sapiens
  misc_feature: GYAE6OF01ERXWR.29.70.G04.1.454.CMB.1.raw
  modified_base (508)..(508): a, c, t, g, unknown or other
  misc_feature (508)..(508): n is a, c, g, or t
  modified_base (510)..(543): a, c, t, g, unknown or other
  misc_feature (510)..(543): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaccccggtcaccgtcctccccagccctccaccaacgggcccacgtccggtccttcccccgtggccgccctcgcctccgacggcgccacccgtccgacgacgacacgacggccggcccgtcggggcctcgtcccgtgggtaccaaacgggtaccttaccttaccgacgttaccttcttaactccgttagggacggtccggggtaccttacgggaccgtaaacggggccgactaagtacgancnnnnnnnnnnnnnnnnnnnnnnnnnnnnnnnnnn

SEQ ID NO: 224192 - DNA, 605 bp, Homo sapiens
  misc_feature: GYAE6OF01BAVC7.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcgttggtagaggccggggcacgtccctgagactctcgtgtgaaggctctggattcactattcagtgacgtctggatggagcgtcggggtcccgccgagacctccggaagggggaacggggctaggaggttggggttcggccgagtaacttacgaagtcgaaggacgggaccagtagggaaagaggactagtaggtcgtccccgtagaacgggcagtacttcgtcgtatttcgtcgaagtatgatcgtagaaagtaacgttaccgttagtaacttctaactatagtaggagtcggcctggcgacggaccgaggaccacgaggactagtcctaactacgtcgacccgacgacgtacggtaccggtacgaccccgtggtcggtacg

SEQ ID NO: 224193 - DNA, 499 bp, Homo sapiens
  misc_feature: GYAE6OF01D8WDF.29.70.G04.1.454.CMB.1.raw
  modified_base (480)..(480): a, c, t, g, unknown or other
  misc_feature (480)..(480): n is a, c, g, or t
  modified_base (487)..(499): a, c, t, g, unknown or other
  misc_feature (487)..(499): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgaccccagtggcagttgttccttgaagactggggccacgggaaccccggtcaccgtcctccccagccctccaccgaacgggccccagtccggtccttccccccgtggccgccctcgcctcccgaggacgccacccgtccgagacgccaccgaggcccggcccgtggggcctcggcccgtgggtaccaaagggtaccttacctttcccgacgttacctcctatccgtggacggcgggctagggcaagggccncagtagnnnnnnnnnnnnn

SEQ ID NO: 224194 - DNA, 533 bp, Homo sapiens
  misc_feature: GYAE6OF01APIHJ.29.70.G04.1.454.CMB.1.raw
  modified_base (231)..(231): a, c, t, g, unknown or other
  misc_feature (231)..(231): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (503)..(512): a, c, t, g, unknown or other
  misc_feature (503)..(512): n is a, c, g, or t
  modified_base (514)..(533): a, c, t, g, unknown or other
  misc_feature (514)..(533): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcgggtnacccagtggcagtttcgttccttgaagtacgtcggggccacgggaaccccgtcacccgtcctccccagccctccgaccaacgggccccagtccggtccttcccccgnggccgccctagcctccagggcnccacccgtcgacgcgccacgacgcccggcccgtgggcctcggcctgggtacaacgggtacctaccgttccgacgttacctcgtaacttcgtaggacggtccgggtacgtcgggacgaacggccgactacgtaagcagcatgcnnnnnnnnnncnnnnnnnnnnnnnnnnnnnn

SEQ ID NO: 224195 - DNA, 510 bp, Homo sapiens
  misc_feature: GYAE6OF01DGMU3.29.70.G04.1.454.CMB.1.raw
  modified_base (338)..(338): a, c, t, g, unknown or other
  misc_feature (338)..(338): n is a, c, g, or t
  modified_base (492)..(510): a, c, t, g, unknown or other
  misc_feature (492)..(510): n is a, c, g, or t
tcagatagagtactcacgaccggtgctcgatttagtgtagtgtgaagggaaaggggctagagtgggttggccgcattacaagtcagagggaccatgggaaagaggactatagtgtcccccgtcaagggcagattctcgattttctcgagaatctgaagaataccgtgtatctacatatgagtggcctgcgagcccgaggacacgaggcatcctactactgcgcgacatcggtgacccagtggctaggttgttccttgacgacgtggggccacgggacccccggtcaccgtcctccccagcctccaaccgaacggccccagtccggtcccttcccccgnggtccgcccctgcctccgacggacgccaccgtcccgaagacgcacgacggtccggcccgtggggcctcgcctcgggtacaacgggccttaccttccaacgttcttcgtacgtctaggacgggccgggtcgtgggtacgaacggcgctaagtcgnnnnnnnnnnnnnnnnnnn

SEQ ID NO: 224196 - DNA, 802 bp, Homo sapiens
  misc_feature: GYAE6OF01EL8U7.29.70.G04.1.454.CMB.1.raw
  modified_base (257)..(257): a, c, t, g, unknown or other
  misc_feature (257)..(257): n is a, c, g, or t
tcagatagagtactcacgaccggtgctcgatttagtgtagtgtgaagggaaaggggagctctgggagaagagccccagccttgggattcccaagtggctttcattcagtgagcaggactgaacacagaggactcaccatggagtttggactggaggtggtattttgctttgttaccattttaaaagtgttccagtgtgcggtgcatttgatggaggtccgggggagtcgtttggtagaggtccggggcacgttcccnggacgtactcttcggtgtaggaaggtcctctgggtattcgactagttaccgaggttcgacggttcctaggtacgtcggacggtaccgttacgggggttaccccgacccgtaacggtaacccgttaccccgggaaaggggggaaccggggtaccgttaagggtaacgggtttcggggggtttaccgggacccggtactaacgtttaaccgaaacggttacggaaggggacggggtaaacccgtaagggttaaggggaaaaagggtaacggtaaacgttaacggttaacggttcccggttaccccccggttagggaaaccggggtacgtaacggttagttttacccgttacgggttaactttttcccgaaggtaacggtaatagttacgtcgttaaaggaacgttaaacgttacccgttattacttactaacgattacgtggacggttccgacgtgaccggtacggaccgagggtaccacggtcggactacgtactacgtaacgtcgacccgcgaacgtcgtaccggtacgacccgtggtggtaccg

SEQ ID NO: 224197 - DNA, 525 bp, Homo sapiens
  misc_feature: GYAE6OF01C88U0.29.70.G04.1.454.CMB.1.raw
  modified_base (368)..(368): a, c, t, g, unknown or other
  misc_feature (368)..(368): n is a, c, g, or t
  modified_base (496)..(496): a, c, t, g, unknown or other
  misc_feature (496)..(496): n is a, c, g, or t
  modified_base (498)..(525): a, c, t, g, unknown or other
  misc_feature (498)..(525): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgagacacgaggcatctactactgcgcgacatcggtcgacccagtggctagtttcgttccttagaacgcgtggggccgaacggggacccccggtcaccgtcctccccagccctccaccgaacgggcccctacgtccggtcccttcccccgcggcctccccgtcgcctccgacggacnccaccctccgagacgcacacggccggcccgtgggcctcgtccgtggtaccaacggtacttacccttccgacgttaacctcttactccgtaggcggtccgggccgtagggccgaacggcgtacaagtgngnnnnnnnnnnnnnnnnnnnnnnnnnnnn

SEQ ID NO: 224198 - DNA, 703 bp, Homo sapiens
  misc_feature: GYAE6OF01BOF6L.29.70.G04.1.454.CMB.1.raw
  modified_base (625)..(625): a, c, t, g, unknown or other
  misc_feature (625)..(625): n is a, c, g, or t
  modified_base (637)..(637): a, c, t, g, unknown or other
  misc_feature (637)..(637): n is a, c, g, or t
tcagatagagtactcacgaccggtgctcgatttagtgtagtgtgaagggaaagggggacggtaggagtgggttggccgcattacaaggtcagagggaccatgggaaacgaggactactagtgtccccgtccaacggcagattctcgatttctcgagatgagtctgaagaataccgtgtatctacatactcgagtgcctgcgacgcgagacacgaggcatctactactgcgcgacatcggtgaccccagtacggacaagtttgttccttgtaaagtacgtacggggaccaacggggaaaccccggtcgaacccggtcctccccgacgtcccttcccgaaccgaacggggacccctaacgttaccgggttaaccttcccccccgtagggcccggccccgtacggcccttccccgaagggacgcctaaccccgttccggacgacggcctaccgacggcccggcccgtcgggccgtccggaccgttacgggtacgaaacggtaccttaacgttacccgtaacggttaccttaccgttaattccggtaggtaaccgggaccggggtcgtacgggaccgaaaggggtccgaccgtaaggtacgagtctaacgtcgtgacgagagacgacgngtagaccgtagngtacgtgtacggtcgagacgacgacgtcgacgcgtacgcggcgtacgacgacgccgccgccgtccg

SEQ ID NO: 224199 - DNA, 552 bp, Homo sapiens
  misc_feature: GYAE6OF01A6PNA.29.70.G04.1.454.CMB.1.raw
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
  modified_base (522)..(552): a, c, t, g, unknown or other
  misc_feature (522)..(552): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtgctgcgagccgaggacacaggcatctaactactgcgcganactcggtcaccccaggtcggctagtttcgttccttggaagacgtcgggggccaacggggaaccccggtcaccgtccnccccagccctccaccgaacggccccagtccggtccttcccccgtcggccgccctgcctccgaggtacgcctaccgtcgacggacgacacgacggcccggccgtcgggcctcggcctagggaccaacgggtaccttaccgtaccctaagttaccttacttaaccgttcgtacgggacggtccgggggtactacggggactaaacggggccgactaagtcgagcnnnnnnnnnnnnnnnnnnnnnnnnnnnnnnn

SEQ ID NO: 224200 - DNA, 614 bp, Homo sapiens
  misc_feature: GYAE6OF01E2JI4.29.70.G04.1.454.CMB.1.raw
  modified_base (324)..(324): a, c, t, g, unknown or other
  misc_feature (324)..(324): n is a, c, g, or t
  modified_base (355)..(355): a, c, t, g, unknown or other
  misc_feature (355)..(355): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggtattttgcttgttacctattttaaaaggtgtccagtgtgcggtgctatttgatgggaggtccggggggagtcgttgggtaggacggccggggcacggtccctgacgtactcgtcgtgtgaaggctctggattcactattcagtgacgtctggatgagcgtgggtccncagactccgagggaggctagagtgggtgcgnattacagtcaggacggacagtagggaaagagtactagtacggtcgtccccgtagaagggcgagtacgttcgtcgtactttcgtcgtagtatgtagtcgtagtaagtaacgtaccgtagtactactactacttagtagtacggtcggtccgtggacgtttacggaccggtacggacgacgacggactacgtaccgttacgtacgtcgaccggtaccgaaccgtacgttaccgggtaccgtacccgtaggtcggttaccgg

SEQ ID NO: 224201 - DNA, 558 bp, Homo sapiens
  misc_feature: GYAE6OF01EFGJG.29.70.G04.1.454.CMB.1.raw
  modified_base (235)..(235): a, c, t, g, unknown or other
  misc_feature (235)..(235): n is a, c, g, or t
  modified_base (360)..(360): a, c, t, g, unknown or other
  misc_feature (360)..(360): n is a, c, g, or t
  modified_base (519)..(519): a, c, t, g, unknown or other
  misc_feature (519)..(519): n is a, c, g, or t
  modified_base (522)..(526): a, c, t, g, unknown or other
  misc_feature (522)..(526): n is a, c, g, or t
  modified_base (528)..(532): a, c, t, g, unknown or other
  misc_feature (528)..(532): n is a, c, g, or t
  modified_base (534)..(540): a, c, t, g, unknown or other
  misc_feature (534)..(540): n is a, c, g, or t
  modified_base (542)..(558): a, c, t, g, unknown or other
  misc_feature (542)..(558): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtgcctgcgagccgaggacacgaggcatctactactgcgcgacatcggtgacccngtgctagttgttccttgaagacgtggggccacggggaaccccggtcaccgtcctccccagccctccaccgaacggccccatcccggtcccttcccccgcggcccacccctccctaccgaacgacnccaacccgttcgtcgggggcaccgacgacgaccgcccgtgggcctcggcctcgggtacaaacgggtacccttaccgttacctcgttaaccgttcctagttaccgtcggtaacgggccgggtaccgtgggtaccggaaacgggccgtacgaagttacgcngtnnnnncnnnnncnnnnnnncnnnnnnnnnnnnnnnnn

SEQ ID NO: 224202 - DNA, 582 bp, Homo sapiens
  misc_feature: GYAE6OF01BUTLG.29.70.G04.1.454.CMB.1.raw
  modified_base (252)..(252): a, c, t, g, unknown or other
  misc_feature (252)..(252): n is a, c, g, or t
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
  modified_base (356)..(356): a, c, t, g, unknown or other
  misc_feature (356)..(356): n is a, c, g, or t
  modified_base (574)..(574): a, c, t, g, unknown or other
  misc_feature (574)..(574): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccggggcagtccctgagactntcgtgtgaaggctctggattcactattccagtgacgtctggatgagcgtcgggtccnccgagacctcgaggggaaggggctaaggnggtaggggttcggccgtntaacttacgaagtcgaaggacgggaccagtagggaaacggaggaactatacggtccggtacccccgtagaaacgggcaggtaacttctaccgtactttcgtaccgagtatgatcgtagaagaataccgtagtatctacatatagagtggtcctgcgacggccgaaggacacgacggcacgtctactacgtgaccgacgactacgtcggtagaccccgngtggtacg

SEQ ID NO: 224203 - DNA, 642 bp, Homo sapiens
  misc_feature: GYAE6OF01AKIW9.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggaggtccgggggagcttgggtagaggccgggggcagtccctggagactctcggtgtgaaggctcgtggacttcacattcagtgacgtctggatgagcgtcgggtccgccgagactccggaaggggaacggggctaggagggtggggttcggccgcgtaattacgaagtcgaaggaacgggaccaggtagggaaagaggtaactagtaggtccggtccccgtacgacgggcaagtacttcgtacgtactttcgacgagtagtgatcgtagaagtaacgtacgtagtacttactaacgattagtagtaggtcggtccgtaggacggacgaccgggaacggaccgacggacgacgtaacgtacgttaacctacggtcgacccggtaccggaaactacggtacgggttaccgaccccggttagggtccgggttaacgg

SEQ ID NO: 224204 - DNA, 645 bp, Homo sapiens
  misc_feature: GYAE6OF01CHO90.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagaggccggggcagtccctgagactctcgtgtgaaggctctggattcactattcgagtgacgtcgtggatggagtcgtgggtcccgccaggacctccgaggggacgggctaggaggtgggttgccgactattaccgaagtcgaaggacgggaaccagtacggaaagaggactagtacgtcgtacccggtacgaagggcaagtactttctacgtatttcgagtaagtagtgtaacgtcgtaaggtaaacgtaacttacccggttattaacgttacctaactagttaacgtacgtaggtcggtaccgttggaccgtacggaccggaacggtaccaaccggaggacctaacgttccgtaacctacggtcgaccggtacgaactacggttcccgggtacgacccggttagggtcggtaccg

SEQ ID NO: 224205 - DNA, 649 bp, Homo sapiens
  misc_feature: GYAE6OF01A1CEM.29.70.G04.1.454.CMB.1.raw
  modified_base (237)..(237): a, c, t, g, unknown or other
  misc_feature (237)..(237): n is a, c, g, or t
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttggctgaggtggattttgcttgttaccattttaaagtgtccagtgtgcgtgcatttgatggaggtccgggggagtcgttggtagaggccgggnagtccctgagactcgtcgtgtgaaggctcgtaggtattcactattcgagtcgacgtntggatggagtcgtggggtcccncgagtaccgtaccggaaggggaacgggtctaggaggttggggttacggccgtcgtaagttaccgaaggtcaagggtacggaccaggtagggaaagtaggtactagtagtcgtaccccgtagaacggtcgaagtacttcgtacggtatttcgacgagtactagaattcgtaaggaagtaacgttaccgttagttaactactaataacgtgttagacgtcgggtcctaggacgacggacccggaaggaaacccctaggacggaccgtaacttccgtaacgtaccgtcgacccgtagaactaccgggtaggtacccgaaccctagggtcggtaccg

SEQ ID NO: 224206 - DNA, 643 bp, Homo sapiens
  misc_feature: GYAE6OF01AMAGL.29.70.G04.1.454.CMB.1.raw
  modified_base (313)..(313): a, c, t, g, unknown or other
  misc_feature (313)..(313): n is a, c, g, or t
  modified_base (340)..(340): a, c, t, g, unknown or other
  misc_feature (340)..(340): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatgggagtccgggggaggtcgttggtagaggccggggcagtccctgagactctcgtgtgaaggctcgtggattcactattcagtgacgtctggatgagcgtcgggccnccacgactccggaggggagggctaggnggttgggttcggaccgctattacgagtcgaaggacggaccagtagggaaagaggaactagtagttcggtccccgtagaacgggacagtattcctacgtagtttccgacggtagtagttacgactctaggtaaacgtaacgttaccgttagtacttacgtaactaattagtacggtaaggtccggtaccgttgggaccggtacggacccgtaagggacccgaacgtacggccttaacgtccttaaacgtacgtccgggaccgacgtacctacggtaccgggtaccgacccgtggtccggtaacg

SEQ ID NO: 224207 - DNA, 456 bp, Homo sapiens
  misc_feature: GYAE6OF01BXYVI.29.70.G04.1.454.CMB.1.raw
  modified_base (422)..(423): a, c, t, g, unknown or other
  misc_feature (422)..(423): n is a, c, g, or t
  modified_base (441)..(456): a, c, t, g, unknown or other
  misc_feature (441)..(456): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgagactggggccacgggaaccccggtcaccgtctccccagccctccaccaagggcccagtccggtccttcccccgtggccgccctgctccaggacgccacctccgagacgcacacgcgcccgtgggctgccgtggtcgaacgactaccttccagtactctatctgagcggnnggcaacggtcgacatagnnnnnnnnnnnnnnnn

SEQ ID NO: 224208 - DNA, 687 bp, Homo sapiens
  misc_feature: GYAE6OF01BLK7L.29.70.G04.1.454.CMB.1.raw
  modified_base (328)..(328): a, c, t, g, unknown or other
  misc_feature (328)..(328): n is a, c, g, or t
  modified_base (405)..(405): a, c, t, g, unknown or other
  misc_feature (405)..(405): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctattttaaaaggtgtccagtgtgcggtgcatttgagtgggaggtccgggggaggtcgttaggtagacggccggggcacggtccctgacgactctcgtgtgaaggctcgtggtattcactattcgagtgacgtctaggatggacgcgtcggggcccncagacctaccggaggggaacgggctaggaggtgggttcgccgatagtacgaagtcgaggaggacagtacgggaaagngactatacgtcgtacccgtagaaggactagtacgttcgtacgtatttcgtacgtaagtacgtagtacgttacgtaaggtaaactaacgttaccgtagttacttacgttaactaacgttaagtacgggtaggtccggtacccgtagggtacccggacggacccgggtaaacggacccgaacggaaccggtacctaaccgttacttaaccccgttaacggtccgggaccgtaaccggaaccgttcgtaccccgggtactaccccgggagggttacgggtaccgg

SEQ ID NO: 224209 - DNA, 487 bp, Homo sapiens
  misc_feature: GYAE6OF01CQ0P3.29.70.G04.1.454.CMB.1.raw
  modified_base (354)..(354): a, c, t, g, unknown or other
  misc_feature (354)..(354): n is a, c, g, or t
  modified_base (459)..(460): a, c, t, g, unknown or other
  misc_feature (459)..(460): n is a, c, g, or t
  modified_base (462)..(487): a, c, t, g, unknown or other
  misc_feature (462)..(487): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacagtcggtgacccagtcggctagtttgttccttgaagacgtggggccagggaaccccggtcacccgtctccccagcctccaccaagggccccagtccgtccttcccccgtggcccgccctgcctccagggcnccacctccggagacgcacgagcccggcccgtgggctcgccgtggcgaaggacctaccttccagtactcgtatcgtggagcgggctgggaaccaggccgcaagtgnncnnnnnnnnnnnnnnnnnnnnnnnnnn

SEQ ID NO: 224210 - DNA, 645 bp, Homo sapiens
  misc_feature: GYAE6OF01B4TSY.29.70.G04.1.454.CMB.1.raw
  modified_base (326)..(326): a, c, t, g, unknown or other
  misc_feature (326)..(326): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctattttaaaaggtgtccagtgtgcggtgctatttgatgggaggtccggggggaggtcttgggtaggaggccgggggcacggtccctgagactcgtcgtgtagaaggctcgtggattcactattcagtgacgtcgtggatgagcgtcgggtcccncgagacgtccggaggggacgggctaggaggttggggttcggccgactagttacgaagtcgaaggacgggaccagtagggaaagagatagtagtcgtccccgtagaagggcagtactttcgtacgtacttttcgacggtagtagtgacttacgtaggtaaaacgtaacgttacccgttagtacttacctaacgtattaagtggaacggtcggtccgttaggccggtacgacccgggaaggtaaccacggacggactacgttaccgtacgtacgtcggccgacgacgtacggtaccgggtaccacccgtgggtccgtacgg

SEQ ID NO: 224211 - DNA, 679 bp, Homo sapiens
  misc_feature: GYAE6OF01BWMOY.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggaggtccgggggagcgttggtagaggccggggcacgtccctgacgactctcgtgtgaaggctctggattcactattcagtgacgtctggatgagcgtgggtcccgcagacctccgagggagggctaggaggtgggttcggccgctattacgaagtcaggacggggaccaggtacgggaaaagaggacgtagtaggtcgtacccccgtagaacggggtcaaggtactttaccgtacgtaacttttccgtacggtaagtaagttgtaattaccgttaaggaaagtaaacgttaccggttagttaaacttcccgttaaataacttaagtacgggtaaggttcggggtacccgttagggacccgacggtacccgggaacgggtaaccaaccggtagggaacctacgttaccgttaacgtaccgtcggaccgtaccgactaccggtcggtaccgaccccgtagggtccggttacgg

SEQ ID NO: 224212 - DNA, 526 bp, Homo sapiens
  misc_feature: GYAE6OF01CCQJD.29.70.G04.1.454.CMB.1.raw
  modified_base (174)..(174): a, c, t, g, unknown or other
  misc_feature (174)..(174): n is a, c, g, or t
  modified_base (396)..(396): a, c, t, g, unknown or other
  misc_feature (396)..(396): n is a, c, g, or t
  modified_base (517)..(526): a, c, t, g, unknown or other
  misc_feature (517)..(526): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgatttctcgagatgatctgaaagaataccgtgtatctanatatgagtgcctgcgagccgaggacacgaggcatctactactgcgcgacagtcggtacacccgaggtcggactaggtttcgttccttaggaagtacggtcggggaccgaaccggggaaccccggtcaacccgtcctccccgacgtcccctccgaaccgaaccgggccccagtcccggttcccttcccccgtggcccgccctgtccaccgaggacgcctaccncggacacgcaccacggtccggcccgtggctcggccgtaggtacgaacggtacttaccgttaccgaagttacctcctatccgtagacggcggtacgtcgggacgaacgggtcaccgagacgnnnnnnnnnn

SEQ ID NO: 224213 - DNA, 999 bp, Homo sapiens
  misc_feature: GYAE6OF01B6JBG.29.70.G04.1.454.CMB.1.raw
  modified_base (978)..(978): a, c, t, g, unknown or other
  misc_feature (978)..(978): n is a, c, g, or t
tcagatagagtactcacgaccggtgctcgatttagtgtagtgtgaagggaaaggggagctctgggagaagacgccccagccttgggattcccaagtgctttcattcagtgagcaggactgaacacagaggactcaccatggagtttgggctgaggtggtatttgcttgttacctaattttaaaaggtgtccagtgtgcggtgctagttgagtgggaggtccggggggaggtcgttgggtaggacggcccgggggacgtacggtccccgtggacgtaccgttccgttcggtaggtacggaaggtccttcgttagggtactttccaacttacgttaccgtaggttacggtaccggtttcgtagggtagtacggtacggtccgggttccggggtcccccgtacccgaacggtaccccgtaacccggggaaaggggggtaacgggggtacttaaggggttagggggttaccgggggtttaccgggccccggttaacgttaacgtttaaaccggaaacggttaccggaaaggggaacccgggggaaacctaaagggggtaaacggggaaaaacgggtaacgggttaaacccgttaaaggtttacggggttaaccccccggttaccccccgggtaaaacgggaaaccgggggtacgttaaccggttaacgtttttacccggtaacgggttttacccgttttacccggtaacccggaaaggtttaacgtaggttaaccgtttaaccggttaagggtaaaaacccgttaaggtttaaccccggtttagttaaaccttaaccgtttaaacgtaagtttaacgggtacgggttaacggtccgggtacccggtacgggtaaccgggacccggaccggggtaaaccgtaacccgaaacggtacgttaacccgtaccgttacccggttaactaccggcccggtacggaaaccccgtggtaaccccgggtacgggtaacccctaacccgggngtttaacccgggttacccggg

SEQ ID NO: 224214 - DNA, 804 bp, Homo sapiens
  misc_feature: GYAE6OF01CVBH1.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaaccacagaggactcaccatggagtttgggctggaggtggtattttgctttgttacctaagttttaaaaggtgtccagtgtgcggtgctagtttgatgggaggtccgggggaggtcgttggtaggacggccggggctacggtccctggacgacctctcggtgtgacggtctcgtggattcactattcgagtcgacgtcgtaggatgacgcggttcgggtcccgaccgacgtaccgtaccggaagggggaacgggtcgtaaggtagggttgggttcgggaccgtactaacgttaacgaagtacgaagggtaccgggaacaaggtagggaaacggtagtaacgttagtaacgggtcccgtacccggttacggaacgggtcaaggttcgtttaccgtaccgtttaacgtttccgtacgtaaggttactaaggtactttacgaagggttaaacgtaaaccggttacccggttttagttaaccttaccttaaaacgtaggtttaacgtcgggttaaacgggtttccggggtccgttaccggacgggtaacccgggacccgggttaaaggaaccgtaccgggtaggtacccgttaacgtttaccgtaaccgttttaccggccgaccgggacccgttaaactaccggggttacccgggtacccgtaacccggtagggggttccttaacgggg

SEQ ID NO: 224215 - DNA, 577 bp, Homo sapiens
  misc_feature: GYAE6OF01BET48.29.70.G04.1.454.CMB.1.raw
  modified_base (236)..(236): a, c, t, g, unknown or other
  misc_feature (236)..(236): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (388)..(388): a, c, t, g, unknown or other
  misc_feature (388)..(388): n is a, c, g, or t
  modified_base (412)..(412): a, c, t, g, unknown or other
  misc_feature (412)..(412): n is a, c, g, or t
  modified_base (524)..(524): a, c, t, g, unknown or other
  misc_feature (524)..(524): n is a, c, g, or t
  modified_base (532)..(532): a, c, t, g, unknown or other
  misc_feature (532)..(532): n is a, c, g, or t
  modified_base (538)..(539): a, c, t, g, unknown or other
  misc_feature (538)..(539): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(549): a, c, t, g, unknown or other
  misc_feature (548)..(549): n is a, c, g, or t
  modified_base (551)..(552): a, c, t, g, unknown or other
  misc_feature (551)..(552): n is a, c, g, or t
  modified_base (554)..(554): a, c, t, g, unknown or other
  misc_feature (554)..(554): n is a, c, g, or t
  modified_base (557)..(558): a, c, t, g, unknown or other
  misc_feature (557)..(558): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
  modified_base (567)..(571): a, c, t, g, unknown or other
  misc_feature (567)..(571): n is a, c, g, or t
  modified_base (574)..(577): a, c, t, g, unknown or other
  misc_feature (574)..(577): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattatcgattttctcgagatgatctgaagaactaccgtgtatctacatatgagtggcctgcgagccgaggcacaggctatctactctgcgcgacatcggcgacccngtcggactagtttcgttccttagaacgtcgtcggggaccaacggggaccccgtnacccgtccncccgacgcccctccgaaccgacgggccccacgtccggttccctcccccgtggccctccctgccgtccgaggacgcccaccgtccggaanaccgcaacgacggcccggtcccgngggccttacgccggtagaccgaaacgtcttaccgtacgtacgttacctacgtactcgggtaggaccggtcggggtactacggggccgaaacgggccgtaactaaggttcgcngtgacctnctacgnncagcncncnncnncnctnncncnncncnnnnncannnn

SEQ ID NO: 224216 - DNA, 559 bp, Homo sapiens
  misc_feature: GYAE6OF01AEMXY.29.70.G04.1.454.CMB.1.raw
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (533)..(559): a, c, t, g, unknown or other
  misc_feature (533)..(559): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctacactgcgcganatcggtcgacccaggtggctaggtttnttccgttgaagacgtgggggccaacggggaacccccggtnacccgtcctccccgaacgtccctaccgaacccgaaggggacccctacgtcccggtcccttccccccgttcggccggtcccctggcccttaccgacgggaacgccaccgtaccgacgacggccaacgacggccggcccgttggggccttgaccgtgggtaccaaacggtaccttacctttcccgaacggttacctccgttaatccgtagggagcgggacttgggaaccaaggccgtctaaagcgnnnnnnnnnnnnnnnnnnnnnnnnnnn

SEQ ID NO: 224217 - DNA, 576 bp, Homo sapiens
  misc_feature: GYAE6OF01BBATJ.29.70.G04.1.454.CMB.1.raw
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (544)..(576): a, c, t, g, unknown or other
  misc_feature (544)..(576): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattatcgatttctcgagatgatctgaagaataccgtgtatctacatatgagtggcctgcgagccgaggacacaggcatctactactgcgcgacatcggtgaccccagtggctaggtttgttcctgaagacgtggggcccgaggggaacccccggtcacccgtcctcccccagcccctccaacccaacgggccccacgtccggtcccttccccccncgggcccncccctgccctcccgaggacgccacctcccggagacgccacgacggccgggcccccgtgggcccttcggcccgttggggtaacccgaaacgggtaccttaaccgttcccgaacggtttaccctccttagttccttacgggacgggtcccggggagtcgggaaccgtaaaggggccgacctaaagtacggcannnnnnnnnnnnnnnnnnnnnnnnnnnnnnnnn

SEQ ID NO: 224218 - DNA, 870 bp, Homo sapiens
  misc_feature: GYAE6OF01C6EKN.29.70.G04.1.454.CMB.1.raw
  modified_base (188)..(188): a, c, t, g, unknown or other
  misc_feature (188)..(188): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagttttgggctggaggtggtattttgcttgttaccaattttaaaggtntccagtgtgcggtgcatttgagtggaggtccggggaggtcgttgggtaggacggccggggcacggttccccgtggacgtacctcgtcgttgtaggacgtcttcgtggtacttccaactagttcgaggtgtacgtcgtaggagtgacggtcgttcgggtcccgaccgacgtaccgtaccgggaaggggtacggggtacttagggtagggttcgggttacggacccgtagttaacgttaacggaagttaccggaagggaaccggggtacgtaaaggtaacgggggaaaaaggtacggtaaccgtttacggtaaccgggtttcccggtacccccgggttaacggaaacgggggtcccttaaagggttaccttttaccggttacccggttaagtttttacccggtaaccggtaaacggtaagtttacggaaaccgtttaccggttaacggtaaaaacgtaacccgtttaccggtttaacgtttaaccgtttaacccggttaaacttaacgttaagggttaccggtaagggtttaccggtacccggttacggtcccgggaaacggtacccggggtaaacggaacccgtaaccggtaccggtacctaacgttaccccttaacggtaaccgtcgggaccgtaccggttacgtaccggttccggaacggtacccgtaggtcccggttacg

SEQ ID NO: 224219 - DNA, 620 bp, Homo sapiens
  misc_feature: GYAE6OF01BG347.29.70.G04.1.454.CMB.1.raw
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (592)..(599): a, c, t, g, unknown or other
  misc_feature (592)..(599): n is a, c, g, or t
  modified_base (601)..(603): a, c, t, g, unknown or other
  misc_feature (601)..(603): n is a, c, g, or t
  modified_base (605)..(607): a, c, t, g, unknown or other
  misc_feature (605)..(607): n is a, c, g, or t
  modified_base (609)..(612): a, c, t, g, unknown or other
  misc_feature (609)..(612): n is a, c, g, or t
  modified_base (614)..(614): a, c, t, g, unknown or other
  misc_feature (614)..(614): n is a, c, g, or t
  modified_base (616)..(620): a, c, t, g, unknown or other
  misc_feature (616)..(620): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctacgtactgcgcgacacgtcggtgaccccgagtcggcgtagtttcgttccttgaacgtacgtggggccgacgggaaccccggtcacccgttcctccccgagccctccgacccgaacgggccccagttcccggtcccgtttcccccgcgggccgcccgttcgcccttacccgacggtacgccctacctccggagacgaccacgacggcccgggacccgtcggggccttcggccgttccgggtaaccgtaacgggtacccttaccgtttacccgtaaggttaaccctccgtttaactccggtacggtaacggggtccggggtacgttacgggacggtaacgggtccgacggtaacgttaaggccctgcngcngcncncacncgtnnnnnnnncnnncnnncnnnncncnnnnn

SEQ ID NO: 224220 - DNA, 711 bp, Homo sapiens
  misc_feature: GYAE6OF01BJWH3.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgtacctattttaaaaggtgtccagtgtgcggtgctatttgatgggagtccgggggagcgttgggtagacggccggggcacgtccctggacgctcgtcgtgtgaaggtctcgtggattcactattcagtgacgtctggatgacggtcgtgggtcccgccaggaccgtaccggaaggggaacgggtctaggagggttcgggttacggccgataattaccgaaagtcgaagggacggacctaggtagggaaacgaggtactagtacgtcgtaccccggtagaacgggacaggtacttcgtacgtactttcgacgtaagtagtgattacgtaggaaacgtaacgttaccggtattaacttacgtaactaattacgtaggtaacgtcgggtacccgttggaccggtaacggtacccgggaaacggaccgtaaccgacgggtaaccttaaccgttaccgttaaacccgttaccgtcggaacccggtaccgtaaacccggtacggtttaccccgggtaaccgtaaccccggtaacgggttggttaaccccgg

SEQ ID NO: 224221 - DNA, 540 bp, Homo sapiens
  misc_feature: GYAE6OF01CWSYZ.29.70.G04.1.454.CMB.1.raw
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (505)..(505): a, c, t, g, unknown or other
  misc_feature (505)..(505): n is a, c, g, or t
  modified_base (511)..(540): a, c, t, g, unknown or other
  misc_feature (511)..(540): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgattttctcgagaatctgaagaataccgtgtatctacatatgagtggcctgcgagccgaggacacgaggcatctactactgcgcgacagtcggtcgacccagtggctagtttcgttccttgaagacgtggggcccaggggaacccccgtcacccgtcctccccacgccctacccaaccgaacgggccccagtcccggttcccttcccccgnggccgcccctgccctcgaggacncctacccgtcgacgacgcaccgacggccggcccgtggggcctcggcccgttgggtaccaaacgggtcccttaacccgttccgaagttacctccgttatccgttgggacggcggggttcacgggacaacgggtcacngtgcgnnnnnnnnnnnnnnnnnnnnnnnnnnnnnn

SEQ ID NO: 224222 - DNA, 578 bp, Homo sapiens
  misc_feature: GYAE6OF01C07DM.29.70.G04.1.454.CMB.1.raw
  modified_base (233)..(233): a, c, t, g, unknown or other
  misc_feature (233)..(233): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
  modified_base (519)..(519): a, c, t, g, unknown or other
  misc_feature (519)..(519): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (551)..(553): a, c, t, g, unknown or other
  misc_feature (551)..(553): n is a, c, g, or t
  modified_base (555)..(565): a, c, t, g, unknown or other
  misc_feature (555)..(565): n is a, c, g, or t
  modified_base (567)..(578): a, c, t, g, unknown or other
  misc_feature (567)..(578): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgaacactcggtanacccgaggtggctagtttcgttaccttaggaacgtaccggtagggggacccgaaccggggtaacccccgggtcctacccggtacctcccccgacgaccccttaccccgaaaccccgaacgggccccctaacgttcccggttacccgtttcccccgtcgggcccgtcccctcggcctaccgaggacnccacccgtccgagacgacacncggcccggccgtcgggctcggaccgtcggtacgaagtacctacttccaagttacctactactcgttagacggcgggtcncggtaacgacggcacgatacgcatcngcgncnnnannnnnnnnnnncnnnnnnnnnnnn

SEQ ID NO: 224223 - DNA, 764 bp, Homo sapiens
  misc_feature: GYAE6OF01A1LW9.29.70.G04.1.454.CMB.1.raw
  modified_base (730)..(730): a, c, t, g, unknown or other
  misc_feature (730)..(730): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggtagtttgggctgaggtggtattttgcttgttacctaagttttaaaaggtgtctagtgtgcggtgctatttgagtgggacgggtccgggggagtcgttggtaggacggccggggcacgtcccgtggacgtaccgttccgtcggttaggtacggaacggtcctcgttggtaacttcaactattacgtagtcgtacgtcgtaggatggacgtcggtcggtacccgccgaaccggtaccgtccgggaaggggacgggtatacgggtagggttggggttccggaccgtacgtaacgttaacgaacggacgaacgggacgggtaaccgaagggtaaagggaaaggtaacggtaacgtaacgttaccggtacccggttacccccggtaagggtaacgggtaaccgtacgttaccgtttaccgtacggtttaactttaccggacggtaagtacgtaggtacttaacgtaggtaaaaccggttaacttaccggttagttaaccttacgtaacgtaagttgtaacggtggtacggtcccgtagggtacccgaggtacccggagaaccgtacggacgtactacgtctaacgtcgcgacganaccgtagaccgggtacaccggtaggtcgttaacg

SEQ ID NO: 224224 - DNA, 1024 bp, Homo sapiens
  misc_feature: GYAE6OF01CE2E1.29.70.G04.1.454.CMB.1.raw
tcagatagagtactcacgaccggtgctcgatttagtgtagtgtgaagggaaagggagctctgggagaagagccccagccttgggattcccaagtgctttcattcagtgagcaggactgaacacagaggactcaccatggagtttgggctgagggtggtatttttgctttgttacctaagtttttaaaaggtgtccagtgtgcggtgctatttgatgggaggtccgggggagtccgttagggtaggacggcccggggactacggttccccgtaggacggtaccttccgtacggtggtaggaacgggtccttacgtgggtaactttaccgaacttacgtttaccgtaaggtcggtaaccgttccgttagggaacttgggaacgtccggttaccggggttccccacccgaacggtaaccgttcccgggaaaggggggtaacggggtccgttaaagggtacggggtttggggttacccggacccggtacgttaaacgtttaaaccggaaacggtttaccggaaacggggtaacccggggtaaacccgtaagggttaaacgggggaaaacggtaaacgggttaaccgtttaaacggtttaaaccgggtttccccggttaacccccggtaaacgggaaaccggggtaccgtaaacgtttaccgtttaccgttaaccgggtttaactttttacccggaacgggtaaagtacgttaacggtaaccttacgggtaaaggttaaaccggttaaacccgtttaaccggtttaacgtttaacccgtttacgttaaacccgtttaaagtttacggttaaccgggtacggttaacccgggttacccgtagggtaaccccggtaaccgggtacccggaaaccgggttaaaccgaacccgggttaaccggtaacccttaaccggtttaaccctaaacccggtttacggtccgggaaccccggttaacccggaacccggtttaacccgggttaccgggtaaccccggtacccccggttaaggggtttcccggttaacccgg

SEQ ID NO: 224225 - DNA, 700 bp, Homo sapiens
  misc_feature: GYAE6OF01E1IJL.29.70.G04.1.454.CMB.1.raw
  modified_base (123)..(123): a, c, t, g, unknown or other
  misc_feature (123)..(123): n is a, c, g, or t
  modified_base (632)..(632): a, c, t, g, unknown or other
  misc_feature (632)..(632): n is a, c, g, or t
  modified_base (639)..(639): a, c, t, g, unknown or other
  misc_feature (639)..(639): n is a, c, g, or t
  modified_base (645)..(645): a, c, t, g, unknown or other
  misc_feature (645)..(645): n is a, c, g, or t
  modified_base (658)..(658): a, c, t, g, unknown or other
  misc_feature (658)..(658): n is a, c, g, or t
  modified_base (679)..(679): a, c, t, g, unknown or other
  misc_feature (679)..(679): n is a, c, g, or t
  modified_base (682)..(683): a, c, t, g, unknown or other
  misc_feature (682)..(683): n is a, c, g, or t
  modified_base (688)..(688): a, c, t, g, unknown or other
  misc_feature (688)..(688): n is a, c, g, or t
  modified_base (694)..(694): a, c, t, g, unknown or other
  misc_feature (694)..(694): n is a, c, g, or t
  modified_base (696)..(696): a, c, t, g, unknown or other
  misc_feature (696)..(696): n is a, c, g, or t
tcagatagagtactcacgaccggtgctcgatttagtgtagtgtgaagggaaaggggctagagtgggttggccgcattacaagtcagagggaccatgggaaagaggactatagtcgtccccgtnaagggcagattctcgatttctcgagatgatctagaagaataccgtgtatctacatatgagtggcctgcgagccgaggacacaggcatcctactactgcgcgacagtcggtcgaccctagtcggctagtttcgttccttaggaagccgtcggggaccgaccgggacccccggtcacccgtcctaccccacggcccctaccgaacccgacgggtcccctaggttccccggtcccttcccccgtgggccccgtaccctcggtaccgtaccgagggtaccgacccgtaccccgtaccggaacgaccgccgaaaccgccgggcccgggtaccccgttgggggtccctacgggtcccgttacggtaaccggtaaaccggttacctttacccgtttacccgtacggtttacccttttaccgtaacgtttaccgggttacgggaccgggttacccggggtccggttaacggacccgggaaacggggtcccggttacccgtaaagtcggctacgcgcncgcgcgngcgagngcgactacgcgangtcgcgcgcgcgctacgacgncgnngcganagacgngngtcg

SEQ ID NO: 224226 - DNA, 685 bp, Homo sapiens
  misc_feature: GYAE6OF01EYM5W.29.70.G04.1.454.CMB.1.raw
  modified_base (374)..(374): a, c, t, g, unknown or other
  misc_feature (374)..(374): n is a, c, g, or t
  modified_base (605)..(605): a, c, t, g, unknown or other
  misc_feature (605)..(605): n is a, c, g, or t
  modified_base (673)..(673): a, c, t, g, unknown or other
  misc_feature (673)..(673): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctattttaaaaggtgtccagtgtggcggtgctatttgatgggaggtccggggggaggtcgttaggtaggacggcccggggcacgtccctgagactctcgtgtagaacggctctggtattcactattcagtgtacgtcgtaggtatggacgtccggtacggggtcccgaccgacggtaccgtccggaaggggaaggggctaggngggtttcggggttcggcccgtataacttaacggaagtacgaagggaacgggaaccgtaggtaaggggaaaaggaggtacttaagtacggtcggtaccccgttacggaagggcaagttacttacttgtacttttcgacgtagtacgtagtactactaggtaaataaccgtacgttagtactttaaccatagtaagtgaggtcgtccgtaggaccggtacggacggaacgganaccggaggtactacgtaccttaacgtcgtccgaccggtaacacgtacgttcccgggacctaacccggnggttccggtacg

SEQ ID NO: 224227 - DNA, 783 bp, Homo sapiens
  misc_feature: GYAE6OF01CJ69U.29.70.G04.1.454.CMB.1.raw
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
tcagatagagtactcacgaccggtgctcgatttagtgtagtgtgaagggaaaggggagctctgggagaagagccccagccttgggattcccaagtgctttcattcagtgagcaggactagaacacagaggactcaccagtggtagtttgggctggaggtggtattttgtctttagttacctaagttttaaaaggtcgtaccgagtggtggtcggtgctagtttgagtgggagggtccgggggagtcgttgggaggacggccggggcacgtcctgacgtactcgtcggtggtaggagtctacgtggtactcgtactntacgngtacgtacgtcggtagtagtaggcgtccggtacggtcccacggaaccgtaccggtacgggaagggggtaacgggtccgtaagggttacggggttcggggtaccggaccgtaacgtaaacgttaacgaacggtacggaaacggggtacggaaacggtaaagggtaaaggggaaacggtaaggttaacggttaacggtaccggttaaccccggtacccggaagggaacggtacgtaacgttacgttacgttacgtactttacgaacggtagtaagtacgttaagtaagtacggtaaattaaccggttacgtgtaactataatagtagtacgtacggtcggtacgtacgggacgacgggacgtaacggactaacgggcgtaaccgttagtacccgtaacgtacgccggtaacgaccgttaacggtacccggtaccggtaaccgccggtagggtccgtttaacggg

SEQ ID NO: 224228 - DNA, 588 bp, Homo sapiens
  misc_feature: GYAE6OF01EQ3WR.29.70.G04.1.454.CMB.1.raw
  modified_base (515)..(515): a, c, t, g, unknown or other
  misc_feature (515)..(515): n is a, c, g, or t
  modified_base (549)..(549): a, c, t, g, unknown or other
  misc_feature (549)..(549): n is a, c, g, or t
  modified_base (555)..(559): a, c, t, g, unknown or other
  misc_feature (555)..(559): n is a, c, g, or t
  modified_base (561)..(561): a, c, t, g, unknown or other
  misc_feature (561)..(561): n is a, c, g, or t
  modified_base (563)..(565): a, c, t, g, unknown or other
  misc_feature (563)..(565): n is a, c, g, or t
  modified_base (567)..(568): a, c, t, g, unknown or other
  misc_feature (567)..(568): n is a, c, g, or t
  modified_base (570)..(574): a, c, t, g, unknown or other
  misc_feature (570)..(574): n is a, c, g, or t
  modified_base (576)..(588): a, c, t, g, unknown or other
  misc_feature (576)..(588): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgatttctcgagatggatctgaagaataccgtgtatctacatatgagtggcctgcgagcgaggacacaggcatctactactgccgcgacagtcggtcgaccccaggtcggctaggttttcgttcccttgaagtacgtgggggcccaacggggaacccccgtcacccgtcctccccagccccgtcccaaccgaacgggccccaagtcccggtttccgttcccccccgtggcccgtcccccttcggacctcccgaggccggacctacccgtaccgacgaccgcctacgacggcccggtacccgtgggcctcgggccctagggtaccaacggtaccttaccgttaccacgtttaacctcttactaccgttggacgggtccgggntacgggaccgaagggcccgataacgtagcctaancgatgnnnnngngnnncnncnnnnngnnnnnnnnnnnnn

SEQ ID NO: 224229 - DNA, 716 bp, Homo sapiens
  misc_feature: GYAE6OF01D614Z.29.70.G04.1.454.CMB.1.raw
  modified_base (191)..(191): a, c, t, g, unknown or other
  misc_feature (191)..(191): n is a, c, g, or t
  modified_base (577)..(577): a, c, t, g, unknown or other
  misc_feature (577)..(577): n is a, c, g, or t
  modified_base (609)..(609): a, c, t, g, unknown or other
  misc_feature (609)..(609): n is a, c, g, or t
  modified_base (712)..(712): a, c, t, g, unknown or other
  misc_feature (712)..(712): n is a, c, g, or t
tcagatagagtactcacgaccggtgctcgatttagtgtagtgtgaagggaaagggcggtagagtgggtggccgcattacaagtcagagggaccatcgggaaagaggactataggtgtccccgtcaagggcagattctcgatttctcgagatgatctgaagatacgtgtatctacatatgagtggcctgcgngccgagacacgagcatctactactgcgcgacatcggtgaacccagtggctaggtttcgttccttaggaagacgtggggtacccaacgggtaccccgtctaaccgtcctaccccgacgacctcccgaaccgaaccggcccctacgttccggttacctttcccccgtggaccgtccccgttgacccttccgaacggcgtaccgtaccggttccgacgtacgccaccgtacggtcccggtcccgtagggtaccctcgggtacccgttaggtaacccgtaaacgggtaccccgtttacccttacccggtaacgttacccgttacgtaaccgttccggtaggtaccggccggggttactcgggacgtaaacgggccgacgtagttaacggngttcctagtcccgtagtcgtccgtggttaacncggttagtcggtacgtcgtacgtcgtcggtcgtacgtcgtacgtaccgtcgtacgtacgtcccggtcgtacgtcccggtagtacccgttccgcttaacggtcnccgg

SEQ ID NO: 224230 - DNA, 485 bp, Homo sapiens
  misc_feature: GYAE6OF01DMUKT.29.70.G04.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (352)..(352): a, c, t, g, unknown or other
  misc_feature (352)..(352): n is a, c, g, or t
  modified_base (465)..(485): a, c, t, g, unknown or other
  misc_feature (465)..(485): n is a, c, g, or t
tcagatagagtactcacgaccggtgctcgatttagtgtagtgtgaagggaaaggggctagagtgggttggccgcattacaagtcagagggaccatgggaaagaggactatagtgtcccccgtcaagggcagattctcgatttctcgagaatctgaagaataccgtgtatctacatatgagtggcctgcgagccgaggacacnggcatctactactgcgcgacatcggtnacccagtggctagttgttccttgaagcgtggggccagggaaccccggtcacccgtctccccagccctccaccaacgggcccacgttcggtcccttcccccgtggccgccctgcctccaggacncaccctcgagacgctaccgacgccggccctggggctcggacctggtacgaaggacctacgttccacgtactctatcgtaggacggcgggctagggaccaaggccgacagtagnnnnnnnnnnnnnnnnnnnnn

SEQ ID NO: 224231 - DNA, 618 bp, Homo sapiens
  misc_feature: GYAE6OF01EV22F.29.70.G04.1.454.CMB.1.raw
  modified_base (345)..(345): a, c, t, g, unknown or other
  misc_feature (345)..(345): n is a, c, g, or t
  modified_base (579)..(579): a, c, t, g, unknown or other
  misc_feature (579)..(579): n is a, c, g, or t
tcagatagagtactcacgaccggtgctcgatttagtgtagtgtgaagggaaagggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccggggcagtccctgagactctcgtgtgagctctggattcactattcagtgacgtctggatggagcgtgggtcccacgagacctccgaaggggagggctagagttgggtagccgntagttacaagtcaagggacgggtaccagtaggggaaaagacgggtaacttagtaacgtttccggtaccccccggttagaaagggggtcctaaggtaacttttcccgtacggtaactttttcgaccgaaagtatcggtaactcgtaggaaacgtaagtacccggtattacgtactaactagttaactgaacgttgacctggactaggaccgaggacacgaggcctagtccttaancgtgccgtacgactagttccggacacccgtgtggtaccg

SEQ ID NO: 224232 - DNA, 625 bp, Homo sapiens
  misc_feature: GYAE6OF01DAL3S.29.70.G04.1.454.CMB.1.raw
  modified_base (382)..(382): a, c, t, g, unknown or other
  misc_feature (382)..(382): n is a, c, g, or t
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
  modified_base (586)..(587): a, c, t, g, unknown or other
  misc_feature (586)..(587): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (597)..(598): a, c, t, g, unknown or other
  misc_feature (597)..(598): n is a, c, g, or t
  modified_base (600)..(602): a, c, t, g, unknown or other
  misc_feature (600)..(602): n is a, c, g, or t
  modified_base (604)..(607): a, c, t, g, unknown or other
  misc_feature (604)..(607): n is a, c, g, or t
  modified_base (612)..(621): a, c, t, g, unknown or other
  misc_feature (612)..(621): n is a, c, g, or t
  modified_base (623)..(625): a, c, t, g, unknown or other
  misc_feature (623)..(625): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgattttctcgagatgatctgaagaataccgtgtatctacatatgagtggcctgcgagccgaggacacgcggcatctaactactgccgcgaacatccggtcgaaccctaggtcggcgtaggtttcgtttccttaggaaacggtacgtcgggggacccaacggggtaaacccccggtcaacccgtcctccccgacgcctacccgaaccgtaacgggcccctaacgttcccggttaccctttcccccggnggccccgtcccgttggacccttccgaacggaccgtcccgaccccgtcggaagacgccgacgacgggcccggcccggtgggcctcggtccgttcggggtaccaaacggtccttaccgttccgtaagttaccttactacgtcgttacgggcgggtcccgggtagtcgggaaacgtaacggtccgacttaagtacgcngtacgngtnngcgnancgcnncnnngnnnncgtcnnnnnnnnnncnnn

SEQ ID NO: 224233 - DNA, 619 bp, Homo sapiens
  misc_feature: GYAE6OF01B5OAL.29.70.G04.1.454.CMB.1.raw
  modified_base (124)..(124): a, c, t, g, unknown or other
  misc_feature (124)..(124): n is a, c, g, or t
  modified_base (594)..(619): a, c, t, g, unknown or other
  misc_feature (594)..(619): n is a, c, g, or t
tcagatagagtactcacgaccggtgctcgatttagtgtagtgtgaagggaaaggggctagagtgggttggccgcattacaagtcagagggacccatcgggaaagaggactatagtgtccccgtnaagggccagattctcgatttctcgagatgatctgaagaataccgtgtactctacatatgagtggcctgcgagccgaggaccacaggcatccgtaactacgtgcgcgacatcggtcgacccagtggcagtttgttccttagaagcgtcggggccgaacggggaacccccggtcaacccggtcctccccgaacgcccttacccgaaccgtaaccgggccctacgttacccggttccttcccccccgtggcccgcccccgttagccccttcccgaagggaccctacccgaccccgtacccgaacggaccgaccgaaccgaccggtcccgggtccccgtggggtaccctccgtcccggtggttaaccaaacgggtacccttaaccgttacccgtaaggttacccttcgtacgttaccgtgggacggtccgggagtcgggacaaacgggcacctagtaggcagcagctatcatgnnnnnnnnnnnnnnnnnnnnnnnnnn

SEQ ID NO: 224234 - DNA, 823 bp, Homo sapiens
  misc_feature: GYAE6OF01AUM99.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgacacagaggactcaccatggagtttgggctgaggtggattttgcttgttaccattttaaaaggtgtccagtgtgcggtgctatttgatgggaggtccggggggaggtccgttgggtagacggtccggggctacggtccctggagacctctcggtgtgaaggtctcgtggattcacattcagtcgacgtcgtggagtgacgtcgtcgggtccgccagtaccgtacggaggggaacgggtcgtacgggtaggttacggggtccggccggtactaacgtttaaccgaacggttacgaacgggtaacgggtaccgaagttaaggggaaacggtaggtaaccgttaacggttaacgggtttcccggtacccccggttaggtaacggggtacgtaacgtaccggttttacccgtcgggttaacgtttttccgaccggtaaagttacgttacgggtaactttacccggtaaaggtaaaaccggttaaggttaacccggtttgtaaacggttaaccctaagtaagtttaacgtagggtaacgggtttccgtaccggtaacgggttcccggaagggaccccggttaaacgggactaaacccgggtagggaaccctaacggtactttaacccggttacgtaccgggtacccgacccggtaaacgtccggttaccccggggtaaacgccccgttaaaggggttcccgttaccggg

SEQ ID NO: 224235 - DNA, 490 bp, Homo sapiens
  misc_feature: GYAE6OF01CZTGR.29.70.G04.1.454.CMB.1.raw
  modified_base (285)..(285): a, c, t, g, unknown or other
  misc_feature (285)..(285): n is a, c, g, or t
  modified_base (435)..(435): a, c, t, g, unknown or other
  misc_feature (435)..(435): n is a, c, g, or t
  modified_base (446)..(449): a, c, t, g, unknown or other
  misc_feature (446)..(449): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (468)..(469): a, c, t, g, unknown or other
  misc_feature (468)..(469): n is a, c, g, or t
  modified_base (471)..(472): a, c, t, g, unknown or other
  misc_feature (471)..(472): n is a, c, g, or t
  modified_base (476)..(477): a, c, t, g, unknown or other
  misc_feature (476)..(477): n is a, c, g, or t
  modified_base (480)..(481): a, c, t, g, unknown or other
  misc_feature (480)..(481): n is a, c, g, or t
  modified_base (483)..(483): a, c, t, g, unknown or other
  misc_feature (483)..(483): n is a, c, g, or t
  modified_base (485)..(490): a, c, t, g, unknown or other
  misc_feature (485)..(490): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaaggcagattctcgatttctcgagatgatctgaagaataccgtgtatctacatatgagtggcctgcgagccgaggacacaggcatctactactgcgcgacatcggtgacccagtgcagttgtccttgaagactggggccagggaaccccggtcaccgtctcccngcctccaccaagggccccagtccggtcttccccctggccgccctgcctccgaggagccaccgtcggagacgcacacgccggccctggggctgcctggcaagggactacttccacgtactctatctgacgcgggactggacaagggcctanagtagactgannnnancacgtgangcngtnctnnanngcanncgnncncnnnnnn

SEQ ID NO: 224236 - DNA, 849 bp, Homo sapiens
  misc_feature: GYAE6OF01DTDVL.29.70.G04.1.454.CMB.1.raw
  modified_base (308)..(308): a, c, t, g, unknown or other
  misc_feature (308)..(308): n is a, c, g, or t
  modified_base (349)..(349): a, c, t, g, unknown or other
  misc_feature (349)..(349): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggtagtttggctgaggtggtattttgctttgttaacctaagttttaaaaggtgtccagtgtggcggtgctatttgagtgggacgggtccggggggaggtcgttagggtaggacgggcccgggggcagtcccctgacgtacctctgtgtgaaggtctcgtggattcaactnttcgagtcgtacgtcgtggatggagtcggtcggggtacccnccgaaggaccgtaccgggaagggggtaacggggcttaagggtaggggtttacgggggtcggaaccccgagttaaacgtttaaccggaaacgttccgaaaggggaaccggggtaaccctaaggggtaaacgggggaaaaaaggtacgggtaaacgtttaacgggttaacgggttccccggttaaccccccgggttaaggaaaacgggggtccgtaaaacgggtttacctttcccggttaaccggtttaagttttacccggtaccggtaaaggtaacttaaggttaccttacggtaaaggtaaacgttaaaccgttacccggtttagttaacgttaccttaactaagttaagtaggtaacggttccgggtaccgtagggaccgacgggaccggaacggaacgtaccggaaggtcctaaacgttcccgttaaaccttccggtacggcccgggtaccgaaacgtccggttaacccgggccggaacccgtgggttcccggtaacg

SEQ ID NO: 224237 - DNA, 676 bp, Homo sapiens
  misc_feature: GYAE6OF01CIHSP.29.70.G04.1.454.CMB.1.raw
  modified_base (566)..(566): a, c, t, g, unknown or other
  misc_feature (566)..(566): n is a, c, g, or t
  modified_base (658)..(658): a, c, t, g, unknown or other
  misc_feature (658)..(658): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggtattttgcttgttacctaattttaaaggtgtccagtgtgcggtgctatttgatgggaggtccgggggaggtcgttggtaggacggccggggctacggtccctgacgacttcgtacgtgtaggaagtctcgtggtattctacgtagtttcaaggttcgtacgttcgtggatggacgtcgtttcggggcccgccgagaccgtaccggaagggggtacgggtcgttacggtagggttcgggttacggcccggactaatttaacgaaggttacgagggagggaaccaggtaaggggaaacgaggtaaccgttagtacggttaccgtccccgtaaggaccgggctaacggttacttccgttaccgttattttacccggtcgagttactagtactgtagtaacgtataccggttntactcgtatatgtagtagtcgtcgtagacgtcgacgtagccgtacacgcacgttctacgtaccgtggacccgtgacctacggtcggttaacncccggtaggttggtcccg

SEQ ID NO: 224238 - DNA, 581 bp, Homo sapiens
  misc_feature: GYAE6OF01ALN2H.29.70.G04.1.454.CMB.1.raw
  modified_base (401)..(401): a, c, t, g, unknown or other
  misc_feature (401)..(401): n is a, c, g, or t
  modified_base (547)..(547): a, c, t, g, unknown or other
  misc_feature (547)..(547): n is a, c, g, or t
  modified_base (549)..(581): a, c, t, g, unknown or other
  misc_feature (549)..(581): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtcgaccccaggtggctagtttcgtttccttaggaagacgtcgggggcccgaacggggaacccccgggtcaacccgttccctcccccgagtccccttccccgaacccgaacggggcccctaacgttccggttccccttcccccgtggcccgtcccctacgcctcccgagggacnccacctccgagacgccacgcgcccggcccgtgggctcgtccgtaggtaccgaaacggtaccttacgttacccgacgttaccttcctattccggtacggacggccggggtcctaggggaccgtaacgggcccgtacgtacgtaggcngnnnnnnnnnnnnnnnnnnnnnnnnnnnnnnnnn

SEQ ID NO: 224239 - DNA, 633 bp, Homo sapiens
  misc_feature: GYAE6OF01D4LXQ.29.70.G04.1.454.CMB.1.raw
  modified_base (396)..(396): a, c, t, g, unknown or other
  misc_feature (396)..(396): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctaatttttaaaaggtgtccagtgtgcggtgctatttgatggaggtccgggggagcgtttggtagacggccggggctagtccctgacgactctcgtgtgaggctcgtggattcactattcagtgacgtctggatgagcgtcgggtccgacagacctccgaggggaaggggctaggaggttcgggttggccgctattacgaagtcgagaggaccagtagggaaagnggatagtagtcgtccccgtagagggcagtacttcgtcgtatttcgtacgagtatgacgttcgtagtaaacgtaacttaccggttagttaacttctaactagttaagtcggtaggttcgggcccgttaggaccgtacggaccgaacgggacctaacgacggtacgacgtttacccgtaagtacccgcggaccgacgtaaccgtcgtaccgggtaccgaccccggtaggtcggtaccgg

SEQ ID NO: 224240 - DNA, 592 bp, Homo sapiens
  misc_feature: GYAE6OF01B7O55.29.70.G04.1.454.CMB.1.raw
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
  modified_base (556)..(557): a, c, t, g, unknown or other
  misc_feature (556)..(557): n is a, c, g, or t
  modified_base (560)..(560): a, c, t, g, unknown or other
  misc_feature (560)..(560): n is a, c, g, or t
  modified_base (563)..(563): a, c, t, g, unknown or other
  misc_feature (563)..(563): n is a, c, g, or t
  modified_base (567)..(592): a, c, t, g, unknown or other
  misc_feature (567)..(592): n is a, c, g, or t
tcagatagagtactcacgaccggtgctcgatttagtgtagtgtgaagggaaaggggctagagtgggttggccgcattacaagtcagagggaccatgggaaagaggactatagtgtcccccgtcaagggcagattctcgattttctcgagatgatctgaagaataccgtgtatctacatatgagtggcctgcgagccgaggacacaggcatctactactgcgcgacatcggtgacccagtggcagtttgttccttgaacgtacgtggggaccaacggggaacccccggtcacccggtcctacccccacggcccctcccgaaaccccgaacggggccccctaacgttcccgggttccctttcccccccgtagggccccgtcccctggacccttccgacgggacgcccacccgtacccggacgacgaccgaaccgagggccccggtcccgtggggcctccggccgttcgggtacgaaacggtcccttacgtacctacgtaccttctactcgtagacggtccgggctacgggacgaacggcgactaagtacgntanggannacnagnacgnnnnnnnnnnnnnnnnnnnnnnnnnn

SEQ ID NO: 224241 - DNA, 591 bp, Homo sapiens
  misc_feature: GYAE6OF01E2UOL.29.70.G04.1.454.CMB.1.raw
  modified_base (557)..(560): a, c, t, g, unknown or other
  misc_feature (557)..(560): n is a, c, g, or t
  modified_base (562)..(563): a, c, t, g, unknown or other
  misc_feature (562)..(563): n is a, c, g, or t
  modified_base (565)..(567): a, c, t, g, unknown or other
  misc_feature (565)..(567): n is a, c, g, or t
  modified_base (569)..(584): a, c, t, g, unknown or other
  misc_feature (569)..(584): n is a, c, g, or t
  modified_base (586)..(591): a, c, t, g, unknown or other
  misc_feature (586)..(591): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtcgacccagtcggctaggtttcgttccttaggaagccgtgggggcccgacggggaacccccggtcacccgtcctccccagccctacccacccgaacgggccccacgtccggttcccttccccccgtcgggccgtcccctcgcctccgagggacgcctacccgtccggaacgacgaccacgtacggcccgggccccgtggggccgtcggcccgtcgggtacccgaacgggtacccttaccgttcccgaacggttaaccttctacgttccgtcgggtacgggtccggggtcgtacggggaaccgtaaggggcccgtacgtacgtacgcgagnnnncnngnnncnnnnnnnnnnnnnnnncnnnnnn

SEQ ID NO: 224242 - DNA, 736 bp, Homo sapiens
  misc_feature: GYAE6OF01D854F.29.70.G04.1.454.CMB.1.raw
  modified_base (199)..(199): a, c, t, g, unknown or other
  misc_feature (199)..(199): n is a, c, g, or t
  modified_base (574)..(574): a, c, t, g, unknown or other
  misc_feature (574)..(574): n is a, c, g, or t
  modified_base (693)..(693): a, c, t, g, unknown or other
  misc_feature (693)..(693): n is a, c, g, or t
tcagatagagtactcacgaccggtgctcgatttagtgtagtgtgaagggaaaggggagctctgggagaagacgccccagccttgggattcccaagtgctttcattcagtgagcaggactgaacacagagactcaccagtggagtttgggctggaggtgtattttgcttgttactaattttaaagtgtcagtgtgcgtgntatttgagtgggaggtccgggggagtcggtttagggtagacgggccggggtactacggtcccgtagggaacgtaccgttcgttcggtggtaggaacgggtccttacgtggtacttaccacttacttcgaggtcgtaaccgtcgtagggtaatggtacggccggttcgggggtccccgacccgggtacgtacccgggtaagggggaacggggtacggtacggtacgggttcggggttcggcccggtacgtaacgtttaacgaacggtacggaacggtaagggaacccgtaggtaaacggggaaaaggtacggtaacgtaacgttacggttccggaccccggttaaccgaagggtaccgagttacttccgttacgtntttacgtagagtataaggtctacgaggtaaactactaccgtagtaacgtatactaatgtacggaggtcgtacctaggacgacggaccgagaactaggctagtacctacgtacctaggcnccgtaacgacgtcgtacgggtaccaccgtggtggcgtttaacg

SEQ ID NO: 224243 - DNA, 869 bp, Homo sapiens
  misc_feature: GYAE6OF01DY2M3.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagagactcaccatggagtttggctgaggtggtattttgcttgttacctaattttaaaaggtgtccagtgtgcggtgctatttgatggaggtccgggggagtcttggtacggacggtccgggggacacggtcccctaggtacggtaccttcgtccggttaggttacggaacggccttcgtggtactttccacctattccgagtcgtaaccgtcgtaggagttgacggtcgttacggggtcccgacctaagtacccgtacccggaagggggtaacggggtccttaaagggtaggtttggggttccggacccggtagttaacctttaacggaacggttacgaacgggtaaaccggggaacctaagggtaaacggggaaaagtacggtaaacccttaaggtaaccggttccggtaccccccggttaagaaagggggtaccctaaggttaccgttccgttaagtacctttttccgggagttaacgtaagttaccggtaacgttccgtaaagggtaaaaccgtaaccggtttaacccggttagtttaaactaccgttaaacctaaggtttaacgttacggtaacggttccgggtcccgttagggaccccggtaacggtacccgggagggaaacccctggaaccgggtacctttaaacggtccgttaaaccccgtacgtcccggacccggtacccgaacgtttaacccggtaccggtaacccggtaacccgttagggtccgggttaacccgg

SEQ ID NO: 224244 - DNA, 556 bp, Homo sapiens
  misc_feature: GYAE6OF01CZKJ2.29.70.G04.1.454.CMB.1.raw
  modified_base (121)..(121): a, c, t, g, unknown or other
  misc_feature (121)..(121): n is a, c, g, or t
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
  modified_base (528)..(556): a, c, t, g, unknown or other
  misc_feature (528)..(556): n is a, c, g, or t
tcagatagagtactcacgaccggtgctcgatttagtgtagtgtgaagggaaagggctagagtgggttggccgcattacaagtcagagggaccatgggaaagaggactatagtgtccccgtnaagggcagattctcgatttctcgagatgatctgaagaataccgtgtatctacatatgagtggcctgcgagccgaggacacaggcatctaactctgccgngacatcggtgaacccngtgctagtttgttcctgaagtcgtcggggcccgacgggtaaaccccggctacccgtcctaccccgancccctacccaaccgtaaccgggcccacgttcccggttcccttcccccgtggcccctcccgttcnccgtcccgaggacctactaccccgccgaagcgaccaacgtcggcccggcccgtgggcctacggcccgttaggtaaccaaacgggtaccttaccgtcccgaattcccgtactagtcgacgtaggcccggtatcgggaacgaacgggcacgtaatgcagtcgnnnnnnnnnnnnnnnnnnnnnnnnnnnnn

SEQ ID NO: 224245 - DNA, 656 bp, Homo sapiens
  misc_feature: GYAE6OF01AOAOU.29.70.G04.1.454.CMB.1.raw
  modified_base (553)..(553): a, c, t, g, unknown or other
  misc_feature (553)..(553): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggaggtccgggggagcgttggtagaggccggggcaggtccctgagactctcggtgtagaaggctcgtggattcatatcaggtgacgtcgtaggagtggacgtcggtcgggtccgtaccgacggaccgtccggaaggggaacggggtctagggtcgggtagggtttcgggcctacgaactttacgaacgttcgaaggggaacggaccgaagtacggggaaaagtaggtaacgtaatagggttccgtaccccgtaggaacgggcagtacgttacgtccgtatttccgtagtacgtagtcgatacgtaggtaacgaagttacccgagttactcttaacagttgtacggngtacggtccctaggcgtacggcgacggacgacgagacctacgttcgtacgtacgtcggaccgaaccggacgtacggtaccggacgtaccggtggtcggtacgg

SEQ ID NO: 224246 - DNA, 540 bp, Homo sapiens
  misc_feature: GYAE6OF01BRZQP.29.70.G04.1.454.CMB.1.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (501)..(502): a, c, t, g, unknown or other
  misc_feature (501)..(502): n is a, c, g, or t
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
  modified_base (510)..(511): a, c, t, g, unknown or other
  misc_feature (510)..(511): n is a, c, g, or t
  modified_base (513)..(516): a, c, t, g, unknown or other
  misc_feature (513)..(516): n is a, c, g, or t
  modified_base (518)..(532): a, c, t, g, unknown or other
  misc_feature (518)..(532): n is a, c, g, or t
  modified_base (535)..(540): a, c, t, g, unknown or other
  misc_feature (535)..(540): n is a, c, g, or t
tcagatagagtactcacgaccggtgctcgatttagtgtagtgtgaagggaaaggggctagagtgggttggccgcattacaagtcagagggaccatgggaaaagaggactatagtgtccccggtcaagggcagattctcgatttctcgagatgatctagaagaattaccgtgtactctacatatgagtgcctgcgagcgagacngagcatctactactgcgcanactcggtcaccgagtgctagttcttcgtagaggacgtcggggaccgacgggacccgtctccgcctcccgactcccaccaccgacggccacgttccggtccttccccgcggtccgccctgtcccgtacgcggtacgccacccgtcgagacgcgacgaccggcccggcccgtggtccgtcgacggtacgcgaacggtaccttctaccgaagttaccttgtctacggtgtaccgggcggtacccgtaacggacgacgggtcgaccgtagtacgntacncgnncncgngtnnannnnannnnnnnnnnnnnnnacnnnnnn

SEQ ID NO: 224247 - DNA, 671 bp, Homo sapiens
  misc_feature: GYAE6OF01AWWO1.29.70.G04.1.454.CMB.1.raw
tcagatagagtactcacgaccggtgctcgatttagtgtagtgtgaagggaaagggagctctgggagaagagccccagccttgggattcccaagtgctttcattcagtgagcaggactgaacacagaggactcaccatggagtttgggctgaggtggtattttgcttgttacctaattttaaaaggtgtccagtgtgcggtgcatttgatgggaggtccggggagcttggagacggccggggcacgtcccgtgacgactcgtcgtgtagaaggctcgtggtacttcactacttcgagtcgtacgtcgtaggatggacgtccggttcgggtcccaccgacggaccgttacccgggaaggggaacgggctagggtagggttgggttcggccgtacgtaacttaaccgaagtcgaacggacgggaacctaaggtaagggaaaagtaggaactaagttacggtaccggttacccccgaggaacgggactagtactttcgtacgttatttccgagtaacgtactagaacgttcgtaagaaacgtacttaccgtatactacctaataatacgtaggtacggtcggtcgtggaccgtacgaccggaagaccacgagacctaacgtcctatccggtgcccgacgaccgtacgtaccggaccgacccgtaggttcggaccg

SEQ ID NO: 224248 - DNA, 596 bp, Homo sapiens
  misc_feature: GYAE6OF01AQN0C.29.70.G04.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (562)..(566): a, c, t, g, unknown or other
  misc_feature (562)..(566): n is a, c, g, or t
  modified_base (569)..(569): a, c, t, g, unknown or other
  misc_feature (569)..(569): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
  modified_base (590)..(592): a, c, t, g, unknown or other
  misc_feature (590)..(592): n is a, c, g, or t
  modified_base (594)..(596): a, c, t, g, unknown or other
  misc_feature (594)..(596): n is a, c, g, or t
tcagatagagtactcacgaccggtgctcgatttagtgtagtgtgaagggaaaggggctagagtgggttggccggcattacaatcagagggacccatgggaaagaggactaatacgtggtcccccgtcaagggcagacttctcgatttctcgagatgatctgaagaataccgtgtatctacatatgagtggcctgcgagccgaggaccacaggcatctaactactcgcgcganactcggtagacccnggtggctaggtttnttcccgttaggaacgacggtcggggccaacggggaacccccggtcacccgtccgtcccccagtcccgtccaaccgaacgggcccagtcccggttcgtccccctggcccgcccgttgcctccgacggacgcccgtaccgtaccgagccgaccgacgtacggccgggtacccgtgggcctcggtccgtggtacaagggtccttaacgttccgacttaccgtacctacttacgtacggacgggtccgggtctaggggacccgagggtaccacgtaataccggagtcatcgtaatgcgcnagtngnnnnngcngcgngngcgancgtgngnncnnncnnn

SEQ ID NO: 224249 - DNA, 961 bp, Homo sapiens
  misc_feature: GYAE6OF01BL0I0.29.70.G04.1.454.CMB.1.raw
tcagatagagtactcacgaccggtgctcgatttagtgtagtgtgaagggaaaggggaggctctgggagaagagccccagccgttgggattcccaagtgtctttcattcagtgagcacggactgaacacagaggactcaccatggagtttgggctgaggtggtattttgcttgttactagttttaaaaggtgtccaggttgtggcggttcgcgtatttggagtgggaggtccgggggagtcgttgggtacgacggccgggggcacggttccctaggacgtaccttcgtcgtaggttggtaaggtcttacgtggaacttaccaacgtacgtttacgacggttacggaaccggtttcgtagggtaagttggtacggtccggttaccgggggttaccccgacccgtaacggtaaccgttacccggggaaagggggggtaaaccgggggtccgttaaaggggtacggggtttccggggggttaccgggaccccggttacgttaaaacggtttaaccggtaaacggttacccgggaaagggaaacccgggggtaacccgtaaagggtaacggggggaaaaaacggtaacggggtaactttaaaggttaccgggttaaccccggtttacccccgggtaacggaaaggggtccgtaaggttaccgtttaacccgttacgggttaacttttttaccggaaccggtaaagggtaacgtttacgggaacgtttaccggttaagggtaaaaacgttaaaccgttttaaccccggggttatttaaacgtttaccctaaacggttaagttaacgttaagggtacgggttcgggtacccgtttcggaacggtacggtacccgggtaaacgggaaccggtaacacgggtacctaacgttccgttaacgtaccggtggacccggtaaccgacggttaaccggttccgggaacccgtaccggtacgggttcgtacccgg

SEQ ID NO: 224250 - DNA, 434 bp, Homo sapiens
  misc_feature: GYAE6OF02F94OA.29.70.G04.1.454.CMB.1.raw
  modified_base (425)..(434): a, c, t, g, unknown or other
  misc_feature (425)..(434): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttccccctggcgccctgctccaggagcacctccgagagcacagcggccctgggctgcctggtcaaggactacttccagtactctatctgagcgggctggcaaggcgcatagnnnnnnnnnn

SEQ ID NO: 224251 - DNA, 428 bp, Homo sapiens
  misc_feature: GYAE6OF02FGJTZ.29.70.G04.1.454.CMB.1.raw
  modified_base (418)..(418): a, c, t, g, unknown or other
  misc_feature (418)..(418): n is a, c, g, or t
  modified_base (424)..(428): a, c, t, g, unknown or other
  misc_feature (424)..(428): n is a, c, g, or t
tcagatagagtactcacgaccggtgctcgatttagtgtagtgtgaagggaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttcccctggcgccctgctccaggagccacctccgagagcacagcggccctgggctgcctggtcaaggctacttccagtactctatctgagcgggctggcaaggcncatagnnnnn

SEQ ID NO: 224252 - DNA, 433 bp, Homo sapiens
  misc_feature: GYAE6OF02G6N99.29.70.G04.1.454.CMB.1.raw
  modified_base (425)..(433): a, c, t, g, unknown or other
  misc_feature (425)..(433): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtctccccctggcgccctgctccaggagcacctccgagagcacagcggccctgggctgcctggtcaaggactacttccagtactctatctgagcgggctggcaaggcgcatagnnnnnnnnn

SEQ ID NO: 224253 - DNA, 431 bp, Homo sapiens
  misc_feature: GYAE6OF02FWEYK.29.70.G04.1.454.CMB.1.raw
  modified_base (427)..(431): a, c, t, g, unknown or other
  misc_feature (427)..(431): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggccccatcggtcttccccctggcgccctgctccaggagcacctccgagagcacagcggccctgggctgcctggtcaaggactacttccagtactctatctgagcgggctggcaaggcgcatagnnnnn

SEQ ID NO: 224254 - DNA, 451 bp, Homo sapiens
  misc_feature: GYAE6OF02F2LE4.29.70.G04.1.454.CMB.1.raw
  modified_base (281)..(281): a, c, t, g, unknown or other
  misc_feature (281)..(281): n is a, c, g, or t
  modified_base (430)..(451): a, c, t, g, unknown or other
  misc_feature (430)..(451): n is a, c, g, or t
tcagatagagtactcacgaccggtgctcgatttagtgtagtgtgaagggaaagggggcgtagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccgttgaagactggggccagggaaccccggtnaccgtctccccagcctccaccaagggcccatccggtcttccccctggcgccctgctccaggagcacctccgagagcacagcgccctgggctgcctggtcaaggactacttccagtactctatctgagcgggctggcaaggcgcagtagnnnnnnnnnnnnnnnnnnnnnn

SEQ ID NO: 224255 - DNA, 432 bp, Homo sapiens
  misc_feature: GYAE6OF02ISCDZ.29.70.G04.1.454.CMB.1.raw
  modified_base (426)..(432): a, c, t, g, unknown or other
  misc_feature (426)..(432): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttccccctggccgccctgctccaggacgcacctccgagagcacagcggccctgggctgcctggtcaaggactacttccagtactctatctgagcgggctggcaaggcgcatagnnnnnnn

SEQ ID NO: 224256 - DNA, 430 bp, Homo sapiens
  misc_feature: GYAE6OF02G4LYZ.29.70.G04.1.454.CMB.1.raw
  modified_base (425)..(430): a, c, t, g, unknown or other
  misc_feature (425)..(430): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgtccttgaagactggggccagggaaccccggtcaccgtctccccagcctccaccaagggcccatcggtcttccccctggcaccctcctccaagacgcacctctgggggcacagcagccctggggctgcctggtcaaggactacttccagtactctatctgagcgggctggcaaggcgcatagnnnnnn

SEQ ID NO: 224257 - DNA, 439 bp, Homo sapiens
  misc_feature: GYAE6OF02HN789.29.70.G04.1.454.CMB.1.raw
  modified_base (429)..(439): a, c, t, g, unknown or other
  misc_feature (429)..(439): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggccccatcggtcttccccctggcgcccctgctccaggagcacctccgagagcacagcggccctgggctgcctggtcaaggactacttccagtactctatctgagcgggctggcaaggcgcatacgnnnnnnnnnnn

SEQ ID NO: 224258 - DNA, 432 bp, Homo sapiens
  misc_feature: GYAE6OF02IFEFB.29.70.G04.1.454.CMB.1.raw
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
  modified_base (426)..(432): a, c, t, g, unknown or other
  misc_feature (426)..(432): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggccccatcggtcttcccccnggccgccctgctccaggagcacctcgagngcacagcggccctgggctgcctggtcaaggctacttccagtactctatctgagcgggctggcaaggcgcatagnnnnnnn

SEQ ID NO: 224259 - DNA, 454 bp, Homo sapiens
  misc_feature: GYAE6OF02I9YNB.29.70.G04.1.454.CMB.1.raw
  modified_base (433)..(433): a, c, t, g, unknown or other
  misc_feature (433)..(433): n is a, c, g, or t
  modified_base (439)..(454): a, c, t, g, unknown or other
  misc_feature (439)..(454): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcacccgtctccccagccctccaccaacgggccccatccggtcttccccctggccgcccctgcctccaggacgcacctcccgagacgcacagccggccctgggcctgcctggtcaaggctacttccagtactctatctgacggcggctggcaaggcncatagnnnnnnnnnnnnnnnn

SEQ ID NO: 224260 - DNA, 555 bp, Homo sapiens
  misc_feature: GYAE6OF02H7AVH.29.70.G04.1.454.CMB.1.raw
  modified_base (361)..(361): a, c, t, g, unknown or other
  misc_feature (361)..(361): n is a, c, g, or t
  modified_base (421)..(421): a, c, t, g, unknown or other
  misc_feature (421)..(421): n is a, c, g, or t
  modified_base (500)..(500): a, c, t, g, unknown or other
  misc_feature (500)..(500): n is a, c, g, or t
  modified_base (505)..(506): a, c, t, g, unknown or other
  misc_feature (505)..(506): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(538): a, c, t, g, unknown or other
  misc_feature (533)..(538): n is a, c, g, or t
  modified_base (540)..(545): a, c, t, g, unknown or other
  misc_feature (540)..(545): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(555): a, c, t, g, unknown or other
  misc_feature (553)..(555): n is a, c, g, or t
tcagatagagtactcacgaccggtgctcgatttagtgtagtgtgaagggaaaggggcgtagggagtgggttggccgcattacaagtcagagggaccatgggaaagaggactagtacgtgtccccgtcaagggccaggattctcgatttctcgaggatcgagtctgaagtaataccgtgtatcctacatactgagtcggcccttgcgagcccgaggactacagggcgatctactactgccgcgacatcggtcggaccccagtggcagttgttaccttagaagtaacttggggaccagggaacccccgtaacaccggtactcccccaagccctcgacccaaggccccatccggtcttcccccnggtcgccctagcgtcccaggacacacctccggagagcacgagtcgggaccctggggtacncgtcctggtacaaaggctaacttccagttactcaatcgtagacgtcggggctaggtctaaagggcgaccaagttaacgnactannacngngnganagacgagngnnananannnnnncnnnnnncncncncnnn

SEQ ID NO: 224261 - DNA, 447 bp, Homo sapiens
  misc_feature: GYAE6OF02HPMR7.29.70.G04.1.454.CMB.1.raw
  modified_base (433)..(447): a, c, t, g, unknown or other
  misc_feature (433)..(447): n is a, c, g, or t
tcagatagagtactcacgaccggtgctcgatttagtgtagtgtgaagggaaaggggctaggagtgggttggccgcattacaagtcagaggggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgtccttgaagactggggccagggaaccccggtcaccgtctccccagcctcaccaagggccccatcggtcttccccctggcgccctgctcccaggacgccacctccgacgacgcacagcggccctgggctgcctggtcaaggcctacttccagtactctatctgagcgggctggcaagggcgcatagnnnnnnnnnnnnnnn

SEQ ID NO: 224262 - DNA, 439 bp, Homo sapiens
  misc_feature: GYAE6OF02H5KSD.29.70.G04.1.454.CMB.1.raw
  modified_base (422)..(439): a, c, t, g, unknown or other
  misc_feature (422)..(439): n is a, c, g, or t
tcagatagagtactcacgaccggtgctcgatttagtgtagtgtgaagggaaaggggctagagtgggttggccgcattacaagtcagagggaccatgggaaagaggactatagtgtcccgtcaagggcagattctcgatttctcgagatgatctgaagaataccgtgtatctacatatgagtggcctgcgagccgaggacacaggcatctactactgcgcgacatcggtgacccagtggcagttgtccttgagactggggccagggaaccccggtcaccgtctccccagcctcaccaaggcccatcggtcttcccccctggcgccctcctccaacgagcacctctgggggcacagcagccctgggctgctggtcaaggactacttccagtactctatctgagcgggctggcaggcgcactagnnnnnnnnnnnnnnnnnn

SEQ ID NO: 224263 - DNA, 506 bp, Homo sapiens
  misc_feature: GYAE6OF02I5HWL.29.70.G04.1.454.CMB.1.raw
  modified_base (219)..(219): a, c, t, g, unknown or other
  misc_feature (219)..(219): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (460)..(460): a, c, t, g, unknown or other
  misc_feature (460)..(460): n is a, c, g, or t
  modified_base (472)..(506): a, c, t, g, unknown or other
  misc_feature (472)..(506): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcncgacatcggtgacccagtggcagttgttccttgaanctgggccagggaaccccgtnaccgtctcccagcctccaccaagggcccatcgtccttccccnggccnccctgcctccaggacnccacctccgagacgcacacgcggcccctggggacctcggacctgggtaccaaacgggacctaacttcccgaaggttaccctccgtaatccgtacggaggccggggctcgggacaaggggccnctaagtacggcnnnnnnnnnnnnnnnnnnnnnnnnnnnnnnnnnnn

SEQ ID NO: 224264 - DNA, 516 bp, Homo sapiens
  misc_feature: GYAE6OF02FP5O8.29.70.G04.1.454.CMB.1.raw
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (362)..(362): a, c, t, g, unknown or other
  misc_feature (362)..(362): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (468)..(468): a, c, t, g, unknown or other
  misc_feature (468)..(468): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccggggcagtccctgagactctcgtgtgaaggctctggattcacattcagtgacgtctggatgagctgggtccncagctccgagggagggcagagtgggtgcgnattacagtcagaggaccagtgggaaanaggactagtagtcgtccccgtnaagggcagattcngactttcgcgagatgatctagaagaataccgtagtactactacattatgagtgcctgcgagccgagacagngcagtctaactactgaccgcgactcgtacggtcgacccgagtggtccg

SEQ ID NO: 224265 - DNA, 514 bp, Homo sapiens
  misc_feature: GYAE6OF02FLJO8.29.70.G04.1.454.CMB.1.raw
  modified_base (394)..(394): a, c, t, g, unknown or other
  misc_feature (394)..(394): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcacattcagtgacgtctggatgagctgggtccgccagactccaggggaaggggctaggagtgggttggccgcattacaagtcagagggaccagtgggaaagaggactatagtgtccccgtnaagggcagattctcgatttctcgagatgatctgaagaataccgtgtatctacatatgagtgcctgcgagccgagacacaggcatctactactgcgcgacatccggtgacccaggtggacg

SEQ ID NO: 224266 - DNA, 634 bp, Homo sapiens
  misc_feature: GYAE6OF02G8EZB.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagaggccggggcagtccctgagactctcgtgtgaaggctctggattcacattcagtgacgtctggatggagcgtgggtccgccagacctccgaggggaagggctaggaggtgggttggccgcattacaagtcaggagggaccagtagggaaagaggactagtaggtcgtccccgtagaagggcagtactttcgcggtaattttccgacggtagtacgttggtaacgttcgttaaggaaaagtaaacgttacccggttagttaacttaccgtaacaagttagtaggtacggttcggacccttggaccgtacggcccggaagggaccaacgagggacctacgtcctaacccttagtcggaccgaccgtacgtacgttcccgggtacaaccccggtaggttcgggaccg

SEQ ID NO: 224267 - DNA, 432 bp, Homo sapiens
  misc_feature: GYAE6OF02I37LN.29.70.G04.1.454.CMB.1.raw
  modified_base (340)..(340): a, c, t, g, unknown or other
  misc_feature (340)..(340): n is a, c, g, or t
  modified_base (426)..(432): a, c, t, g, unknown or other
  misc_feature (426)..(432): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctcaccaagggcccatcggtcttccccctggcgccctgctccaggacncacctccgagagcacagcggccctgggctgcctggtcaaggactacttccagtactctatctgagcgggctggcaaggcgcatagnnnnnnn

SEQ ID NO: 224268 - DNA, 440 bp, Homo sapiens
  misc_feature: GYAE6OF02FQONY.29.70.G04.1.454.CMB.1.raw
  modified_base (230)..(230): a, c, t, g, unknown or other
  misc_feature (230)..(230): n is a, c, g, or t
  modified_base (428)..(440): a, c, t, g, unknown or other
  misc_feature (428)..(440): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtnacccagtggcagttgttccttgaagactggggccagggaaccccggtcaccgtctccccagcctccaccaagggcccatcggtcttcccccgtggccgccctgcctccaggacgccacctccgagagcacagcggccctgggctgcctggtcaaggctacttccagtactctatctgagcggctggcaggcgcatagnnnnnnnnnnnnn

SEQ ID NO: 224269 - DNA, 428 bp, Homo sapiens
  misc_feature: GYAE6OF02H7284.29.70.G04.1.454.CMB.1.raw
  modified_base (320)..(320): a, c, t, g, unknown or other
  misc_feature (320)..(320): n is a, c, g, or t
  modified_base (417)..(417): a, c, t, g, unknown or other
  misc_feature (417)..(417): n is a, c, g, or t
  modified_base (423)..(428): a, c, t, g, unknown or other
  misc_feature (423)..(428): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgagactggggccagggaccccggtcaccgtctccccagcctccaccaaggccccatcggtcttcccccnggcgccctgctccaggacgcacctccgagagcacagcggccctgggctgcctggtcaaggctactccagtactctatctgagcgggctggcaaggcncatagnnnnnn

SEQ ID NO: 224270 - DNA, 518 bp, Homo sapiens
  misc_feature: GYAE6OF02I5AGT.29.70.G04.1.454.CMB.1.raw
  modified_base (371)..(371): a, c, t, g, unknown or other
  misc_feature (371)..(371): n is a, c, g, or t
  modified_base (437)..(437): a, c, t, g, unknown or other
  misc_feature (437)..(437): n is a, c, g, or t
  modified_base (496)..(496): a, c, t, g, unknown or other
  misc_feature (496)..(496): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcacattcagtgacgtctggatgagctgggtccgccagactccgagggagggctagagtgggttggccgcattacagtcagagggaccagtgggaaagnggactatagtgtccccgtgaagggcagacttctcgtatttctcgagatgatctagaaagatacgtntatctacatatgagtgcctgcgagccgaggacacgaggcatctaactactcgcgcgacngtccggtcgacccaggtgtacg

SEQ ID NO: 224271 - DNA, 478 bp, Homo sapiens
  misc_feature: GYAE6OF02JEV6O.29.70.G04.1.454.CMB.1.raw
  modified_base (278)..(278): a, c, t, g, unknown or other
  misc_feature (278)..(278): n is a, c, g, or t
  modified_base (339)..(339): a, c, t, g, unknown or other
  misc_feature (339)..(339): n is a, c, g, or t
  modified_base (448)..(478): a, c, t, g, unknown or other
  misc_feature (448)..(478): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtnaccgtctccccagcctccaccaagggcccatcggcttccccctggcgccctgctccaggancacctccgagacgccacacgccggccctgggcctcggccctgggtcaaacgggtcctaacgttcccaggtactcgtaatctggagcgggctggcgaaggcgcatagcgnnnnnnnnnnnnnnnnnnnnnnnnnnnnnnn

SEQ ID NO: 224272 - DNA, 447 bp, Homo sapiens
  misc_feature: GYAE6OF02HMYVF.29.70.G04.1.454.CMB.1.raw
  modified_base (432)..(447): a, c, t, g, unknown or other
  misc_feature (432)..(447): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggccccatcggtccttcccccctgggccgccctgcctccaggagccacctccgagagcacagcggccctgggctgcctggcaaggctacttccagtactctatctgacggcgggctggcaaggcgcagtagnnnnnnnnnnnnnnnn

SEQ ID NO: 224273 - DNA, 431 bp, Homo sapiens
  misc_feature: GYAE6OF02JGBT3.29.70.G04.1.454.CMB.1.raw
  modified_base (395)..(395): a, c, t, g, unknown or other
  misc_feature (395)..(395): n is a, c, g, or t
  modified_base (425)..(431): a, c, t, g, unknown or other
  misc_feature (425)..(431): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgattctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggccccatcggtcttccccctggcgccctgctccaggagcacctccgagagcacagcggccctgggctgcctggtcaaggctacttccagtacnctatctgagcgggctggcaaggcgcatagnnnnnnn

SEQ ID NO: 224274 - DNA, 550 bp, Homo sapiens
  misc_feature: GYAE6OF02HD43O.29.70.G04.1.454.CMB.1.raw
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
  modified_base (540)..(540): a, c, t, g, unknown or other
  misc_feature (540)..(540): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcgttggtagaggccggggcagtccctgagactctcgtgtgaaggctctggattcacattcagtgacgtctggatgagcgtgggtccgccgagacctccgaggggaaggggctaggaggtgggttggccgcattacgaagtcgagagggaccagtagggaaagaggaactagtagtcgtccccgtagaagggcagtacttcgcgtatttcgtgagatgatcgagaagtaactaccgtagtactctaacattatgagtgccgtgcgacgcgaaggcacgaggcagtctactacgngccgngacagtccggacgtacccgnggtcggtacg

SEQ ID NO: 224275 - DNA, 437 bp, Homo sapiens
  misc_feature: GYAE6OF02HLPPY.29.70.G04.1.454.CMB.1.raw
  modified_base (278)..(278): a, c, t, g, unknown or other
  misc_feature (278)..(278): n is a, c, g, or t
  modified_base (420)..(420): a, c, t, g, unknown or other
  misc_feature (420)..(420): n is a, c, g, or t
  modified_base (426)..(437): a, c, t, g, unknown or other
  misc_feature (426)..(437): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtnaccgtctccccagcctccaccaagggccccatcggtcttccccctggccgccctgctccaggagcacctccgagagcacagcggccctgggctgcctggtcaaggctacttccagtactctatctgagcggctggcaaggcncatagnnnnnnnnnnnn

SEQ ID NO: 224276 - DNA, 531 bp, Homo sapiens
  misc_feature: GYAE6OF02G8VPC.29.70.G04.1.454.CMB.1.raw
  modified_base (344)..(344): a, c, t, g, unknown or other
  misc_feature (344)..(344): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcactattcagtgacgtctggatgagcgtgggtccgccagactccgagggaagggctagagtgggtggccgnattacaagtcaggagggaccagtagggaaagaggactagtagtcgtccccgtanaacgggcagtattcncgtatttcgcgagatgatcgtagaaagtaataccgtagtaactctacattagtgagtcgcctgcgagccgagacacgagcagtctactancgcgcgacngtcggacacccgagtgacg

SEQ ID NO: 224277 - DNA, 561 bp, Homo sapiens
  misc_feature: GYAE6OF02GX1RS.29.70.G04.1.454.CMB.1.raw
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (355)..(355): a, c, t, g, unknown or other
  misc_feature (355)..(355): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (535)..(543): a, c, t, g, unknown or other
  misc_feature (535)..(543): n is a, c, g, or t
  modified_base (545)..(552): a, c, t, g, unknown or other
  misc_feature (545)..(552): n is a, c, g, or t
  modified_base (554)..(557): a, c, t, g, unknown or other
  misc_feature (554)..(557): n is a, c, g, or t
  modified_base (559)..(561): a, c, t, g, unknown or other
  misc_feature (559)..(561): n is a, c, g, or t
tcagatagagtactcacgaccggtgctcgatttagtgtagtgtgaagggaaaggggcgtagagtgggttggccgcattacaagtcagagggaccatgggaaagaggactatagtgtccccgtcaagggcaggattctcgatttctcgagatgatctgaagaataccgtgtatctacatatgagtcgcctgcgagccgaggacactggcatctactactgcgcgacatcggtcaccagtggctagttntcctgancgtgggcacgggaacccggtcaccgtctcccacgcctccaccgaacgggcccaacgtccggtaccttccccccgtggcccgccctcgccctccgaacggcnccgaccctacggacggacgacgaccacggccggtccctacggggcttacggccgtcgggtactaaacggggacctttaaccgttcccgaacgtttacgtccttaactccgttcgaagggtccggacgtcggacggtaacggcgacgacgttaacggctgactcgatcggacngntcgncnnnnnnnnncnnnnnnnncnnnncnnn

SEQ ID NO: 224278 - DNA, 438 bp, Homo sapiens
  misc_feature: GYAE6OF02IDLWT.29.70.G04.1.454.CMB.1.raw
  modified_base (325)..(325): a, c, t, g, unknown or other
  misc_feature (325)..(325): n is a, c, g, or t
  modified_base (424)..(424): a, c, t, g, unknown or other
  misc_feature (424)..(424): n is a, c, g, or t
  modified_base (429)..(438): a, c, t, g, unknown or other
  misc_feature (429)..(438): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccaggggaacccccggtcaccgtctccccagcctccaccaagggccccatcggtcttcccccnggcgccctgctccaggagccacctccgagagcacagccggcctgggctgcctggtcaaggactactcagtactctatctgagcgggctgggcaaggcgnatagnnnnnnnnnn

SEQ ID NO: 224279 - DNA, 614 bp, Homo sapiens
  misc_feature: GYAE6OF02HWCUT.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgaacaggactgaacacagaggactcaccatggagtttgggctgaggtggattttgcttgttaccattttaaaaggtgtccagtgtgcggtgctatttgatggaggtccggggggaggcttggtagagccggggcacgtccctgagactctcgtgtgaaggctctggattcactattcagtcgacgtctggatggagccgtggggtcccgccacgacctccgaaggggaacggggctaaggaggtggggtcggccgcattacgagtcaggtagggaccagtgggaaagacggactagtagtcgtcccgtagaagggcagtacttctcgtatttcgcgagtatagtatcgtagaaagtaacttacccggtataacttctaactattatggagtcggcctggccggagcccggaagaccgagacggactacgttcctaaccgtactcgggacccgacggtaaccacggttccgggtaccaaccccggtagggttccggacctttacggg

SEQ ID NO: 224280 - DNA, 498 bp, Homo sapiens
  misc_feature: GYAE6OF02H13WK.29.70.G04.1.454.CMB.1.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (484)..(498): a, c, t, g, unknown or other
  misc_feature (484)..(498): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttcttgaagactggggccagggaccccgtcaccgtcctccccagcctccaccaacggccccatccggtccttcccccgtggccncccctgcctccgaggacnccaccctccgagacgccaacgacgccggcccgtgggcctcggcccgtgggtaccgaaacgggtaccttaccttacccgaacgttacctcgttaactcgtgaacggccggggtctggggaccaagggccacaagtagnnnnnnnnnnnnnnn

SEQ ID NO: 224281 - DNA, 552 bp, Homo sapiens
  misc_feature: GYAE6OF02I6QWK.29.70.G04.1.454.CMB.1.raw
  modified_base (386)..(386): a, c, t, g, unknown or other
  misc_feature (386)..(386): n is a, c, g, or t
  modified_base (435)..(435): a, c, t, g, unknown or other
  misc_feature (435)..(435): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccgggcagtccctgagactctcgtgtgaaggctcgtggattcactattcagtgacgtctggatgagcgtgggtcccgccgagacctccgaggggaaggggctaaggaggtgggttcggccgcagttacaagtcaggacggaccagtagggaaagnggactagtacgtcgtccccgtagaacgggcagtacttctacgtatttcngagtatgatcgtagaagtaattaccgtagtactactacatacgtgagtcgctgcgacgcgagcacgcgcagtctacgtctcgcgacgactagtccggtacgacccgtagtcggtacg

SEQ ID NO: 224282 - DNA, 502 bp, Homo sapiens
  misc_feature: GYAE6OF02JMPMD.29.70.G04.1.454.CMB.1.raw
  modified_base (473)..(502): a, c, t, g, unknown or other
  misc_feature (473)..(502): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggccagtttcgttccttgaagacgtggggccagggaaccccggtcaccggtcctccccagcctccaccgaacgggccccagtccggtccttcccccctggccgacccctgcctccgaggacgccaacctccgagacgcaccgacgccgccctgggctcgccgtgtcgaacggtacctacttccgacgtacgtctaactcgtgacggccgggctgggacgtaacgggccacatacgnnnnnnnnnnnnnnnnnnnnnnnnnnnnnn

SEQ ID NO: 224283 - DNA, 440 bp, Homo sapiens
  misc_feature: GYAE6OF02H3JEZ.29.70.G04.1.454.CMB.1.raw
  modified_base (326)..(326): a, c, t, g, unknown or other
  misc_feature (326)..(326): n is a, c, g, or t
  modified_base (420)..(420): a, c, t, g, unknown or other
  misc_feature (420)..(420): n is a, c, g, or t
  modified_base (426)..(440): a, c, t, g, unknown or other
  misc_feature (426)..(440): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctcaccaagggcccatcggtcttccccctgggcncccctgcctccaggacgcacctccgagagcacagcggccctgggctgcctggtcaaggctatccagtactctatctgagcgggctggcaaggcncatagnnnnnnnnnnnnnnn

SEQ ID NO: 224284 - DNA, 438 bp, Homo sapiens
  misc_feature: GYAE6OF02F9EYI.29.70.G04.1.454.CMB.1.raw
  modified_base (423)..(423): a, c, t, g, unknown or other
  misc_feature (423)..(423): n is a, c, g, or t
  modified_base (429)..(438): a, c, t, g, unknown or other
  misc_feature (429)..(438): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattatcgatttctcgagatgatctgaagaataccgtgtatctacatatgagtggcctgcgagccgaggacataggcatctactactgcgcgacatcggtgaccccagtggcagttgttccttgaagactggggccagggaaccccggtcaccgtctccccagcctccaccaagggcccatcggtcttccccctggccgccctgctccaggacgcacctccgagagcacagccggccctgggctgcctggtcaaggactacttccagtactctatctgagcggctggcaaggcncatagnnnnnnnnnn

SEQ ID NO: 224285 - DNA, 427 bp, Homo sapiens
  misc_feature: GYAE6OF02FNRLH.29.70.G04.1.454.CMB.1.raw
  modified_base (422)..(427): a, c, t, g, unknown or other
  misc_feature (422)..(427): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgaccccagtggcagttgttccttgaagactggggccagggaaccccggtcaccgtctccccagcctccaccaagggcccatcggtcttccccctggcgccctgctccaggagcacctccgagagcacagcggccctgggctgcctggcaaggctactccagtactctatctgagcgggctggcaaggcgcatagnnnnnn

SEQ ID NO: 224286 - DNA, 597 bp, Homo sapiens
  misc_feature: GYAE6OF02H25CE.29.70.G04.1.454.CMB.1.raw
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (476)..(476): a, c, t, g, unknown or other
  misc_feature (476)..(476): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatgggagtccgggggagcttggtagaggccggggcagtccctgagactctcgtgtgaaggctcgtggattcactattcagtgacgtctggatgagccgtgggtccncagactccgagggagggctaggaggtgggtggccgntagttacaagtcgaaggacgggacaggtagggaaaagaggactagtacggtccgttccccggagaacgggctaaggtacttccgtacggttatttcgacggagtatagattcgaagaagtaactacgtntaactctaactattagtagtacggtcgacctggacggtacgaccggaggaaccacgaggactacgtctaaactcgtcgaccgaccgtacgacggtccggtacgaccctagggtcggtaccg

SEQ ID NO: 224287 - DNA, 445 bp, Homo sapiens
  misc_feature: GYAE6OF02IW8A8.29.70.G04.1.454.CMB.1.raw
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
  modified_base (426)..(445): a, c, t, g, unknown or other
  misc_feature (426)..(445): n is a, c, g, or t
tcagatagagtactcacgaccggtgctcgatttagtgtagtgtgaagggaaaggggctagagtgggttggccgcattacaagtcagagggaccatgggaaagaggactatagtgtcccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaacccccggtcaccgtctccccagcctccaccaagggcccatcggtcttcccctggcgccctgctccaggagcacctccgagacgcacagccggccctgggctgcctggtcaaggactacttccagtactctatcngagcgggctggcaaggcnatagnnnnnnnnnnnnnnnnnnnn

SEQ ID NO: 224288 - DNA, 442 bp, Homo sapiens
  misc_feature: GYAE6OF02HDQ1S.29.70.G04.1.454.CMB.1.raw
  modified_base (342)..(342): a, c, t, g, unknown or other
  misc_feature (342)..(342): n is a, c, g, or t
  modified_base (431)..(442): a, c, t, g, unknown or other
  misc_feature (431)..(442): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctcccccagcctccaccaagggcccatcggtcttccccctggccgcccctgctccaggngccacctccgagagcacagcggccctgggctgcctggtcaaggactacttccagtactctatctgacgcgggctggcaaggcgcatagnnnnnnnnnnnn

SEQ ID NO: 224289 - DNA, 437 bp, Homo sapiens
  misc_feature: GYAE6OF02HSG3U.29.70.G04.1.454.CMB.1.raw
  modified_base (425)..(437): a, c, t, g, unknown or other
  misc_feature (425)..(437): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgttccttgaagactgggccagggaaccccgtcaccgtctccccagcctccaccaaggcccatcggtcttccccctggccgccctgcctccaggacgccacctccgagagcacacgccggcccgtgggctgcctggtcaaggactactcagtactctatctgagcgggctggcaggcgcatagnnnnnnnnnnnnn

SEQ ID NO: 224290 - DNA, 554 bp, Homo sapiens
  misc_feature: GYAE6OF02FS1R9.29.70.G04.1.454.CMB.1.raw
  modified_base (324)..(324): a, c, t, g, unknown or other
  misc_feature (324)..(324): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (530)..(531): a, c, t, g, unknown or other
  misc_feature (530)..(531): n is a, c, g, or t
  modified_base (533)..(536): a, c, t, g, unknown or other
  misc_feature (533)..(536): n is a, c, g, or t
  modified_base (538)..(554): a, c, t, g, unknown or other
  misc_feature (538)..(554): n is a, c, g, or t
tcagatagagtactcacgaccggtgctcgatttagtgtagtgtgaagggaaaggggcgtagagtgggttggccgcattacaagtcagagggaccatgggaaagaggactatagtgtcccgtcaagggcagattatcgatttctcgagatgatctgaagaataccgtgtatctacatatgagtggcctgcgagccgaggacacaggcatctactactgcgcgacatcggtgacccagtggcagttgttccttgaagactgggccagggaaccccggtcaccgtctccccacgcctccaccagggccccatccggtcttcccccgnggccgcccctcgcctcccgacgggacgccaacccgtccgacggacgccacgacgcgggcccctgggctcgcccgtggtcgaaacgggaccttaccgtttaccgacgttaccgtcctaacgtccttcgggacgtccggggaccttcggggaccctaaagggcccgacgtaacgttaaggtccacgtgcgacncncgncncncgcgcnncnnnncnnnnnnnnnnnnnnnnn

SEQ ID NO: 224291 - DNA, 487 bp, Homo sapiens
  misc_feature: GYAE6OF02GTSO0.29.70.G04.1.454.CMB.1.raw
  modified_base (230)..(230): a, c, t, g, unknown or other
  misc_feature (230)..(230): n is a, c, g, or t
  modified_base (452)..(452): a, c, t, g, unknown or other
  misc_feature (452)..(452): n is a, c, g, or t
  modified_base (458)..(460): a, c, t, g, unknown or other
  misc_feature (458)..(460): n is a, c, g, or t
  modified_base (462)..(487): a, c, t, g, unknown or other
  misc_feature (462)..(487): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtnacccagtggcagttgttccttgaagactggggccaggggaaccccggtcaccgtctccccagcctccaccaacgggcccatcggtccttccccctggccgcccctgcctccgaggagcctacctccgagacgccacgaggccggccctggggcctcggcctgggtaccaaggccttaccttccagttacctcttaactctgacgcgggctcggcaagggccngatagnnncnnnnnnnnnnnnnnnnnnnnnnnnnn

SEQ ID NO: 224292 - DNA, 526 bp, Homo sapiens
  misc_feature: GYAE6OF02GVNY7.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagaggccggggcagtccctgagactctcgtgtgaaggctctggattcacattcagtgacgtctggatgagctgggtccgccagactccgagggaagggctaggagtgggttgccgcattacagtcagagggaccagtagggaaagaggactatagtcgtcccgtgaagggcagtattctcgtatttcacgagtatgatctagaagtaataccgtgtatactacattatgtagtgcctgcgagccgagacacgagcatctaactactgcgcgactagtccggtacgaccctaggtggac

SEQ ID NO: 224293 - DNA, 485 bp, Homo sapiens
  misc_feature: GYAE6OF02G96CJ.29.70.G04.1.454.CMB.1.raw
  modified_base (458)..(485): a, c, t, g, unknown or other
  misc_feature (458)..(485): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgttccttgaagactggggccagggaccccggtcaccgtctccccagcctccaccaaggccccatcggtcctccccctggccgccctgcctccgaggacgccacctccgagagccacgacgccggccctggggcctcggccctgggtccaaagggtacctaccgttcccaagttcctcttactctggagccggggctcgggacaaggcgcagtacgnnnnnnnnnnnnnnnnnnnnnnnnnnnn

SEQ ID NO: 224294 - DNA, 429 bp, Homo sapiens
  misc_feature: GYAE6OF02H1JPQ.29.70.G04.1.454.CMB.1.raw
  modified_base (336)..(336): a, c, t, g, unknown or other
  misc_feature (336)..(336): n is a, c, g, or t
  modified_base (421)..(429): a, c, t, g, unknown or other
  misc_feature (421)..(429): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccacaagggcccatcggtctcccctggcgccctgctccaggacncacctccgagacgcacagcgccctgggctgctggtcaaggactacttccagtactctatctgagcggctggcaaggcgacatagnnnnnnnnn

SEQ ID NO: 224295 - DNA, 539 bp, Homo sapiens
  misc_feature: GYAE6OF02GJGJ3.29.70.G04.1.454.CMB.1.raw
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
  modified_base (482)..(482): a, c, t, g, unknown or other
  misc_feature (482)..(482): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcacattcagtgacgtctggatgagcgtggggtcccncagcctccgaggggagggctaggngtgggtgccgnattacagtcagacggacagtgggaaagnggactataggtcgtccccgtagaagggcagattctcgtatttcgcgagatgatcgtagaagacttaccgtgtatctaacattatgagtcgcctgcgagccggaagcacgngctacgtctacctacgtgccgacgtaacacggttccgggacacccggtaggtgtacg

SEQ ID NO: 224296 - DNA, 520 bp, Homo sapiens
  misc_feature: GYAE6OF02FU056.29.70.G04.1.454.CMB.1.raw
  modified_base (416)..(416): a, c, t, g, unknown or other
  misc_feature (416)..(416): n is a, c, g, or t
  modified_base (505)..(505): a, c, t, g, unknown or other
  misc_feature (505)..(505): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcacattcagtgacgtctggatgagctgggtccgccagactccgagggaaggggctagagtgggttggccgcattacaagtcagagggaccagtgggaaaagaggactagtagtcgtccccgtcaagggcagatctcgatttcncgagatgatctagaagataccgtgtatctacatatgagtgctgcgagccgagacacgaggcagtcactactgccgacgacagtccggtnacccgaggtcgtacg

SEQ ID NO: 224297 - DNA, 517 bp, Homo sapiens
  misc_feature: GYAE6OF02G8SB8.29.70.G04.1.454.CMB.1.raw
  modified_base (296)..(296): a, c, t, g, unknown or other
  misc_feature (296)..(296): n is a, c, g, or t
  modified_base (467)..(468): a, c, t, g, unknown or other
  misc_feature (467)..(468): n is a, c, g, or t
  modified_base (470)..(471): a, c, t, g, unknown or other
  misc_feature (470)..(471): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (486)..(495): a, c, t, g, unknown or other
  misc_feature (486)..(495): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(507): a, c, t, g, unknown or other
  misc_feature (503)..(507): n is a, c, g, or t
  modified_base (509)..(509): a, c, t, g, unknown or other
  misc_feature (509)..(509): n is a, c, g, or t
  modified_base (511)..(512): a, c, t, g, unknown or other
  misc_feature (511)..(512): n is a, c, g, or t
  modified_base (514)..(517): a, c, t, g, unknown or other
  misc_feature (514)..(517): n is a, c, g, or t
tcagatagagtactcacgaccggtgctcgatttagtgtagtgtgaagggaaaggggctagagtgggttggccgcacttacaagtcagagggacctatgggaaagaggactatagtgtccccgtcaagggcagattctcgatttctcgagatgatctgtaagaataccgtgtatactacatatgagtggcctgcgagccgaggacacgaggcagtctacgtactgcgcgacatcggtgacccagtcggcagttgttccttgaagactgggccagggaaccccgtcaccgtctccccngcctccaccaagggcccatcggtcttcccccgtggccgccctgcctccgaggagcaccgtccgagacgcacgagcggccctgggcctcggccgtgggtccaaacggaccttacttccgaagttacctactaatccgtagacgtcgggcttggacaaggcgacaagtacggnngnngntagcanacgcgtnnnnnnnnnngngngngnnnnngngnngnnnn

SEQ ID NO: 224298 - DNA, 539 bp, Homo sapiens
  misc_feature: GYAE6OF02HPOSA.29.70.G04.1.454.CMB.1.raw
  modified_base (340)..(340): a, c, t, g, unknown or other
  misc_feature (340)..(340): n is a, c, g, or t
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccggggcagtccctgagactctcgtgtgaaggctctggattcacattcagtgacgtctggatgagctgggtccgccagactccagggaagggctagagtgggtggccgnattacaagtcagagggaccagtagggaaagaggactagtagtgtccccgtanaagggcagattctcgatttcncgagatgactctagaagtaataccgtgtaactctaacataatgagtcggacctggccgagccgaaggacacgacggctagtctaactactgccgcgacgagtccggtcgaaccctggtcggtaccg

SEQ ID NO: 224299 - DNA, 477 bp, Homo sapiens
  misc_feature: GYAE6OF02GHDBB.29.70.G04.1.454.CMB.1.raw
  modified_base (279)..(279): a, c, t, g, unknown or other
  misc_feature (279)..(279): n is a, c, g, or t
  modified_base (442)..(442): a, c, t, g, unknown or other
  misc_feature (442)..(442): n is a, c, g, or t
  modified_base (444)..(477): a, c, t, g, unknown or other
  misc_feature (444)..(477): n is a, c, g, or t
tcagatagagtactcacgaccggtgctcgatttagtgtagtgtgaagggaaaggggcgtagagtgggttggccgcattacaagtcagagggaccatgggaaagaggactatagtgtccccgtcaagggcagattctcgattttctcgagatgatctgaagaataccgtgtatctacatatgagtggcctggccgagccgaggacacaggcatctactactgcgcgacatcggtgacccagtggcagttgtccttgaagactgggccagggaaccccgtnaaccgtctccccagcctccacgaacgggcccatcggtcttcccctggcgccctgcctccaggacgccacctcgacagcacacgcgcctgggcctgccctggtacaggcctaacttccgagtactcctaatcgtcgaggcggctggtcaaggccgtcaagtcgnannnnnnnnnnnnnnnnnnnnnnnnnnnnnnnnnn

SEQ ID NO: 224300 - DNA, 562 bp, Homo sapiens
  misc_feature: GYAE6OF02G5Y08.29.70.G04.1.454.CMB.1.raw
  modified_base (459)..(459): a, c, t, g, unknown or other
  misc_feature (459)..(459): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttgggtagagccggggcagtccctgagactctcgtgtgaaggctctggattcacattcagtgacgtctggatgagcgtcggggtccgccgagacctccgaggggagggctaggagtggggttggccgcattacaagtcaggagggaccagagggaaagaggatagtagtcgtccccgtacgaagggcagatttcgtacgtatttcgcgagtatgatcgtagaagtacttaccggtntatctaacattagtgagttcggcctggcgacggccgaggacacgaggctacgtctacctacgcggtaccgcgactcggtccggacgacccgtaggtcgtacgg

SEQ ID NO: 224301 - DNA, 482 bp, Homo sapiens
  misc_feature: GYAE6OF02FR4TT.29.70.G04.1.454.CMB.1.raw
  modified_base (452)..(453): a, c, t, g, unknown or other
  misc_feature (452)..(453): n is a, c, g, or t
  modified_base (455)..(482): a, c, t, g, unknown or other
  misc_feature (455)..(482): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattatcgatttctcgagatgatctgaagaataccgtgtatctacatatgagtggcctgcgagccgaggacacaggcatctactactgcgcgacatcggtgacccagtggctagtttgttccttgaagacgtggggccagggaccccggtcaccgtcctccccagccctccaccaagggccccagtccggtccttcccccgtggccgcccctgcctccgaggcgcacccgtccgagacgcacgacgccggccctgggctcgcctggtacaaggacctacttccagtactctatctgagcgggctggacaagggccgacagtgnncnnnnnnnnnnnnnnnnnnnnnnnnnnnn

SEQ ID NO: 224302 - DNA, 841 bp, Homo sapiens
  misc_feature: GYAE6OF02GDKBK.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggaggtccgggggaggcttgggtagagccggggcagtccctgagactctcgtgtgaaggctctggacttcactattcaggtgacgtctggatggagcgtggggtcccgccacggacctccggaaggggaacggggctaaggagggttggggttcgggcccgtacgtaatttacgaaaggtccgaagggacggggaaccaaggtagggaaaacggaggaacttaagtacggtcggtacccccggtacgaacggggccaggtactttccgtacggttaactttttacccggtacggtaaggtaacgttaggtacttaccgtaagggtaaaacgtaaacgtttaacccggttacgtttaacgtttaaccttaaaccttaaagttaacgttaacgggttaacggggtttccggggtaacccgttcggggtaacccgggtaagggtaccccggggaaaacggggtaaccccggtaaaccggaacggggtaccccgttaaacgtttcccccgtttaaaccggtttaacccgggtccgggtaaccccgggtacccggtaaacccggttaacgggttttaaccccccggggggtaaccggttaaaccccccgggtagggggttttaccgggtaacccccggg

SEQ ID NO: 224303 - DNA, 556 bp, Homo sapiens
  misc_feature: GYAE6OF02GF7WR.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcacattcagtgacgtctggatgagctgggtccgccagctccagggaagggctagagtgggttggccgcattacaagtcagagggaccatgggaaagagactagtagtgtccccgtgaacgggcagattacgtcgatttcctacgagtagtggatctgaagaagtaccgtgtatcctaacaattatagagtcggcctgaccgagtacccggagaacgacagggtccagttcctaccgtactcggcccgacgactacggtccggttacgacccgtagtcggtacg

SEQ ID NO: 224304 - DNA, 668 bp, Homo sapiens
  misc_feature: GYAE6OF02GT00G.29.70.G04.1.454.CMB.1.raw
tcagatagagtactcacgaccggtgctcgatttagtgtagtgtgaagggaaaggggaggctctgggagaagacgccccagccttgggattcccaagtgctttcattcagtgagcaggactgaacacagaggactcaccatggagtttgggctgaggtggattttgcttgtaccattttaaaaggtgtccagtgtgcggtgcatttgatgggagtccgggggagtcttgggtaggacggccggggcacggtcccgtggacgactcgtcgtggtgaaggctcgtggacttcactattcagtgacgttcgtggatggagtcgtcggggtcccgcgtacggaccgtcccggaagggggaaggggtcctaagggacgggttggggttcggcccgatagttaacgaagtccgaaggacgggactaaggtagggaaaagcggaactagtagtccgtcccgtagaagggcagtacttcagtatttccgagagtatgattcgaggtaaataacttccgtagtactcctaatacgttataggtacgtcgtccgtaggaccgtacggacccgaaggaccaacggtacgggacctaaacgttcccgtaaaccgttactcgggaaccgtacgaaccgtacggttaccgggtaaccaccccggttaagggccggttaaccgg

SEQ ID NO: 224305 - DNA, 498 bp, Homo sapiens
  misc_feature: GYAE6OF02H01CC.29.70.G04.1.454.CMB.1.raw
  modified_base (228)..(228): a, c, t, g, unknown or other
  misc_feature (228)..(228): n is a, c, g, or t
  modified_base (466)..(466): a, c, t, g, unknown or other
  misc_feature (466)..(466): n is a, c, g, or t
  modified_base (470)..(498): a, c, t, g, unknown or other
  misc_feature (470)..(498): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtnacccaggtggcagtttcgttccttgaagctggggccagggaaccccggtcaccgtctccccagcctccaccaagggcccatccggtcttccccctggccgcccttcgcctccgacggtacgcaccctccgacgacgccacgacgccgggccctggggcctcgcccgtggtaccaacgggccttacttcccgagttacctctacttcgtgcggcgggctggacgaaggcgacgatacgncagnnnnnnnnnnnnnnnnnnnnnnnnnnnnn

SEQ ID NO: 224306 - DNA, 637 bp, Homo sapiens
  misc_feature: GYAE6OF02FHDXK.29.70.G04.1.454.CMB.1.raw
  modified_base (342)..(342): a, c, t, g, unknown or other
  misc_feature (342)..(342): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccggggcagtccctgagactctcgtgtgaaggctcgtggattcgacattcagtgacgtctggatgagctgggtccgccagactccgagggaagggctagaggtggtgccgnatacgagtcagagggaccagtagggaaagnggactagtagtcgtccccggtanaacgggccagacttcgtacgattttcgcgagattcggaattctaggaaacaacgttaccgtagtacttaccgttacgaattaacgtggtaacgttcgggaccttggaccggaacggtccggtaaacgggacctaaacggacgggtacccaatttacccggtaaccttaccgggtcggtacccggtaacgtacccggagtttaccccggggttaacgacccccgtaagggttcgggtaaccgg

SEQ ID NO: 224307 - DNA, 546 bp, Homo sapiens
  misc_feature: GYAE6OF02I59GA.29.70.G04.1.454.CMB.1.raw
  modified_base (512)..(512): a, c, t, g, unknown or other
  misc_feature (512)..(512): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggatttgcttgttaccattttaaaaggtgtccagtgtgcggtgcatttgatggagtccgggggaggcttggtagagccggggcagtccctgagactctcgtgtgaaggctctggattcacattcagtgacgtctggatgagcgtggggtccgccaggacctccgaaggggaaggggctaggaggtgggtcggccgcattacagtcgagagggaccagtagggaaaagaggaactagtagtcgtaccccgtagaacgggcagacttctacgtatttcacgagatgactctagaagaataccgtgtactcctaacatactgagtcggcctgcgagccgaggacacgagcatctactacncgcgacgacacgtccggcgaccctaggtcggtcg

SEQ ID NO: 224308 - DNA, 770 bp, Homo sapiens
  misc_feature: GYAE6OF02HGMH3.29.70.G04.1.454.CMB.1.raw
  modified_base (655)..(655): a, c, t, g, unknown or other
  misc_feature (655)..(655): n is a, c, g, or t
tcagatagagtactcacgaccggtgctcgattttagtgtagtgtgaagggaaagggggctagagtgggttgccgcattacaagtcagagggaccatgggaaacgaggactatagtgtccccgtcaacgggcacgattctcgatttctcgaggactgatctgaagaataccgtgtatctacatatcgagtggcctgcgagccgaggacacaggcatctactactgcgcgacagtcggtgacccagtggctagtttcgtttccttggaacgtacgtcggggaccaacggggaaccccccggtcaacccggtccctacccccgagtccctacctaacccgtaaaggggccccaagttccgggttacccctttcccccccgtgggacccgtcccccgtcggtacccgttcccggaacgggtaccgtcccgtaaccccgtttccggaacgaccggcctaaccggaacgggtccccgggtccccgtacgggggtcccttaccggcccggtttacgggtaacccgtaaacgggttacccttaacccggtttacccgtaacgggttaaccctttaccggttaacgttaccggttaccgggaagggtcccggggttacttccgggaacgaccgggtccgacccgttaagttacggtacacgacngactaccgtgtcgtactacgtccgaagttccgactacggttagccgtagtaccgacgcgtaccgactaaccgctaccgtcgtcgtactccgtccgttaccgtccgtcgtcgtacg

SEQ ID NO: 224309 - DNA, 875 bp, Homo sapiens
  misc_feature: GYAE6OF02IZOCH.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctattttaaaaggtgtccagtgtgcggtgctatttgatgggacggttaccggggggagggtcgtttgggtaggacgggcccgggggctaacggttcccccgtaggacgtaccttccgttccggttaggtggtaacgggccgttaccgttgggtaactttccgaaccgtacttttaccgaaggttacggtaacccggttcgtagggtaattacggtaacggtccggttccgggggtaccccgacccgtaacggtacccggtacccgggaaggggggtaaacgggggtccgttaagggtacggggttacgggggtttcggccccggtactaacgttaaccgaaacggttccgaaggggaacggggtaaccctaagggtaaggggaaaaacgggtaggtaaaccgttagtaaacggttcccggtacccccgttacggaaacggggtcctaaggtaacgttttcctaccggtaacgtttttccgtaaccggtaaggtacttacggtaacttaccgttaagggaaacgtaacgtttaaacccggttgttaaactcccgttaaactagttaaagttacggtacggttcgtcccgttagggcccggtaaggtacccgggaaagacccgaacggtacggacctaacggttccttaacgtccgtagccgtaaccgactacggttccgggacctaacccgttggaccgtaccgg

SEQ ID NO: 224310 - DNA, 714 bp, Homo sapiens
  misc_feature: GYAE6OF02JA232.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgctatttgatgggaggtccgggggaggcgttggtaggacggccggggcacggtcccgtggagtacctcgtcgtggtgaacggctcgtggtacttcactattcgagtcgacgttcgtggtatgagtcgtcgggtcccgccgagaccgtaccggaagggggaacgggcgtaaggtagggttgggggttcggcccggtactaagttaaccgaagtccgaaagggaacgggaaccgaaggtaggggaaaacgaggtaaccgttaagttaacgggttccggtaccccgtacggaacggggtacaaggttaccttccggtagttaacgttttcgaacggtagtattagacgttacgtaggaaaaacgtacttaccggttagttaaacttaccaacttaagttaacgtggttaaccgtgggtaccgtgccgtaacggcccgtaaggaccacggacgtactacgtccttaaccgcgtagaccggtacgtacgtaaccggttccggaccgtaccgaggttgacgg

SEQ ID NO: 224311 - DNA, 474 bp, Homo sapiens
  misc_feature: GYAE6OF02GDLWR.29.70.G04.1.454.CMB.1.raw
  modified_base (280)..(280): a, c, t, g, unknown or other
  misc_feature (280)..(280): n is a, c, g, or t
  modified_base (348)..(348): a, c, t, g, unknown or other
  misc_feature (348)..(348): n is a, c, g, or t
  modified_base (443)..(443): a, c, t, g, unknown or other
  misc_feature (443)..(443): n is a, c, g, or t
  modified_base (445)..(474): a, c, t, g, unknown or other
  misc_feature (445)..(474): n is a, c, g, or t
tcagatagagtactcacgaccggtgctcgatttagtgtagtgtgaagggaaaggggctagagtgggttggccgcattacaagtcagagggaccacgggaaagaggactatagtgtccccgtcaagggcagattctcgatttctcgagatgatctgaagaataccgtgtatctacatatgagtggcctgcgagccgaggacacaggcatctactactgcgcgacatcggtgaccccagtggcagttgttccttgaagactggggccaggggaaccccggtnaccgtctccccagcctccaccaagggcccatccggtccttcccccgtggccgccctgcctccgaggcnccacctccgagacgcacacgccggccctggctgcctggacaaggactactccagtactctatctagagtcggcgtggcgaacggcgacgagtagnannnnnnnnnnnnnnnnnnnnnnnnnnnnnn

SEQ ID NO: 224312 - DNA, 649 bp, Homo sapiens
  misc_feature: GYAE6OF02IKO3P.29.70.G04.1.454.CMB.1.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
  modified_base (451)..(451): a, c, t, g, unknown or other
  misc_feature (451)..(451): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgtaccattttaaaaggtgtccagtgtgcggtncatttgatggagtccgggggagtcttgggtagaggccggggcacggttccctggaacgctcgtcgtgtgaacggctcgtggattcanattcagtgacgtctggatgagngttcgggaccnccagacctccgaagggacgggctaggagtgggtgccgtanagtacagtcaggaggaccagtagggaaagacggactataaggtcggtaccccgtagaacggccaagtcgttcgtacgtaatttccgaacgtanaagtcgtaacttcgtacggtaaaagtaacttaccggtaagtaacgttacgtaaccgtaattacgtaaggtacggtcggaaccgttcgggacgacgggacccgaaagggtaacacggtacgaacgtaccttccggtaacctcggtccgaccggaccgaacgttcggtaccggggttacacccggtacggttaggacccg

SEQ ID NO: 224313 - DNA, 577 bp, Homo sapiens
  misc_feature: GYAE6OF02IQ5WO.29.70.G04.1.454.CMB.1.raw
  modified_base (290)..(290): a, c, t, g, unknown or other
  misc_feature (290)..(290): n is a, c, g, or t
  modified_base (351)..(351): a, c, t, g, unknown or other
  misc_feature (351)..(351): n is a, c, g, or t
  modified_base (432)..(432): a, c, t, g, unknown or other
  misc_feature (432)..(432): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggaggtccgggggaggcttggtagagccggggcagtccctgagactctcgtgtgaaggctctggattcacattcagtgacgtntggatgagctggggtccgccaggactccgaagggggaacgggctaggaggtgggttggccnatacaagtcagagggaccagtaggggaaaagaggactaagtacgtcggtaccccgtcgaagggcagagtttctcgatttcncgagatgatctagaaagactaccgttntactctaacntangtaagtggcctggcgagccgaagggacacgaggctaattccgtaactacgtacggccgtaccgaacctcggttaccggtaccggaccccgtaaggtccggtaacg

SEQ ID NO: 224314 - DNA, 622 bp, Homo sapiens
  misc_feature: GYAE6OF02JBNSU.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggatttgcttgttaccattttaaaaggtgtccagtgtgcgtgcatttgatggagtccgggggagcgttggtagagccggggcagtccctgacgactctcgtgtgaaggctctggattcacattcagtcgcgtctggatgagcgtgggtcccgcagaccgtccgaggggagggctaggaggttgggtcggccgacgaattacaagtcgaaggagggaccagtagggaaacgaggactatagtcgtccccggtagaacgggcaggtattccgtagtacttttcgcgagtatgaactcgtagaaagtaacttaccggtagttactacgactattaagtgtagtcggaccgtggcgaacggtcccgaagggaacctacggagtacgtaacgtacccttaacgtacccgtggaacccggtaccgtaaccgtacggttacccgggtacccggacccgttaggtcgggtacccg

SEQ ID NO: 224315 - DNA, 528 bp, Homo sapiens
  misc_feature: GYAE6OF02GTWMH.29.70.G04.1.454.CMB.1.raw
  modified_base (340)..(340): a, c, t, g, unknown or other
  misc_feature (340)..(340): n is a, c, g, or t
  modified_base (367)..(367): a, c, t, g, unknown or other
  misc_feature (367)..(367): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (475)..(475): a, c, t, g, unknown or other
  misc_feature (475)..(475): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcacattcagtgacgtctggatgagctggggtccgccagctccgagggagggctagagtgggtgccgnatacagtcagaggaccagtgggaaagnggactagtagtcgtccccgtcgaagggcagtattctcgtatttcncganatgatctgaagataccgtgtatctacatatggagtcgcctgaccgagccgaggacacgnggctagtccacttacgtggccgcgacagtccggtacgacccgtaggtcgtacg

SEQ ID NO: 224316 - DNA, 642 bp, Homo sapiens
  misc_feature: GYAE6OF02HUYPG.29.70.G04.1.454.CMB.1.raw
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggtattttgcttgttacctattttaaaaggtgtccagtgtgcggtgcatttgattggaggtccgggggaggtcttggtagagccggggcagtccctgagactctcgtgtgaaggtctcgtggattacgacattcagtgacgtctggatggagcgtggtcccgcagacctccgaggggaagggctaggngtgggttcggccganactttacaagtacagggtacggaactaggtagggaaaggaggtaacgttaagtaggtccggtaccccggtacgaaggggtccagtacttccgttacgtacgtttcgtagtagattgattcgtagtaaagtaacgtacgttgtaacttacaatacgttagtgacggtggtacctcgggacgtacggaccggaacgacgtaccgacgggtactacgtacgtaacttacgcgtacccgaacgtacgtacggtccggtttaaccggacccggttaggtaggtaacccg

SEQ ID NO: 224317 - DNA, 570 bp, Homo sapiens
  misc_feature: GYAE6OF02IL0AL.29.70.G04.1.454.CMB.1.raw
  modified_base (514)..(514): a, c, t, g, unknown or other
  misc_feature (514)..(514): n is a, c, g, or t
  modified_base (538)..(538): a, c, t, g, unknown or other
  misc_feature (538)..(538): n is a, c, g, or t
  modified_base (540)..(570): a, c, t, g, unknown or other
  misc_feature (540)..(570): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctagaagaattaccgtgtatctacatatgagtggcctgcgagccgaggacacaggcatctaactactgccgcgaacagttcgggacgaccccaggtcgggacctaggtttcgtttcccttagaaacggacgtcggggacccgaacggggtaaacccccggtcacccgtcctcccccaacgtcccctaccgaacccgaacgggcccctacgtcccggttcccttcccccgtggcccgcccctgcctaccgacggacgcccaccgtccgaagcgacgaccgacggccggcccgtgggcctcgccgtcggtacgaaacggtcctaacgttccaagttacctactatccgtaggaccgggcggtcncgggtacgaacgggctacagtagncnnnnnnnnnnnnnnnnnnnnnnnnnnnnnnn

SEQ ID NO: 224318 - DNA, 587 bp, Homo sapiens
  misc_feature: GYAE6OF02F7B3G.29.70.G04.1.454.CMB.1.raw
  modified_base (350)..(350): a, c, t, g, unknown or other
  misc_feature (350)..(350): n is a, c, g, or t
  modified_base (421)..(421): a, c, t, g, unknown or other
  misc_feature (421)..(421): n is a, c, g, or t
tcagatagagtactcacgaccggtgctcgatttagtgtagtgtgaagggaaagggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagagccggggcagtccctgagactctcgtgtgaaggctctggattcacattcagtgacgtctggatgagctggggtccgccagacctccgaggggaaggggctaggaggtgggttggccgnattacagtcagagggacagtgggaaagaggataatagtcgtccccgagaagggcaagattctcgtatttcncgagtatgattcaggaaagaacttaccggtagttaactcctaacgtattagtaggagttacgggccttaggacggtacggccggaacggaccgacgtaagggctagtaccgtaactacgtcggtccgtcggtctacggttccggtacacccggtaggtcggtaccg

SEQ ID NO: 224319 - DNA, 731 bp, Homo sapiens
  misc_feature: GYAE6OF02IKERE.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccaattttaaaaggtgtccagtgtgcggtgcatttgatggaggtccgggggagcttggtagagccggggcagtccctgacgactctcgtgtgaaggctctggattcactattcagtcgacgttctggatgagtcgtcgggtccgccagacctccggaaggggaacggggacctaaggtagggttcggggttcgggccggtactaagttaaccgaaaggtccgaaagggtaacgggaacccgaaggttaaggggaaaaagaacgggtaacttaagttaacggtaccgttacccccggtacggaaacggggtcaaggttactttacccgttacggtaacttttcgtcggtaagttaactggtaacttaccgtaaggtaaacgtaaacgttacccggttaagttaacgttcctaaactaagttaagttagggtaacgtcgggtccttaggacccggacggacccggtaaaggaccgaaccgacgggtactaaccgttctaacccgtacgtggacccgacgtaaccgtacgtaccggggttaccacccggtacggttcgtaaccg

SEQ ID NO: 224320 - DNA, 870 bp, Homo sapiens
  misc_feature: GYAE6OF02H035D.29.70.G04.1.454.CMB.1.raw
  modified_base (691)..(691): a, c, t, g, unknown or other
  misc_feature (691)..(691): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctattttaaaggtgtccagtgtgcggtgctatttgagtgggaggtccgggggaggtcgttgggtaggacgggccgggggacacggttcccgtggacgaccttccgttcggttaggtacggtaacgggtccttcggtagggtactttccgaacgtatttcgaaggttcggtaaccgttcggttagggattacggacggtccggttcggggttcccaccggaaggtacccgtccgggaaacgggggtaacggggacttagggaacgggtttcggggggttaccgtcccggaagttaacgtttaacgaaacgggttccgaaaggggtaccggggaacccgtaaggtttaaggggaaaaacggaacgggttacgttaagtacggtttcccgggtacccccgtaagggaaaccggggtctaacggttactttacccggtacggtttaacgtttccgtaaccgggtagttaacgtacggttaattaccgtaagggtaaaacgtaaccgttacggtacgtttaaacncgtttaaacgagttaaacggttacggacggtttaaccggaccctttacggggaaccgtaacccgggaccggtaaacggtaacccacggtacgggtactaacgttacccgttaacgttcggtacggaccggtactacggtacggttcccggtaaccgaaccggttaggtccgtaaccggg

SEQ ID NO: 224321 - DNA, 506 bp, Homo sapiens
  misc_feature: GYAE6OF02FVDB9.29.70.G04.1.454.CMB.1.raw
  modified_base (231)..(231): a, c, t, g, unknown or other
  misc_feature (231)..(231): n is a, c, g, or t
  modified_base (349)..(349): a, c, t, g, unknown or other
  misc_feature (349)..(349): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (468)..(470): a, c, t, g, unknown or other
  misc_feature (468)..(470): n is a, c, g, or t
  modified_base (472)..(472): a, c, t, g, unknown or other
  misc_feature (472)..(472): n is a, c, g, or t
  modified_base (480)..(506): a, c, t, g, unknown or other
  misc_feature (480)..(506): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgattttctcgagatgatctgaagaataccgtgtatctacatatgagtggcctgcgagccgaggacacaggcatctactactgcgcgacatcggtnacccaggtggcagttgttccttgagactggggccaggggaaccccggtcaccgtctccccagcctccaccaaggccccatcggtccttcccccgtggccgcccctgcctccacgggancaccctccgagagccacaggccggccccgtaggggccctttaccgtgggtacaacggggtcctacgtttcccagttacctctacgtctggacgcgggctcggcaagggcncgatagnannncntcagtcannnnnnnnnnnnnnnnnnnnnnnnnnn

SEQ ID NO: 224322 - DNA, 530 bp, Homo sapiens
  misc_feature: GYAE6OF02IKFG6.29.70.G04.1.454.CMB.1.raw
  modified_base (122)..(122): a, c, t, g, unknown or other
  misc_feature (122)..(122): n is a, c, g, or t
  modified_base (144)..(144): a, c, t, g, unknown or other
  misc_feature (144)..(144): n is a, c, g, or t
  modified_base (235)..(235): a, c, t, g, unknown or other
  misc_feature (235)..(235): n is a, c, g, or t
  modified_base (404)..(404): a, c, t, g, unknown or other
  misc_feature (404)..(404): n is a, c, g, or t
  modified_base (455)..(455): a, c, t, g, unknown or other
  misc_feature (455)..(455): n is a, c, g, or t
  modified_base (495)..(530): a, c, t, g, unknown or other
  misc_feature (495)..(530): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtnaagggcagattctcgattttcncgagatgatctgaaagaataccgtgtatctacatatgagtcggcctgcgagccgaggaccacaggcatctactactgcgcgacagtcggtnaacccaggtggcaggtttgttccttagaagacgtggggcccgaagggaaccccgtctacccgtcctccccgacgccctacccgaaccgaaccggggcccctaagttccggtccctttcccccgcggcccgtcccctcgaccgtccgaggacgcccaacctccgaggacncaacgacgccggaccgtgggctcgcctggacacgtacctactacagtcctnacgttcacggcgcgggactggacgaacggcgataacaggnnnnnnnnnnnnnnnnnnnnnnnnnnnnnnnnnnnn

SEQ ID NO: 224323 - DNA, 539 bp, Homo sapiens
  misc_feature: GYAE6OF02F966T.29.70.G04.1.454.CMB.1.raw
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (511)..(539): a, c, t, g, unknown or other
  misc_feature (511)..(539): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtcgacccagtggcagttgttccttgaagactggggccagggaaccccggtcaccgtctccccagcctccaccaacgggcccagtcggtccttccccctggccgccctgcctccaggcgccaccgtccgagacggcacgacggccggcccgtggggcctcgccgtcgggtacaaacgggtaccttaccgtttcccaacggtacctttactagttccctaggaacgggcccgggggtccgttaggggacccgtaacgggggcccgactaaacgttaggccncngnnnnnnnnnnnnnnnnnnnnnnnnnnnnn

SEQ ID NO: 224324 - DNA, 707 bp, Homo sapiens
  misc_feature: GYAE6OF02IAGEK.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctattttaaaggtgtccagtgtgcggtgctatttgagtgggaggtccgggggagtcgttggtagacggccggggcacgtccctgacgtactcttcgtgtgaaggctcgtggtattcactattcaggtgacgttcgtggagttgagccgttcgggtcccgccgaacggacctaccggaagggggaacggggtcgtaagggtgggttagggggttcggccgtacgtaagttaacgaaagtccgaagggtacgggaaccgtaaggtacggggaaaacggaggtaaccgttaagttacggttccggttacccccggtaggtaaaccggggacaacggtacgttttccgtacggtttaacttttccgtaacggaggtattacggtattacgtaggaaagttaacctacggttattacgtcctaaagtattacgtaggtacgttcgggccttggaaccgtacggacggacgtaaccgacgaggtacctagtccctaactcgcgtaccgacacgtacggtccgaccggtaccgtaggtcgtcg

SEQ ID NO: 224325 - DNA, 564 bp, Homo sapiens
  misc_feature: GYAE6OF02FWKNE.29.70.G04.1.454.CMB.1.raw
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (514)..(515): a, c, t, g, unknown or other
  misc_feature (514)..(515): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (534)..(536): a, c, t, g, unknown or other
  misc_feature (534)..(536): n is a, c, g, or t
  modified_base (539)..(539): a, c, t, g, unknown or other
  misc_feature (539)..(539): n is a, c, g, or t
  modified_base (544)..(546): a, c, t, g, unknown or other
  misc_feature (544)..(546): n is a, c, g, or t
  modified_base (549)..(549): a, c, t, g, unknown or other
  misc_feature (549)..(549): n is a, c, g, or t
  modified_base (551)..(552): a, c, t, g, unknown or other
  misc_feature (551)..(552): n is a, c, g, or t
  modified_base (557)..(558): a, c, t, g, unknown or other
  misc_feature (557)..(558): n is a, c, g, or t
  modified_base (560)..(560): a, c, t, g, unknown or other
  misc_feature (560)..(560): n is a, c, g, or t
  modified_base (563)..(563): a, c, t, g, unknown or other
  misc_feature (563)..(563): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggctagttgttcctgaagacgtggggccacgggaaccccgtcaccgtcctcccgagcctaccaccgaacgggcccagtccggtccttcccccgtggccgccctgcctccgaggacgcctaccgtccgagacgccaacgacgccggcccgtggggctcggccgtggtacccgtaaagggtacccttaacgtttacccgtaacttcctacgttacgtcgggacggccgggtcttcgggaccgtaaacgggccgcgaaagttacgngtnagtcacggtcnncgagctcngcacntnacgnnngcngcgcnnngcncnncgacnncnganc

SEQ ID NO: 224326 - DNA, 833 bp, Homo sapiens
  misc_feature: GYAE6OF02FUM22.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttacctattttaaaaggtgtccagtgtgcggtgctatttgatggaggtccgggggagggtcgttggtaggaggccggggcagtcccgtgagacctctcgtgtgaaggctctggacttcactattcagtgacgtctggatggacgcgtcggggtcccgaccacggtaccgtaccggaagggggaacggggtcgtaacgggtagggttcgggggttacgggccccggtactaagtttaaccggtaaaggttccgaacgggaacggggaacctaaagggtaacgggggaaaacgggaaaccgggtacgtttaaaggttaacggttacccgggttacccccggtaaccggtaaacgggggtcctaaacgggtttaacgttttcccgttaacggttaaacctttttccggtaaccggtaagttaacgttaggtaacgtttaccgtaaaggtaaaaacgtaaaccggtttaacccggttagtttaaacttacccgttaaacgttacgttaagtacggttaacgggttcgtacccggttgggaaccggaaccggtaccgggaaacggtaccgaacggacgggtacctaacgttcccgttaaacggtacctacgggacccgtacgtaacggtcggtttaccggacccggtaaccccgtaggtccggttaaccgg

SEQ ID NO: 224327 - DNA, 649 bp, Homo sapiens
  misc_feature: GYAE6OF02GYQ52.29.70.G04.1.454.CMB.1.raw
  modified_base (407)..(407): a, c, t, g, unknown or other
  misc_feature (407)..(407): n is a, c, g, or t
  modified_base (587)..(587): a, c, t, g, unknown or other
  misc_feature (587)..(587): n is a, c, g, or t
  modified_base (598)..(598): a, c, t, g, unknown or other
  misc_feature (598)..(598): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggaggcttggtagaggccggggcagtccctgagactctcgtgtgaaggctcgtggattcgactattcaggtgacgtcttggattggagctggggtcccaccgagacctcccgaaggggtaaggggcctaaggaggttgggttggccgcaagtttacgaagtcgaaggacgggaccaggtacgggaaaagnggactaagtaggtcgtcccccgagaaggggcctaggaactttccgacggtactttttccgacgaagtacgttagacttccgtaggaaacgtaaacgttacccgtagttaatacccttaacgtaattaacgtgtaacgggtcgtccgttaggaccggaacgtacccggaaggtaccaacgnggactaccgtnttaaccgtacgtcggaccgtcgaacgcgttccggacacccgtagcggtacc

SEQ ID NO: 224328 - DNA, 822 bp, Homo sapiens
  misc_feature: GYAE6OF02GYU59.29.70.G04.1.454.CMB.1.raw
  modified_base (761)..(761): a, c, t, g, unknown or other
  misc_feature (761)..(761): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagaggccggggcagtccctgagactctcgtgtgaggctcgtggattcactattcagtgaccgtctgggactggacgtcggtcggggtcccgaccgtaggacccgttacccggaaggggggtaaacgggggccgttaaaggggtaacgggttcggggggtttacggggacccccgggtaactaaacgttttaaacccgaaaggttacccgaaagggggtaacggggaaccccgtaaagggttaaggggggaaaaaacggtacggggtaaaaccttagtaaacggttcccgggtacccccggtacgaaacgggggtccgaacggtaacgtttccgtacggttaactttccgtacggtagtacgttacggtactaccgttaaggaaaacgtaaacgtttacccgttagtaacgtttactaaaccgtagttaagttacggtacggtacgggaccccttagggacccgggtaacggaccccgggtaaagggaaccctaacgggacgggtacctaacgttacccgttaacttaacccggnggttacccggccgtaacgtacggttaccgggttaccaaccccggttagggtacggtaccgg

SEQ ID NO: 224329 - DNA, 446 bp, Homo sapiens
  misc_feature: GYAE6OF02GR5H9.29.70.G04.1.454.CMB.1.raw
  modified_base (276)..(276): a, c, t, g, unknown or other
  misc_feature (276)..(276): n is a, c, g, or t
  modified_base (405)..(405): a, c, t, g, unknown or other
  misc_feature (405)..(405): n is a, c, g, or t
  modified_base (437)..(446): a, c, t, g, unknown or other
  misc_feature (437)..(446): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggcctgcgagccgaggacacaggcatctactactgcgcgacatcggtgacccagtggcagttgttccttgaagactggggccagggaaccccggtnaccgtctccccagccctccaccaagggcccatccggtcttccccctggccgccctgcctccaggagccacctccgagacgcacagccggccctgggcctgcctggtcaaggacttacttccagtacctntatctagagcgggctggacaagggtcacatgnnnnnnnnnn

SEQ ID NO: 224330 - DNA, 578 bp, Homo sapiens
  misc_feature: GYAE6OF02FY4Q4.29.70.G04.1.454.CMB.1.raw
  modified_base (517)..(517): a, c, t, g, unknown or other
  misc_feature (517)..(517): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (536)..(538): a, c, t, g, unknown or other
  misc_feature (536)..(538): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
tcagatagagtactcacgaccggtgctcgatttagtgtagtgtgaagggaaagggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcagtctactactgcgcgacatcggtgacccagtgcagttgttcctgaagctgggccaggaccccggtcaccgtctccccagcctccaccgaaggccccatccggtccttacccccgtggccgcccgtgccttccgaggtaccgccaacccgttccgagacgaccacgaacgccggccctggggacctcgtcccgtgggtaccaaaggggtaccttaacgttcccgaacggttaccttaccttaattacccgtaggaaccggccgggaccgttagggcgtaaacgggccggtaccaaggttacgcgatccgagntacgcgcanacgngcgcannngcgcgagcgagcgancganacgngcgtcgtagncgcgncg

SEQ ID NO: 224331 - DNA, 788 bp, Homo sapiens
  misc_feature: GYAE6OF02JYBD7.29.70.G04.1.454.CMB.1.raw
tcagatagagtactcacgaccggtgctcgatttagtgtagtgtgaagggaaagggctagagtgggttggccgcattacaagtcagagggaccatgggaaagaggactatagtgtccccgtcaagggcagattctcgatttctcgagatgatctgaagaataccgtgtatctactatatgagtggcctgcgagccgaggacacaggcagtctactactgccgcgacagtcggtacgacccaggtcggctaggtttcgttcccttagaacgtacgtggggccgaagggaacccccggttcgaaccgttccgtaccccgacggaccccttccgaacccgaaacggggccccctaacgttccccgggttcccgtttaccccccgtcgggacccctaacccccgttccccgttaacccgtaaacgggaccggtacccgtaaccccgttccgggttaccggggggtacctaaaccgaccggtacccgaaaccggttccccggtacggggtacccgttcccggtcccgttacggggtaacccgtaaaaccggggttaccttaaaccccggtttaccgtaaaccgggtttacccttaacccgttaacgttacccggttacgggtaaccgggtcccgggggtaccgttaccggggtacgttaaaaccggggcccggtaacccgtaaaacggttaggttcccgtacgtacgtacgtacgtacgtacgtacgtacgtacgtacgtacgtacgtacgtacgtcgtacgtaccgtacgtacgtacgtacgtacggtacgta

SEQ ID NO: 224332 - DNA, 814 bp, Homo sapiens
  misc_feature: GYAE6OF02FW156.29.70.G04.1.454.CMB.1.raw
  modified_base (306)..(306): a, c, t, g, unknown or other
  misc_feature (306)..(306): n is a, c, g, or t
tcagatagagtactcacgaccggtgctcgatttagtgtagtgtgaagggaaagggagctctgggagaagagccccagccttgggattcccaagtgctttcattcagtgagcaggactgaacacagaggactcaccatggagtttgggctgaggtggattttgcttgtaccattttaaaaggtgtaccagtgtgcggtgcattgatggagtccgggggagtcgttggtagaggccggggcagtcccgtgacgactctcgttgtagaaggtctcgtggattcgactagtttcgaaggttgaccgttcngggtattaggacgtcgttggggtcccgaccgtaagtaccttccggaagggggtaaacgggccttaagggacggttaggggttacctacggggactttaacgttagggtcggacgtacggtttggggtcgacccgtgttaaaagttacgtaaagtttagtcggaaccttaacggggaacccctacccgggttagggaaaccgggggttcccggtttaacccgaaccgttaacgttttaaccccggaaggtaaccgtaacccgtaaagtttaccggaaaacgtaaccgggtaacgtcccgttaagttacgttacgtacggtaacgtaaaacgttcggaagtacgtacccgtaggtaacgtaccgtacgtaaaccgacggtaccggttacccgttacgttagtttacggttacgttaacgggttaaaccggtccgtaacgggttacgttacgggtaaacggtaaccccggggggttaccccggacccgttaacggttaccggtaaccccgg

SEQ ID NO: 224333 - DNA, 465 bp, Homo sapiens
  misc_feature: GYAE6OF02G7RWE.29.70.G04.1.454.CMB.1.raw
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
  modified_base (433)..(433): a, c, t, g, unknown or other
  misc_feature (433)..(433): n is a, c, g, or t
  modified_base (441)..(465): a, c, t, g, unknown or other
  misc_feature (441)..(465): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtgcctgcgagccgaggacacaggcatctactactgcgcgacatcggtgacccagtggcagttgttcctgaagacgtggggccagggaaccccgtcaccgtctccccagcctccaccagggcccatcgtcttcccctggccnccctgcctccgaggacnccaccgtccgagacgcacgagccggccctgggctcgccgtggtaccaaggactacttccaagttactctatctgacgcgggtctggcaagggcncgatacgnnnnnnnnnnnnnnnnnnnnnnnnn

SEQ ID NO: 224334 - DNA, 495 bp, Homo sapiens
  misc_feature: GYAE6OF02HG0X4.29.70.G04.1.454.CMB.1.raw
  modified_base (330)..(330): a, c, t, g, unknown or other
  misc_feature (330)..(330): n is a, c, g, or t
  modified_base (345)..(345): a, c, t, g, unknown or other
  misc_feature (345)..(345): n is a, c, g, or t
  modified_base (465)..(495): a, c, t, g, unknown or other
  misc_feature (465)..(495): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagccctccaccaagggcccatccggtcctcccccgtggccnccctgcctccagganccacctccgacgagcacagcggcccgtggctcgcctggtacgaaggactacttcccgagtaacctcgtaactctgggtacgcgggtcgtacggcgaaacgggcgtacctagtagcgagcnnnnnnnnnnnnnnnnnnnnnnnnnnnnnnn

SEQ ID NO: 224335 - DNA, 661 bp, Homo sapiens
  misc_feature: GYAE6OF02GMWFO.29.70.G04.1.454.CMB.1.raw
  modified_base (399)..(399): a, c, t, g, unknown or other
  misc_feature (399)..(399): n is a, c, g, or t
  modified_base (613)..(613): a, c, t, g, unknown or other
  misc_feature (613)..(613): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgagggtggattttgcttgttacctaatttttaaaaggtgtccagtgtgcggtgctatttgatggaggtccgggggaggcgttggtaggaggccgggggctacggtcccgtggacgacttctcggtgtggaaggcttcgtggtacttcaacgtattcgaggtcgacgttcgtggtatggacgtcgttcgggcccgtaccgacggtacctaccggaggggaacggggtctaggagggttggggtcggccgntaacgttacaagtcaaggacgggacaggtagggaaagaggtactaagtacgtcggtaccccgtaggaacggcgagtactcgtacgttacgttcgtagtagagtagtatacgtaagaacgtaacgtacgtagtactaactaatatagtacggagttacggccgtggaccgacggtacggaccggaacgcgtacggtctacgtacctaacgttacnccggacgtacccgtagtaccggtacggtaccgaccggaggtacggtcg

SEQ ID NO: 224336 - DNA, 866 bp, Homo sapiens
  misc_feature: GYAE6OF02JOGPV.29.70.G04.1.454.CMB.1.raw
  modified_base (123)..(123): a, c, t, g, unknown or other
  misc_feature (123)..(123): n is a, c, g, or t
tcagatagagtactcacgaccggtgctcgatttagtgtagtgtgaagggaaaggggagctctgggagaagagccccagccttgggattcccaagtgctttcattcagtgagcaggactgaacncagaggacgtacacccaatggtaggttgggtcgtgtagggtaggtagttttgttcgttgtttacccgttaagttttaaaaggttagtccgtagtggttggtcgggtcggtctagttttgttaggtacgggtacggggttaccggggggtaacgggggtacgtttcggggttaggaacggggcccgggggccggtaccgttccgtccggtaaggtccgttccttcggttggtaggtaaacgggcgttaccgttggaacggtttcctaacgtacttacggtacggttaacggcgttaccgttagggtagttacggcggtacgggttccggtaccccggacccaagggaaccccgttacgggaacgggggaaaagggggttccctaaggtaagggggttcggggtttcgggaccccggtcgtaaagttttaacccgaaaggtacgaacggggacgggtaaccggaagttaggggaaaaaggaccggtaagtaacgtttaaccgggttaccggtacccccgggtaaagcggggtaacgacggtacgtacgtaccgttacgttcgtacgtagtagtacgtatccgtaagtacgtaaacgttaacgttacggttacttacgtaacgtacgttaagtacgtaggtaccgtacggtcgtacgggtacggacgtaccggacgaccgtacgtacgactacgtactaccgtcgtacgacgaccgtaggtccggtactcccggtagcggttacgg

SEQ ID NO: 224337 - DNA, 466 bp, Homo sapiens
  misc_feature: GYAE6OF02JT89Q.29.70.G04.1.454.CMB.1.raw
  modified_base (396)..(396): a, c, t, g, unknown or other
  misc_feature (396)..(396): n is a, c, g, or t
  modified_base (431)..(436): a, c, t, g, unknown or other
  misc_feature (431)..(436): n is a, c, g, or t
  modified_base (438)..(466): a, c, t, g, unknown or other
  misc_feature (438)..(466): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagaatctgaagaataccgtgtatctacatatgagtggtctgcgagccgaggacacaggcatctactactgacgcgacatccggtgacccagtggctagttgttccttgaagctggggccagggaaccccgtcaccgtctccccagcctccaccaacgggcccatccgtcttcccctggccgccctgctccagacgcaccgtcgagagcacagccgcctggctgcctgcagctacttcacgtactcatacgngagcggacgtcggacgacggtcgctagtagctagnnnnnncnnnnnnnnnnnnnnnnnnnnnnnnnnnnn

SEQ ID NO: 224338 - DNA, 500 bp, Homo sapiens
  misc_feature: GYAE6OF02F6FFK.29.70.G04.1.454.CMB.1.raw
  modified_base (469)..(469): a, c, t, g, unknown or other
  misc_feature (469)..(469): n is a, c, g, or t
  modified_base (471)..(472): a, c, t, g, unknown or other
  misc_feature (471)..(472): n is a, c, g, or t
  modified_base (474)..(500): a, c, t, g, unknown or other
  misc_feature (474)..(500): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgattttctcgagatgatctgaagaataccgtgtatctacatatgagtggcctgcgagccgaggacacaggcatctactactgcgcgacatcggtgaccccaggtggctagttgttccttggaacgacgtgggggcccaaggggaaccccggtcacccggtcctccccagcctccaccaacgggcccatccggtccttccccctggccgcccctgcctccgagggacgccacctccggagacgccacgacgccggcccgtgggcctgccgtggtacacggtactaccgttccagttactctatcgtgaggcgggcgtggacgaaggcgcatagntnncnnnnnnnnnnnnnnnnnnnnnnnnnnn

SEQ ID NO: 224339 - DNA, 627 bp, Homo sapiens
  misc_feature: GYAE6OF02FXYXN.29.70.G04.1.454.CMB.1.raw
  modified_base (350)..(350): a, c, t, g, unknown or other
  misc_feature (350)..(350): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtgcatttgatggagtccgggggagcttggtagagccggggcagtccctgagactctcgtgtgaaggctcgtggattcacattcagtgacgtctggatgagcgtggggtccgccgagacctccgaggggaaggggctaggaggttgggtgccgnattacaagtcaggaggaccagtagggaaagaggactagtaggtcgtaccccgtacgaagggcagtacttcgtacgtattttccgacgtagtactgattcgtaggaaacgtaacttacccggttagttaacttacctaactaattaagtggtaacggtcgggtaccctggccggtaacggcccggtaaaggaaccgtacgacggactaacgttccgttaaccgtacgtcggaccgtacgaaccgtagtccgggtacgaccccgtagggtcggtaccgg

SEQ ID NO: 224340 - DNA, 863 bp, Homo sapiens
  misc_feature: GYAE6OF02HKUAA.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctggaggtggtattttgcttgttacctaattttaaaaggtgtccagttgtgcggtgctagtttgatggacggtccggggagtcttgggtacgaggccggggcacgtccctgacgacctcgtcgtgtaggacgtctcgtggtacttcactattcgagtgacgttcgtaggtatagtacggtccgtacggggtcccgccgtaacggtaaccgtacccgggtaagggggtacggggtaccgttagggtaacggggttcgggggttacgggtcccggacgttaacttaaccggtaaacggttcggaagggtaaccggggtaaccttaaggggtaaacggggtaaaaccggtacgggttaaaccttaagggttaccgggttaccggtttaccccccgggtaaaggtaaccggggttaccgtaacggttaaccgttttaccgttaccggttaaacgttttcccggtaaccggttaaggtaccgtaacggttaccgttaacggttaaggtaaaacgtaccgttaaccggtttacgtttaaaccgtttaacgttaaccgttaaagttacggtacggtaaccgggttcggtacccgtggtaccggaacggtcccggaacgacgaacggtaccgggtacttaccggttaccttaaccgttaccgtacggtaccgtaccggacgttacggtaccggttaccccggacggttacggtacggttaccg

SEQ ID NO: 224341 - DNA, 630 bp, Homo sapiens
  misc_feature: GYAE6OF02J17HT.29.70.G04.1.454.CMB.1.raw
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
  modified_base (528)..(528): a, c, t, g, unknown or other
  misc_feature (528)..(528): n is a, c, g, or t
  modified_base (541)..(541): a, c, t, g, unknown or other
  misc_feature (541)..(541): n is a, c, g, or t
  modified_base (585)..(585): a, c, t, g, unknown or other
  misc_feature (585)..(585): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagttgggctggaggtggtattttgcttgttacctattttaaaaggtgtccagtgtgcggtgctatttgatggaggtccgggggtagtcttgggtaggacggcccggggctacgttcccgtagacgtacctccgtacggtggtagaacggtcttcgtggaactttcgactattcgagtcgtacgtctggactagcgtcgtcggtccnccgagacgtccggagggagggctaggtaggtgggttcgaccggtntaagttaccgagttcgaaggtacgggtaccaggtagggaaacgtaggtacgtaagtagtccgtacccggagtaaggctaggtacttccgtggttaatttcgacgtagtactcgattccgaaggaaacttacgtcgtntaaacgtctaatntacgtagtcggtacttcgacgcggagtcccgaagccgtacaggnttaccgctactcgcgactgacctcgtccggcacggtagcgtaacg

SEQ ID NO: 224342 - DNA, 692 bp, Homo sapiens
  misc_feature: GYAE6OF02GEVF9.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggatttgcttgtaccatttaaaaggtgtccagtgtgcggtgcatttgatggaggtccgggggagcgttggtagacggccggggcacgtccctagacgactctcgtgtgaaggctcgtggacttcactattcgaagtgtacgtctaggatgagtcgtcgggtcccgccacgaccgtccggaaggggaacggggcgtaggaggttcggggttcggaccggcgtaagttaaccgtaagtaccgaaggtaacgggacccaaggtaaggggaaaaggtacggaaacttagtaacgggtcgttaccccggtaacggaacgggactaacggtacgtttccgtaccgtagttttacgtacggaagtacgtacgtaatccgtagtaaacgtaaacttaccgttagtacgtactaatacttagtagtacggtcggacgttacggacgtaccggaccggacgaaccgaaccgcgaaccgtacgtactaacctacgtacgaccgaccggactaccggttaccggtaccggaccgttaggcgttaaccgg

SEQ ID NO: 224343 - DNA, 605 bp, Homo sapiens
  misc_feature: GYAE6OF02IEZFZ.29.70.G04.1.454.CMB.1.raw
  modified_base (159)..(159): a, c, t, g, unknown or other
  misc_feature (159)..(159): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
  modified_base (483)..(483): a, c, t, g, unknown or other
  misc_feature (483)..(483): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (540)..(541): a, c, t, g, unknown or other
  misc_feature (540)..(541): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (572)..(572): a, c, t, g, unknown or other
  misc_feature (572)..(572): n is a, c, g, or t
  modified_base (596)..(596): a, c, t, g, unknown or other
  misc_feature (596)..(596): n is a, c, g, or t
tcagatagagtactcacgaccggtgctcgatttagtgtagtgtgaagggaaagggctagagtgggttggcgcatacaagtcagaggaccatgggaaacgaggactatagtgtccccgacaaggcagatttctcggattttctacgagaattgaactcgngaagaaattccgttggaatctacattagtcgagcggcctgacgagccgaagacacaggcaattcactactgcgcgactatccggnaaccagtcgganaggttgttcctanaagtaccgtgggccgagggaaccccggtnaccggcgtacccaggcctccaacgaaacggtcccaatccggtccttacccgtcgccgtccccancccgtacaaggcgtaccgcctacggacacggcctacaacgtcggccgccgggtcacggtacctcggacgaaacgaccgttaaacccgttcgacgtaacctcgaacgttcaacgggttacgngggccgttggaccgaacgggtacgttacggaaattcggacganttagnacacgaganncgancacanagcgagacgacgtacgacgacngacgacgtacgacgtacgagatanacgacagac

SEQ ID NO: 224344 - DNA, 824 bp, Homo sapiens
  misc_feature: GYAE6OF02GGOB2.29.70.G04.1.454.CMB.1.raw
tcagatagagtactcacgaccggtgctcgatttagtgtagtgtgaagggaaaggggagctctgggagaagagccccagccttgggattcccaagtgctttcattcagtgagcaggactgaacacagaggactcaccagtggtagtttgggctggaggtggtattttgcttgttaacctaagttttaaaaggtgtcctagtgtgcggtgctatttgagtgggagggtccgggggagtcgttgggtaggacggccgggggacacggtcccgtaggacgtacctccgttcggtggtaggaacggtctacgttggtactttaccgaacttagttactacggttaggtaccgttcggtagggagtacggtacggtccggttaccggggtcccgaccgtaccggtaacccgtaccggggaaaggggggtaacgggtacgttaagggtacggggtttcgggggttccggaccccggtataacgttaaacggaacggttaccggaaggggaaccgggtaaccggtaagggtaaggggaaaaacggtaggtaacgttaacggttaacggttcccgggttaccccggtaggaaacgggtactagttaacgtttacccgtaggtttactttcgacggtaagtacgtacgtaacgtcgtaaaggtaaacgtaacgttacggttacgttaactacctaacgtaagttacggtacggtcggtcggtccgtacggacgacggacccggaagaccgtaacgagtctaaccgttaacctaccgtaccgtcggaaccgcgtaaccgttggtacccggttaccacgggttaggccggttaacg

SEQ ID NO: 224345 - DNA, 720 bp, Homo sapiens
  misc_feature: GYAE6OF02GN9ZG.29.70.G04.1.454.CMB.1.raw
  modified_base (184)..(184): a, c, t, g, unknown or other
  misc_feature (184)..(184): n is a, c, g, or t
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggngtccagtgtgcggtgcattgatggngtcgggggagcttggtagagccggggcagtcccngacgacctctcgtgtggaaggccttcgtggtattcactagttcaggtgacgtcgtggattggagtcgtacgggttcccgacaacggaccgtccggaagggggaacgggggtcctaagggagggttacggggttcgggaccgaccgtaagttaacgaacggttaccgaagggtaacgggaccctaaggtacgggggaaaaagtacgggtaacttaagtacggtaccggttacccccggtagtaaacgggggctaacggtacgtttcgtacgggttaacttttccgacggtaatacggtagtactacgtaaggaaactacgttaccgttagtaacttacgtaaccttagtaagtcggtacgttacgggccttaggaccgaggacccggaggaccctacgggagtcctaagttccctaactcgtaccgtccgggactacgtacgttacccggggtaccaacccggttagtccggttaccg

SEQ ID NO: 224346 - DNA, 691 bp, Homo sapiens
  misc_feature: GYAE6OF02H9WW6.29.70.G04.1.454.CMB.1.raw
  modified_base (199)..(199): a, c, t, g, unknown or other
  misc_feature (199)..(199): n is a, c, g, or t
  modified_base (441)..(441): a, c, t, g, unknown or other
  misc_feature (441)..(441): n is a, c, g, or t
  modified_base (500)..(500): a, c, t, g, unknown or other
  misc_feature (500)..(500): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgttaccattttaaaaggtgtccagtgtgcggtncatttgagtgggagtccgggggaggtcgttgggtagaggccggggcacgtcccgtgacgacgtcgtcggtgtgaaggctcgtaggtatttcaactagttcgaggtcgtacgttcgtaggatgagtccgtgggtcccgacgagaccgtcggagggacgggctaggaggtgggttcggccgatagttacgaagtcgagacggacagagggaaagagctatacgtcgtacccgagaacggcagtnttacgtacgtactttcgagtatcgtagtactacgtaagaacgttacttacggtacttanacctaacgtagttagtaggtagttccgggacttcgggaccggtaacgacccggtaacggaaccgtaccggtaggtcccttaacgttccttaaacccggttcgtaacccggggtacccgtaacccgggtaacgtaccggttacccgggggttaacccgtaaccccgggttagggttaccggttaacccgggg

SEQ ID NO: 224347 - DNA, 612 bp, Homo sapiens
  misc_feature: GYAE6OF02HX2KL.29.70.G04.1.454.CMB.1.raw
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (576)..(576): a, c, t, g, unknown or other
  misc_feature (576)..(576): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtgcctgcgagccgaggacacaggcatctactactgcgcgacatcggtgacccagtgcagttcgttccttgagacgtggggccagggaccccgtcaccgtcctccccagcctccaccgaaggcccagtccggtccttcccccgtggcctccctgaccgtccgaggagccaccctccgacgacgccacgtacggccggcccgtggggcctacggcccgttcggggtaaccaaacgggtaacccttaccgtttacccgacggtttaacctccgttaacgttccttacggacgggtcccggggtccttaggggaccgaaacgggtccgtacgtaaacgttaacggcgacgtgcgacgacgacgagacgcgcgcgtcgacgcgacgcncntcgagagtcncgcgtcgacgacgtcgtacgacgacgactagacgac

SEQ ID NO: 224348 - DNA, 598 bp, Homo sapiens
  misc_feature: GYAE6OF02GP1YG.29.70.G04.1.454.CMB.1.raw
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgatggcctgcgagccgaggacacaggcatcctactactgcgcgacatcggtnacccagtcggcagttgttccttgaagactcggggccagggacccccgtnacccgtcgtccccagccctccaccaacgggcccatcggtaccttcccccgtaggccgccctggcctccgaggtacgcctaccgtccgagacgccgtacacggccggaccccttgggggaccctcggcccgttagggttacccaaacggggtaccttacccgtttacccaacgttacccgttacttactccgtttcggaacggtcccggggccttacggggaccaaacggggtccacgtaagttaacggcnganccggtanacgtacngctagatgcgtgcncnncgcacncncgctcnctcncgncgcnccncacntnc

SEQ ID NO: 224349 - DNA, 918 bp, Homo sapiens
  misc_feature: GYAE6OF02GXP55.29.70.G04.1.454.CMB.1.raw
  modified_base (724)..(724): a, c, t, g, unknown or other
  misc_feature (724)..(724): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggtattttgcttgttactagttttaaaagtgtccagtgtgcgtgctattgagtggaggtccgggggaggtcgttgggtacggagggcccgggggcgtacggttcccgtaggacgtaccttcctcggtggtaggaacggtcgttccgtggtactttccaactacgtttctaaggttgtaccgttcgtagggtactggtacggtccggttcggggttaccccggacccgtaaccggtacccggttacccgggaagggggggtaaaacgggggtcccggttaaagggtacgggtttcggggggttccgggtaccccggtacggttaaaacccgttttaacggtaaacggttaccgggaaacggggtaacgggggtaaccctaaagggttaacgggggaaaaaggtaacgggtaaacgttaacggtttaacgggttcccggttacccccggtaacgggtaaaccggggtacgtaaacggttacgttttcccggtacggtttaacgttttaccggtacgtaacggttacgttaacgagttaaccgaagggttaaaaccgtaaagttaccggttnttaacttacgttaaccttaagttaggttaacggtcggttaccgggtacgtcggtaaaccgggtccggaccggtaaacggacccgaacgtaggacccttaacgtacccgttaaccgttaccgttggacccggtaaccgttaaccggcggttacccgggtacccggtaaacccggtcgggttaccgggttaaccgg

SEQ ID NO: 224350 - DNA, 613 bp, Homo sapiens
  misc_feature: GYAE6OF02GAYF7.29.70.G04.1.454.CMB.1.raw
  modified_base (253)..(253): a, c, t, g, unknown or other
  misc_feature (253)..(253): n is a, c, g, or t
  modified_base (580)..(580): a, c, t, g, unknown or other
  misc_feature (580)..(580): n is a, c, g, or t
  modified_base (582)..(583): a, c, t, g, unknown or other
  misc_feature (582)..(583): n is a, c, g, or t
  modified_base (585)..(613): a, c, t, g, unknown or other
  misc_feature (585)..(613): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacattatgagttggcctgcgagccgaggacacaggcatctactaactgcgcgacatcggtcgacccagttcggcaggtttnttccttgaagtactacggggtccgagggtaacccccggtctaacccggtctcccccgtaaggccccttcccgaaccctaacggggccccgacgttacccggttccgttcccccccctgggccgtccccccgttagcccgttccaccgggacgcccaccccgtccgacgacgccgacaccgggtcgcccgtcggggtctcgccgtcgggacgaaaccggaccgtttaacccgttccaacggttaacctttcccggttaaacttccacgggttaaccggtccggggtcgtcgggtaccggaaaacgggcgaccggttaacaggactcgncnncnnnnnnnnnnnnnnnnnnnnnnnnnnnnn

SEQ ID NO: 224351 - DNA, 587 bp, Homo sapiens
  misc_feature: GYAE6OF02HRUTO.29.70.G04.1.454.CMB.1.raw
  modified_base (145)..(145): a, c, t, g, unknown or other
  misc_feature (145)..(145): n is a, c, g, or t
  modified_base (234)..(234): a, c, t, g, unknown or other
  misc_feature (234)..(234): n is a, c, g, or t
  modified_base (361)..(361): a, c, t, g, unknown or other
  misc_feature (361)..(361): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
  modified_base (537)..(537): a, c, t, g, unknown or other
  misc_feature (537)..(537): n is a, c, g, or t
  modified_base (557)..(557): a, c, t, g, unknown or other
  misc_feature (557)..(557): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtacaagggcagattctcgattttcncgagatgatctgaagaataccgtgtatctacatatgagtggcctgcgagccgaggacacgaggcatctactactgcgcgacatccggtnacccagtggcagttcgttcctgaagacgtgggccacgggaccccggtcacccgtctccccgagcctacccaccaacggtcccaatccggtccttcccccgtaggccgccctcgctccgaggacgccnccgtaccgagacgcgaacacgggccggcccgtaggggcctacggtccgtaggtaccgaacggtaccttaccctccgtaacgttacctctaacgtcgttaggacgtcgggacctgggaccgaaggcgacaaggttacgnaganctangtagtaccgntacgatacgctagacgctanagcgactgccgactggaacnccgttgaccattccggaantacncgactcg

SEQ ID NO: 224352 - DNA, 735 bp, Homo sapiens
  misc_feature: GYAE6OF02JV4SS.29.70.G04.1.454.CMB.1.raw
  modified_base (144)..(144): a, c, t, g, unknown or other
  misc_feature (144)..(144): n is a, c, g, or t
  modified_base (201)..(201): a, c, t, g, unknown or other
  misc_feature (201)..(201): n is a, c, g, or t
tcagatagagtactcacgaccggtgctcgatttagtgtagtgtgaagggaaaggggagctctgggagaagacgccccagccttgggattcccaagtgctttcattcagtgagcaggactgaacacagaggactcaccagtaggngtttgggctggaggtgtatttgcttgtacctagtttaaaggtgtctagtgtgcggtnctattgagtcggagtccgggggagtcgttggtagacgccggcgtacggtcccgttgacgtcgtacgtcggtggtgaagcgttcgtgtagttcgtactattcgtagtcgtaccgtcgtaggtacgtggtacgtcggtcgggtccctccgtaacgacgttaccggagggagggtacgtaggtacgggttgggtcgggtccgtagtaacgtaacgtacggtcgtaagggacgtaacggtaaggtaacgggtaaaacgaggttaacgtaacggttcgtacccgttacccggtaggaacgggtaaccaggttacgtccgttaacgttacgttaccggtacgaagtacgtagtaaccgttaagacgtaacgttaacgaggttaccgttaactaccgtaacgtaattagtacggtacgttaccgcgggtagtaacccggtagtacccggaaacgtaccggactaacggtcctacgtaaccgtacttacgggtccaccggtagtacctacggtccgttacccggtacgtaggtaccgtacgg

SEQ ID NO: 224353 - DNA, 756 bp, Homo sapiens
  misc_feature: GYAE6OF02GGVUZ.29.70.G04.1.454.CMB.1.raw
  modified_base (254)..(254): a, c, t, g, unknown or other
  misc_feature (254)..(254): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggagtttgggctgaggtggattttgcttgtacctattttaaaggtgtaccagtgtgcggtgcatttgatgggaggtaccgggggaggcgtttggtagaggccggggcagtccccgngagacctctcgtgtgaacggctctggacttcgactattcaggttgaaccgtctgggatggaagtccgtcggggttccccacgacgtacccggtcccggaagggggtaacggggtcttaaagggcgggttgggggtttcggaccccggtactaacgtttaaaccgtaacggttacaaggggaaccggggtaacctaaggtaacggggaaaaaggtcggtaaacgtttagaacggtttccggtaccccggtaggaacgggtctaacggtactttccgttcgttaattttccggaccgtagttacgtcgtacgttaccgtaggtaaacgtacgttaccggttagtaattaccctagaacgtttagtacggtacggttaccggaccgtgacccggtacgacccggtacgggtaacccaggtacggaccttaacgttccgttaaccgacgttacgacccggttcggaacttccggtccgtacccggacccttagggtcgttaaccgg

SEQ ID NO: 224354 - DNA, 769 bp, Homo sapiens
  misc_feature: GYAE6OF02IJQ5W.29.70.G04.1.454.CMB.1.raw
  modified_base (163)..(163): a, c, t, g, unknown or other
  misc_feature (163)..(163): n is a, c, g, or t
  modified_base (744)..(744): a, c, t, g, unknown or other
  misc_feature (744)..(744): n is a, c, g, or t
tcagatagagtactcacgaccggtgctcgatttagtgtagtgtgaaggggaaaggggagctctgggagaagagccccagccttgggattcccaagtgctttcattcagtgagcaggactgaacacagagactcaccatggaggtttgggcgtggaggtaggtntttttgtctttgttaaccttaaattttaaaaggtcgttccgtagttgtgtcggtgctagtttgagtgggacgggtccggggggtaggtcgtttgggtaaggacgggcccggggacgtacggtcccgtggacgtaccgttccgtcggtaggtggtaaggtcttccggtggtacttcaaacctatttcgaggttgtaccgtgttggaacgtggacggtcggtccgggtccccgaccgagtacccgtacgggaaggggaacggggtcgtaaggtaggggttgggttaccgggcccgtagttaacttaacggaagtacgaaggggaacgggaactaggggtaacgggaaagtacgggtaactaagttacggttaccggaccccggtaaggacgggtacgtaaggtactttcgtaccgtacttttacgacgtaagtaggtaacgtacgttacgtaaaggaaacgttaacgtaaccggttaagttactaaccgttaataacgttagttacggtaggttccggtcgtacggtacgacggtacggacgaacgacgagacgtacgtacgtactacgtacgcgtacgacgngtaccggcggtacgacgtcgtacgg

SEQ ID NO: 224355 - DNA, 795 bp, Homo sapiens
  misc_feature: GYAE6OF02JSDIR.29.70.G04.1.454.CMB.1.raw
  modified_base (201)..(201): a, c, t, g, unknown or other
  misc_feature (201)..(201): n is a, c, g, or t
tcagatagagtactcacgaccggtgctcgatttagtgtagtgtgaagggaaaggggagctctggagaagagccccagccttgggattcccaagtgctttcattcagtgagcaggactgaacacagaggactcaccatggagtttgggctggaggtggtattttgcttgttacctatttaaaggtgtcctagtgtgcggtgntattgtagtgggagtccgggggaggcgttaggtaggaggtccggggtcgacggtcccgtagaggtacctcgtcgtcgtgaacggtctcgtaggcttcacgtattcgtacgtgaccggttcgtggtagtggacgtcggttcgggcccgtccggagtacccgtaccgggaacgggggtaacggggtcgtaacgggtaggggttacggggggttcgggtacccccggagttacgtttaaaaccggaacggttcgggaaacggggtaaacggggacccgttaacgggtaagggggaaaaacgtcggtaaaccgttaagttacggggtacccggttacccccgggtaacggtaaccgggggactaacggggttactacggttcgttaccgtttaccggtacgtaggtacgtacgtaacttaccggagtaaacgttaacggttacgttacggttactacctagtacgttaacgtggttaacggtcggtacgtacggccgtacggaccggttaggaccgagtaccgggactaacgttcggttaactaggccgaccggtacaccggtgtaacccgggtacgcccggttacggcgtttaacgg

SEQ ID NO: 224356 - DNA, 715 bp, Homo sapiens
  misc_feature: GYAE6OF02JJ0BV.29.70.G04.1.454.CMB.1.raw
  modified_base (121)..(121): a, c, t, g, unknown or other
  misc_feature (121)..(121): n is a, c, g, or t
  modified_base (212)..(212): a, c, t, g, unknown or other
  misc_feature (212)..(212): n is a, c, g, or t
  modified_base (612)..(612): a, c, t, g, unknown or other
  misc_feature (612)..(612): n is a, c, g, or t
  modified_base (630)..(630): a, c, t, g, unknown or other
  misc_feature (630)..(630): n is a, c, g, or t
  modified_base (639)..(639): a, c, t, g, unknown or other
  misc_feature (639)..(639): n is a, c, g, or t
  modified_base (649)..(649): a, c, t, g, unknown or other
  misc_feature (649)..(649): n is a, c, g, or t
  modified_base (684)..(684): a, c, t, g, unknown or other
  misc_feature (684)..(684): n is a, c, g, or t
tcagatagagtactcacgaccggtgctcgatttagtgtagtgtgaagggaaagggctagagtgggttggccgcattacaagtcagagggaccatgggaaagaggactatagtgtccccgtnaagggcagattctcgatttctcgagaatctagaagaactaccgtgtatctacatatgagtcggcctgacgagccgagacacaggcatctanactgcgcgacagtcgtgaaccctgtggctagttcgttccgtaggaaacgaccgtggggaccgaacgggaaccccggtcacccggtcctaccccgacgccccttacccgaccgtaacgggacccctacgtaccgttccttacccccgtcggaccgtcccgtacaccgtccgacgggaactcccgtaaccctcgtaacggtaccgacgaaccgtacggacccggttacccggtaccgggccgtaccggtaccccggttgggtaaccctaaacgggtaccgtttaaacccgttacccgtaaccggtttaaccctttacgtaaccgtttaacgaccggttaacgggtccgggtaaccccgtagggtaccggtaacgggaacccggtacgtaaaccggtcggtanacgtcgacgcgtcgaccngacgcgtanacgacgtacncgtcgtcgtactacgacgtccgtcgcgacgcgcgngatgagtcgacgacgtatacgtcgtacacgg

SEQ ID NO: 224357 - DNA, 686 bp, Homo sapiens
  misc_feature: GYAE6OF02I5DAN.29.70.G04.1.454.CMB.1.raw
  modified_base (102)..(102): a, c, t, g, unknown or other
  misc_feature (102)..(102): n is a, c, g, or t
  modified_base (144)..(144): a, c, t, g, unknown or other
  misc_feature (144)..(144): n is a, c, g, or t
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
  modified_base (606)..(606): a, c, t, g, unknown or other
  misc_feature (606)..(606): n is a, c, g, or t
  modified_base (616)..(616): a, c, t, g, unknown or other
  misc_feature (616)..(616): n is a, c, g, or t
  modified_base (623)..(623): a, c, t, g, unknown or other
  misc_feature (623)..(623): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
  modified_base (643)..(643): a, c, t, g, unknown or other
  misc_feature (643)..(643): n is a, c, g, or t
  modified_base (646)..(647): a, c, t, g, unknown or other
  misc_feature (646)..(647): n is a, c, g, or t
  modified_base (657)..(657): a, c, t, g, unknown or other
  misc_feature (657)..(657): n is a, c, g, or t
  modified_base (664)..(664): a, c, t, g, unknown or other
  misc_feature (664)..(664): n is a, c, g, or t
  modified_base (671)..(671): a, c, t, g, unknown or other
  misc_feature (671)..(671): n is a, c, g, or t
  modified_base (684)..(684): a, c, t, g, unknown or other
  misc_feature (684)..(684): n is a, c, g, or t
tcagatagagtactcacgaccggtgctcgatttagtgtagtgtgaagggaaaggggctagagtgggttggccgcattacaagtcagagggaccatgggaaanaggactatagtgtccccgtcaagggcagattctcgattttcncgagaatctgaagaataccgtgtatctacatagtgagtggcctgcgacgccgaggacacgaggcatctactactgcgcgacngtcggtcacccgagtcgctagttcgttccgttagaacgacgtcggggaccgaccgggtaaccccggtaccncccgttcctaccccgagcccctacccaaccgaaccgggcccctaaggtccccggttaccctttccccccggtacggcccgtaccccgtcggtaccgtacccggaagggaccaccccgacccgtccggaacggaccgcgacgaaccggtccccgggaccggttcgggtaccgtccggtcccgttacggggttaaccaaacgggttccctttaacccggttacccgtaagttaccctttacgtaacgttccgtgggaaccgggtccgggtccggtaggaccggtaaccgggacgtaccgaagttcgagtcncgtgactcgnagacgtntgngncgacgtcgtagtagngannagtcgtacgncgtctcngtcgacncgcgagacgtcgntg

SEQ ID NO: 224358 - DNA, 683 bp, Homo sapiens
  misc_feature: GYAE6OF02GH3IL.29.70.G04.1.454.CMB.1.raw
  modified_base (255)..(255): a, c, t, g, unknown or other
  misc_feature (255)..(255): n is a, c, g, or t
  modified_base (590)..(590): a, c, t, g, unknown or other
  misc_feature (590)..(590): n is a, c, g, or t
  modified_base (601)..(601): a, c, t, g, unknown or other
  misc_feature (601)..(601): n is a, c, g, or t
  modified_base (619)..(619): a, c, t, g, unknown or other
  misc_feature (619)..(619): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgattttctcgagatgatctgaagaattaccgtgtatctacatatgagtggcctgcgagccgaggacacgaggcatctactactgcgcgactatcggtacacccaggtggacctagtttnttaccttgaagtacgtcggggccgaacgggaccccggtcaccgtccgtccccagccctacccaaccgtaaacgggcccctaagtccggtacccttccccccgtaggcccgacccccgtggaccctaccgaagggacgacctaacccgtccgaagacgccaacgacggtcccggaccccgttggggacctttcgggacccttacggggtaaccgtaaacggggtaaccctttaaccctttacccgaaacggtttaaccgtacgtaaccgttcgttacgaaccggggtcggggtccgttacgggtaaccaaaggggtcccaaccgtaagttaacggngacgcgtacgnacgtagtcgactagacgnacgacagagacgtatagtacgtacacgacacactctagacgacgtacgtacacgacacgagacg

SEQ ID NO: 224359 - DNA, 708 bp, Homo sapiens
  misc_feature: GYAE6OF02G2RG3.29.70.G04.1.454.CMB.1.raw
  modified_base (574)..(574): a, c, t, g, unknown or other
  misc_feature (574)..(574): n is a, c, g, or t
tcagatagagtactcacgaccggtgctcgatttagtgtagtgtgaagggaaaggggagctctgggagaagagccccagccttgggattcccaagtgctttcattcagtgagcaggactgaacacagaggactcaccatggaggtttgggctgaggtggtattttgcttgttacctaagttttaaaaggtgtaccagttgtgcggtgctatttgatggaggtccgggggaggtcgttgggtagacgggcccgggggacctacggtcccctaggacgtaccgttcgtcggttggttaggaacggtcgtacgtggtattccactacttcagtcgacgttcgtaggatagacgtcggtccgggtcccgtcgaacgccgtaccggaaggggacgggattagggacggttggggtacggccgatacttaacgaacgtgacggaacgggaccgaaggtagggaaaacggtacggtaacttacggttaccggtaccggtaccccggtaaggaagggacctaagtaccgtttactaggtacttttcgagtactagtctacgtataagaacgtaagttaccgtnttaactaccttaatagttagtacgtagtcgtaccgagaccgtaacggccgaaagccgaacggctaacctaagttcccgtaagttacgccggtccgaacgtcttagggccgttaccgaacggttcgtacgtaccg

SEQ ID NO: 224360 - DNA, 918 bp, Homo sapiens
  misc_feature: GYAE6OF02G4KQ2.29.70.G04.1.454.CMB.1.raw
  modified_base (191)..(191): a, c, t, g, unknown or other
  misc_feature (191)..(191): n is a, c, g, or t
  modified_base (362)..(362): a, c, t, g, unknown or other
  misc_feature (362)..(362): n is a, c, g, or t
tcagatagagtactcacgaccggtgctcgatttagtgtagtgtgaagggaaagggggagctctgggagaagagccccagccttgggattcccaagtgctttcattcagtgagcaggactgaacacgagaggactcaccatggagtttgggctggaggtggtattttgcttgttacctaagtttaaaaggtntccagtgtgcggtgctatttgagtgggaggtccgggggaggtcgttggtaggacggcccggggacacggtccctggacgtaccttctcggtggtaggaacggtctcgtggtacttcaatacttcgtaggtcgtcggttcgtagggataggacggtcggtccggggtacccnccgaaccggacgtccgggaagggggaacggggtaccgtagggtacggggttacgggggttcggacccgtagtaaccgttaacgtaacggttacggaacggggtaacgggtaaccgtaaagggtaacgggggtaaaacggaagggttaaacgttaacgtttaacgggttaccccggtaccccgggtaacgggaacggggtaccgtaacggttaacgttttacccgttaccggttttaaccgttttccggttaaccggttaacggttaacgtacggttaaacggtttaccgtaaacggttaaaaacgttaacccggtttaacccgttaaggtttaaccctaaccgttttaaaacgagtttaacggttacgggtacgggttaccggttacccggtacggtaacccggtacggggaacccggtaaacgggtacccgaacgggaccggttaacgtacctttaacccgggtaccttaaccggtaccggtacccggtaaccggtaccggtaccgggtacccgggtaaccccgggtaacccggttaccgggtacccggttacgg

SEQ ID NO: 224361 - DNA, 706 bp, Homo sapiens
  misc_feature: GYAE6OF02HD051.29.70.G04.1.454.CMB.1.raw
  modified_base (285)..(285): a, c, t, g, unknown or other
  misc_feature (285)..(285): n is a, c, g, or t
  modified_base (606)..(606): a, c, t, g, unknown or other
  misc_feature (606)..(606): n is a, c, g, or t
  modified_base (670)..(670): a, c, t, g, unknown or other
  misc_feature (670)..(670): n is a, c, g, or t
tcagatagagtactcacgaccggtgctcgatttagtgtagtgtgaagggaaaggggagctctgggagaagacgcccagccttgggattcccaagtgctttcattcagtgagcaggactgaacacagaggactcacagtggtagtttgggcgtgaggtggtattttgcttcgttacctaagttttaaaggtgtcagtgtgcggtgctagtttgagtggacggtccgggggaggtcgttggtaggaggccggggacgtacgtcccgtagacggtactcgtcggtggnggaacggtctcgtggtatcgatattcagtcgacgtgtggtatggacgtcgttcgggtcccgccgacggtaccgtacggaaggggacggggtacgttaaggtagggttcggggtacggtacccggtacgtaacgttaacgaagtccgaaagggtacgggaaccgtaggtaagggaaacggaggtaactaacggttacggtaccggtaccccggtaaggaacgggacgaaggttacttaccgtaacgtttacgttttacgtacggagtagtcgtagtacgtaaggtaacgtaagttaccggttatactacgtagtacttaagnggtacgtacgtccgtacggagaccggacggtagaccgaagtccgtaactcgtacgtactacggngaccgtacgacgtcgtcggacctcgaggtcgtacgg

SEQ ID NO: 224362 - DNA, 593 bp, Homo sapiens
  misc_feature: GYAE6OF02F693R.29.70.G04.1.454.CMB.1.raw
  modified_base (556)..(556): a, c, t, g, unknown or other
  misc_feature (556)..(556): n is a, c, g, or t
  modified_base (560)..(561): a, c, t, g, unknown or other
  misc_feature (560)..(561): n is a, c, g, or t
  modified_base (563)..(593): a, c, t, g, unknown or other
  misc_feature (563)..(593): n is a, c, g, or t
tcagatagagtactcacgaccggtgctcgatttagtgtagtgtgaagggaaaggggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtcacccagtggctaggtttgttccttagaagcgtcggggccgacggggaaccccggtcgtacccgtcctcccccacgccctcccaccgaacgggcccctacgtccggttcccgttccccccgtcggcccgtccccgtcgccctccggacggacgtcccacccgtaccgaacgacgccaaccgaccggccggtccccggtgggtcccgtcggtcccggttcgggtaccgtaaacgggtacccttaccgttttacccgagttaccttacgttaactacccgtgggaccggtccggggtcgtcgggaacggtaacggccgacgaacgtcgnacgnncnnnnnnnnnnnnnnnnnnnnnnnnnnnnnnn

SEQ ID NO: 224363 - DNA, 479 bp, Homo sapiens
  misc_feature: GYAE6OF01DEMS2.13.60.F05.1.454.CMB.1.raw
  modified_base (462)..(479): a, c, t, g, unknown or other
  misc_feature (462)..(479): n is a, c, g, or t
tcagtcacgtactacacgaccggtgctcgatttagtacgtcatcagggaaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattatgtgcgagacggcaaatatggttcagggagttcgactacgtggggccaaggggaaccctggtcaccgtctcctcagccctccaccaagggcccatcggtccttccccctggccacccctcctccaaagacgccacccgtcgtcggggggccacgacgccgggcccctcggggcctggcccgtggtccgaaaggaccttaaccttcccgtaggtacgtgacgtgacggcggggctgggacaagggccgactaacgtagnnnnnnnnnnnnnnnnnn

SEQ ID NO: 224364 - DNA, 476 bp, Homo sapiens
  misc_feature: GYAE6OF02G5VK0.13.60.F05.1.454.CMB.1.raw
  modified_base (113)..(113): a, c, t, g, unknown or other
  misc_feature (113)..(113): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (435)..(439): a, c, t, g, unknown or other
  misc_feature (435)..(439): n is a, c, g, or t
  modified_base (441)..(476): a, c, t, g, unknown or other
  misc_feature (441)..(476): n is a, c, g, or t
tcagtcacgtactacacgaccggtgctcgatttagtacgtcatcagggaaaggggctggagtggattgggggatatctcttatagtgggagtacgaactacaatccgtccctnaagagtcgagtcatcatatccgtagacaggtccaggaacgaattctccctgaaagtgagttctgtgaccgtgcagacacggctgtctattatgtgcgagacggcaaatntggttcagggnttcgactacgtggggaccagggaacccctggtcaccgttctctcacgccaccaccgacggccacgtccgtcctcccgtcgccaccctcctaccacgacgcctaccgtcggtcgggcacgacgccggccgtcggcgtcgccgtgtacgacgtactcgtcgtagtacgtcgacgtgagcggcgtcgacgacggcgacgagtagnnnnncnnnnnnnnnnnnnnnnnnnnnnnnnnnnnnnnnnnn

SEQ ID NO: 224365 - DNA, 491 bp, Homo sapiens
  misc_feature: GYAE6OF01C9L7B.10.1.A01.1.454.CMB.1.raw
  modified_base (337)..(337): a, c, t, g, unknown or other
  misc_feature (337)..(337): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccacctcccaagctcctctccgacaggaataacatccggccctcagggatctcagagagattcnctgcatccaggtcaggagcacagcctccctgacccattactgactccagctgacgacgaagctgatttatactgctcagcagtgggaccaccggcctcagtgtcggtgggtttcggcgggacgggaccgaagtctagacccgtctggtcaccgg

SEQ ID NO: 224366 - DNA, 494 bp, Homo sapiens
  misc_feature: GYAE6OF01A7HCK.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagcctcctctccgacaggaataacatccggccctcagggatctcagagagattctctgcatccaggtcaggaagcacagcctccctgaccattactgactccaggctgacgacgaagctgattattactgctcagcagtggacaccggcctcgagtcggcgtgggtttcggcggacgggaccacgcgtcgaccgtcctaggtcgtaccgg

SEQ ID NO: 224367 - DNA, 654 bp, Homo sapiens
  misc_feature: GYAE6OF01DAV78.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgcacactcacctgcactggaacaacaacaatgtgccacgacggagtcgttggctgcagcagcaccacgggccaccctccaacgcctcctctccgaacaggaactaacactccggaccctacgacgggactccgtacgagaagacgtacttcgtctgactacttccgaaggttcaagggaacgccaacgacggccctacccgtacggaaccctactttaaccgtacggtaacccgttacccgagggccttacggaaccggtaaccgtaaacggtcgttacgtaacgttttaacgttaaccttcgaccgttacgtaacggtacgtaacgttcggggaacctacccgggtccctacgacgggttcggtcgggtttacggggttttccgggacgggtaacggggtaaccaacgggtccgttaacggaccccgggttaccgtacgggtcccgtaacccggg

SEQ ID NO: 224368 - DNA, 723 bp, Homo sapiens
  misc_feature: GYAE6OF01EFTCW.10.1.A01.1.454.CMB.1.raw
tcagcatagtagtgcacgaccggtgctcgatttagacgtctcatcgagggggctccaaacagagcttcagcaagcatagtgggaatctgcaccatgccctgggctctgctcctcctgaccctcctcactcactctgcagtgtccagtggtccaggcagggctgactcagccaccctcggtatccaaggaccttgagacagaccgccacactccacctgcactgggaacaacaacaatgttgccacgacggagtcgttggctgcacgacagcaccagggccaccctcccaacgcctccctcctccggacacggaactaaccactcccggccctacgacggggtactccgtacagacgacgactttcctcctcgaccacgtccgacggttacgaacgggtaacgaccgaacgtacggaccccgtacccgtacggtaaccctaacgtttaaccgtacggtaacccttcccgaagggtcctacggtaaccgaaccggtaaacgtaccgttagtaacgtttaactttaaccgtacgtaccgttacgtaacggtaccgtaacggtaccggggtaccgacccgggtacccgttaccggtaacggggttccgggtaccgggtttacgggggttttacccggggaccggggtaaccggggtaacccgaaacgggtcccgttaacgggtacccccgggtttaccggttaaccgggttcccggtaaaccccggg

SEQ ID NO: 224369 - DNA, 491 bp, Homo sapiens
  misc_feature: GYAE6OF01AXX0Z.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagcctcctctccgacaggaataacatccggccctcagggatctcagagagattctctgcatccaggtcaggagcacagcctccctgacccattactgactccagctgacgacgaagctgattatactgctcagcagtgggacaccggcctcgagtcgcggttgggtttcggcggagggaccaagcgtagaccgtccgtggtcgacgg

SEQ ID NO: 224370 - DNA, 481 bp, Homo sapiens
  misc_feature: GYAE6OF01A9G7B.10.1.A01.1.454.CMB.1.raw
  modified_base (357)..(357): a, c, t, g, unknown or other
  misc_feature (357)..(357): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggactctcagagagattctctgcatccaggtcaggancacagcctccctgacccattactggactccaggctgacgacgagctgattnttactgctcagcatggacnccggctcgagtcgcgttgggtttcggcggaggccagctgaccgtctggtcacgg

SEQ ID NO: 224371 - DNA, 293 bp, Homo sapiens
  misc_feature: GYAE6OF01EYNMS.10.1.A01.1.454.CMB.1.raw
  modified_base (289)..(293): a, c, t, g, unknown or other
  misc_feature (289)..(293): n is a, c, g, or t
tcagcatagtagtgcacgaccggtgctcgatttagacgtctcatcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagcccaaggctgccccctcggtcactctcgttcccgccctcctccactactatgctgagcgggctggcaaggcgcatagnnnnn

SEQ ID NO: 224372 - DNA, 534 bp, Homo sapiens
  misc_feature: GYAE6OF01BUN7Q.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcatggctgactcagccacctcggtatccaaggacttgagacagaccgccacactcacctgcactgggaacaacaacaatgttggccacgacggagtcgtttggctgcagcagcaccagggccaccctcccaagctcctctccgacaggaataacatccggccctcgaggatctcagagagattctctgcatccaggtcaggaagcacgacgcctccctgaacctattactacggacctccgacggctacgacgacgaacgctagtacttattactgtctacagactagtcggacaccggtcctacgtaggtcggtcggttcggggttttcgggcgggtaacgggaccgtaacggtccgtaggtaccgtccgtaggtacccgg

SEQ ID NO: 224373 - DNA, 576 bp, Homo sapiens
  misc_feature: GYAE6OF01ADQBO.10.1.A01.1.454.CMB.1.raw
  modified_base (368)..(368): a, c, t, g, unknown or other
  misc_feature (368)..(368): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagcctcctctccgacaggaataacactcccggacctcgagggactctacgagagagtagttctcgtgcatccgaggtcaggaancacacgcctcctgacctattacgcggactcgacggctcgacgacgaacgtcgtagtacttattacgtcgtactacgacgcagtacgggaccctacccgggtctacggacgttcggtaccgggtttcggggtttacgggccggggtaacgggtaccgtaacggtccgttaccgggtacccggttcccgttaagggtccgtaaacccggg

SEQ ID NO: 224374 - DNA, 531 bp, Homo sapiens
  misc_feature: GYAE6OF01DJW5C.10.1.A01.1.454.CMB.1.raw
  modified_base (362)..(362): a, c, t, g, unknown or other
  misc_feature (362)..(362): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttagccacgacggagtcgttggctgcagcagcaccgaggcccacctccaagctcctctccgacagaataacatccgcctcaggatctcagagagtacttactctcgactatccgaggtcaaggagcaacncgcctcctagaccctatactggacctcaggcctgacgacgaagtctagtattaattactcgctacacgactagtcggaccaccggtcctcgtaggtcggtcggttgggggtttacgggacgggacgggaccaacggtccgtacggtacccgtcgtagggtcaaaccggg

SEQ ID NO: 224375 - DNA, 517 bp, Homo sapiens
  misc_feature: GYAE6OF01EZLU2.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagcctcctctccgacaggaataacactccggccctcagggactctcagagagattctctgcatccgaggtcaggaagcacgacgcctcctacgacctattactggacctccaggctgacgacgagctgattattactgctcagcagtcgggaccaccggcctcgacgtggtcggttggggtttcgggcgggacgggaccaaggtcgtacggacccgtccgtggtccgaaccgg

SEQ ID NO: 224376 - DNA, 493 bp, Homo sapiens
  misc_feature: GYAE6OF01A9494.10.1.A01.1.454.CMB.1.raw
  modified_base (379)..(379): a, c, t, g, unknown or other
  misc_feature (379)..(379): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctccaagctcctctccgacaggaataacatccggccctcagggatctcagagagattctctgcatccaggtcaggaacgcacagcctccctgaccattacnggactccaggctgacgacgagctgacttattactgctacagcagtcgggacaccggcctcgagtcggtcggttgggtttcggcggagggacgagctgaccgtcgtggtcgacgg

SEQ ID NO: 224377 - DNA, 292 bp, Homo sapiens
  misc_feature: GYAE6OF01AC8HK.10.1.A01.1.454.CMB.1.raw
  modified_base (288)..(292): a, c, t, g, unknown or other
  misc_feature (288)..(292): n is a, c, g, or t
tcagcatagtagtgcacgaccggtgctcgatttagacgtctcatcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagcccaaggctgccccctcggtcactctgttcccaccctcctccactactatgctgagcgggctggcaaggcgcatagnnnnn

SEQ ID NO: 224378 - DNA, 571 bp, Homo sapiens
  misc_feature: GYAE6OF01C2VV7.10.1.A01.1.454.CMB.1.raw
  modified_base (170)..(170): a, c, t, g, unknown or other
  misc_feature (170)..(170): n is a, c, g, or t
  modified_base (298)..(298): a, c, t, g, unknown or other
  misc_feature (298)..(298): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagnggtgtccagtgtcaagtgcagctggcggagtcgtgggggaggcgtggtccagccgtgggaggtccctgagactctcctgtgcagcctctgggttcaccttcaatacctatggcatgcacgtgggtccnccaggctccgaggcaaggggctgggagtgggtggctcgttatctcatatgataggtaaattgtttaaaatttgtgacagtactccggtagaacggtccgtattcgaccatcctcgagaagactaattaccaaggaaccaccctagtactctagacaaagtcgaaaccagtccctaggaacgagtacgtaggaaccgtaccgaaccggtctttacggttttaattacgttggtacgaccgtacgaggtacgacgagtcttagtactttaaaccg

SEQ ID NO: 224379 - DNA, 610 bp, Homo sapiens
  misc_feature: GYAE6OF01DVFQ1.10.1.A01.1.454.CMB.1.raw
  modified_base (151)..(151): a, c, t, g, unknown or other
  misc_feature (151)..(151): n is a, c, g, or t
  modified_base (165)..(165): a, c, t, g, unknown or other
  misc_feature (165)..(165): n is a, c, g, or t
  modified_base (169)..(169): a, c, t, g, unknown or other
  misc_feature (169)..(169): n is a, c, g, or t
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (465)..(465): a, c, t, g, unknown or other
  misc_feature (465)..(465): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttggctgagcgtggtttcncgtagctcttaagnggtntcagtgtcaagtgcagctggcggagtcgtggggngcgtggccagccgtggcgtccctgacgtctctcctgngcagcctcgtcggtcacttcaactacctatggcagtncncgtcggccncgaggctccgaggcgaagggctgggaggtggcggcttnttctctctatagtgtagtaggtaaattagtttaaattttgacggtctaacgtacttaccgggtaagacgggtacctacttccaccgtacttaccgaccaaggtaacaacctaacttaccggaaacgtacctacccggtntaactaccgttagaaaccttaagaacgaacctaggacctagggatacggacttagaaccgtacgacgttacgttttaagtttctacgtttacggccggtaacgaccgaagacggtacgaagttccgtacttaaacgttttaaccg

SEQ ID NO: 224380 - DNA, 525 bp, Homo sapiens
  misc_feature: GYAE6OF01BT3RF.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgtttggctgcagcagcaccagggccaccctcccaagcctcctcctccgacaggaataaccatccggccctcaggggactctcagagagattctctgcatccaggtcaggagcacacgcctccctgaccctattacctggacctccgacggctagacgacgaacgtctagtattattactcgctcagcagtcgggaccaccggcctacgagtcggtcggttgggtttcgggccgggtacgggaaccgaggtcgtcgacgttccgtccgtgggtaccg

SEQ ID NO: 224381 - DNA, 540 bp, Homo sapiens
  misc_feature: GYAE6OF01CYZL4.10.1.A01.1.454.CMB.1.raw
  modified_base (342)..(342): a, c, t, g, unknown or other
  misc_feature (342)..(342): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgttggccaacgacgggagtcgtttggctgcagcagcaccagggccaccctccaagctcctctcgacaaggaataacactccggccctcgagggatctcagagagattcnctgcactccaggtcaggacgcaacgacgccctccctagaccctaattaactcggactccaggcctcgacgacgaagctagattattactgctcagcagtcgggaccgaccggcctcgtacggtcggtcggttcggggttttcggcgggacgggacccaaggtccgtacggacccggttacgtacggtcgtaacccggg

SEQ ID NO: 224382 - DNA, 522 bp, Homo sapiens
  misc_feature: GYAE6OF01AG38T.10.1.A01.1.454.CMB.1.raw
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttgccacgacggagtcgtttgctgcagcagcaccgagggccaccctccaacgctcctctccgacaggaactaacatcccgcctacgagggatctcagacgagtattctctgcactcaggtcaggaagcacacgcctcctgacctattacncggactccgagctgacgacgaancgtagtatttactacgtgctcagcagtcggacaccgctcgagtggtccgggttagggtttcgggacgggtacgggaccgaacggtcgtacggtacccgtccgtaggtcgaacccggg

SEQ ID NO: 224383 - DNA, 637 bp, Homo sapiens
  misc_feature: GYAE6OF01CFH8Y.10.1.A01.1.454.CMB.1.raw
  modified_base (312)..(312): a, c, t, g, unknown or other
  misc_feature (312)..(312): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccgagggccaccctcccaagcctcctctccgacaggaactaaccntcccggccctacgacgggactctacaacggagacgtattcctctgcactccgaggtacaaggacgacaccgacgccctcccgtacgaaccctatttacgacggtacctacccgaggtacctacggaaccgaaccggaacgtccttacggtaattttacttaacctcgaccttacgacgtcgtaacggtcggggaaccgtacccggcctaccgtaggtccggttcgggtttcgggggttttaccgggaccggggtaaccggggaacccgtaaacgggtcccgttacgggtaccccggttcccggtaacgggtcccgtaaacccggg

SEQ ID NO: 224384 - DNA, 656 bp, Homo sapiens
  misc_feature: GYAE6OF01BKBN0.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagcccaccctcggtatccaaggacttgagacagaccgccacactcacctgcactaggaacaacaacaatgttggaccacggacggagtcgttggctgcagcagccaccgacgggcccacccgtcccaagcctcctctccgacaggaactaacacgtcccggccctcgacgggactctacgagagagtacttctcgtcgctactccgaaggtacaaggaacgccacgaccgtccctcccgtagtacccctaagttaccgtcggtacctccgaggtcctaggaaccgtaacgaacgtcgttaagtaacgtttacttaccgtcgtacctacggaacgtacgtaacggtaccgggaacccgtacccgggtacctacggtacgggttacgggttcggggtttaccgggggtttaccgggaccggggtaacgggtaaccggtacggtacccggttaccggtaaccccggttccggttaacgggtaccgtaaccccggg

SEQ ID NO: 224385 - DNA, 568 bp, Homo sapiens
  misc_feature: GYAE6OF01CX1A3.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacacaatgttggccacgacggagtcgttggctgcagcagcacagggcccaccctcccaagcctcctctccgacaggaactaacactcccggccctcgacgggactcgtacaggagagtacttctcgtcgctactccgaggtcagggacacacgacgcctccctgaccctattaccgtacggacctccgaggtcgtgacgaacgaagctagtactttaactactcgtcctgacgctaggtgggaccacccggtcctcgaggttcggtccgggttggggtttacgggcgggacgggtaaccgtaggtccgttacggacccggttaccgtagggtccgtaacccggg

SEQ ID NO: 224386 - DNA, 668 bp, Homo sapiens
  misc_feature: GYAE6OF01CXZ7S.10.1.A01.1.454.CMB.1.raw
  modified_base (170)..(170): a, c, t, g, unknown or other
  misc_feature (170)..(170): n is a, c, g, or t
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttggctgagctgggttttcctcgttgcttcttttaagnggtgtccagtgtcaagtgcagctggcggagtcgtgggggagcgtggtccaggcccgtggggacggtcccctggacgtacctcgtccgtgtcgcagcctcgttgggttcaccttcaatacctatggcatgcacgtggtccnccgaggctccaggcaaggggctgggagtgggtggcctnttagtctcatangtataggtaaattgtttaaattttgagtactaagtaccgtaccggtaggaacgggtccgtaattccaacctatacccgttaccgaagaacgtaactaacttccgaaacggtaaaccctacccgttagtactacgttacgaacgtaaaacgttacgaaacctacgtacccgttaaggaacgtaacggtaccgttaccggaaaccggtaacccgtaaccggggttactttaggttttaaacttacgttaggttacggaccgtaaaccgtaaggacgtaccgtagaccgttaagtaacgtttttaaacccg

SEQ ID NO: 224387 - DNA, 648 bp, Homo sapiens
  misc_feature: GYAE6OF01CZB3P.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccacctcggtatccaaggactgagacagaccgccacactcacctgcactgggaacaacaacaatgttaggccacgacggagtcgtttggctgcagcagcaccgaggcccaccgtcccaacgcctccctctaccgacaaggaactaaccacgtcccggccctacgaacgggtactcgtacaagaagacgtaacttctctacgcctacgtacccgtagggttaccaagggaacgaccaaccgacggtccccttaccccgtacgtaaccccgtaactttaacgtacggtacctacccgacggccgttacggaaccgaacggaacgtacgtagtaatttaacttacgtcgtacctcgaagctaacggtcgggaaccgtacccggacctacgtacggtcggtcgggttacggggttttcgggaccgggaacggggtaccctaaggtcccgttacggtacccggttacgtacgggtccgtaacccggg

SEQ ID NO: 224388 - DNA, 297 bp, Homo sapiens
  misc_feature: GYAE6OF01CAM2I.10.1.A01.1.454.CMB.1.raw
  modified_base (292)..(297): a, c, t, g, unknown or other
  misc_feature (292)..(297): n is a, c, g, or t
tcagcatagtagtgcacgaccggtgctcgatttagacgtctcatcagggatctcagagagattctctgcatccaggtcaggaagcacagcctccctgaccattactggactccaggctgacgacgaagctgattattactgctcagcatgggacaccggctcagtgcgtgggtttcggcggagggaccaagctgaccgtctaggtcagcccaaggcctcgcccctcggtccacctctcgttccccaccttcctccactacctatgctgagcgggctggcaaggcgacatagnnnnnn

SEQ ID NO: 224389 - DNA, 524 bp, Homo sapiens
  misc_feature: GYAE6OF01A4PUI.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagcctcctctccgacaggaactaacactccggccctcagggatctcagagagattctctgcatccaggtcaggagcacagcctcctgaccctattactggactccgaggctgacgacgaagctagattatactgctcagcagtcgggaccaccggcctcgagtcggtccggttggggttttcgggcgggaggggaccaacggtccgtacggtacccggtcccgtagggtcccgtaaccgg

SEQ ID NO: 224390 - DNA, 554 bp, Homo sapiens
  misc_feature: GYAE6OF01B0DQ2.10.1.A01.1.454.CMB.1.raw
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
  modified_base (408)..(408): a, c, t, g, unknown or other
  misc_feature (408)..(408): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggagcgtggtccagccgtggggagtccctgagactctcctgtgcagcctctgggttccaccttcaatacctatggcatgcactgggtccnccaggctccgaggcgaaggggctgggagtgggtgctcttatctcatatgataggtaaattgttaaatttngacagactcgtagaacgggtctattcgactatctacaganacaactccgagaaccacctagtactctagacaaatacgaacgacgtaccgtagagacgtcgtacgaacgaccgacggtcgttagtttaacttacgtaggtcggaccgtagaacgtacgacgtaagtcgttagtaacgtttaaaccg

SEQ ID NO: 224391 - DNA, 671 bp, Homo sapiens
  misc_feature: GYAE6OF01A2ECQ.10.1.A01.1.454.CMB.1.raw
  modified_base (394)..(394): a, c, t, g, unknown or other
  misc_feature (394)..(394): n is a, c, g, or t
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcagtggtccaggcagggctgactcagcccaccctcggtatccgaaggacttgagacagaccgccacactcacctgcacgtggaacaacaacaagtgtggaccacggacggacgtcgttggctgcagcagcaccgacggcccaccctccaacgcctcctacctccggaacacggtaaactaacgacgtccggacctcgaaggactctacgagagacgtacttactctcgctactccgaaggtacgaagggaacnccaaccgtacgccctaccgtacgaccctaacgtacgtacgactccgacggccgtacggaaccgtacggtaacgtcgttaacgtaacgtttataccgttcgacgttacgacgtacgtaacggttacgggaacccgtacccgggtcctaccggtaacgggtttcgggtaccggtttttcggggggttacccggggtaccgggaaacggggttacccgtaacgggtcccggttaaccggtaccccgggttaaccgttaacgggtccggtaaaccccgggg

SEQ ID NO: 224392 - DNA, 547 bp, Homo sapiens
  misc_feature: GYAE6OF01A0CSP.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtggccacgacggagtcgttggctgcagcagcaccagggccaccctccaagctcctctccgacaggaataacactccggccctcgagggactctcagagagattcctctgcactccgaggtcagggaagccacacgccctccctacgacccacttacgtcggtacctccgacggtctcgacgacgaacgctgactttacttactgtctcacgtcacgtacgggaccaccggcctcgaggtcggtcggttggggttttacgggccgggtacgggaacccgacgtccgtcggacccgtcgttagggtccgtaaccgg

SEQ ID NO: 224393 - DNA, 575 bp, Homo sapiens
  misc_feature: GYAE6OF01DGTPV.10.1.A01.1.454.CMB.1.raw
tcagcatagtagtgcacgaccggtgctcgatttagacgtctcatcagggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccagggcccaccctcccaagcctccctctccgacaggaataacactcccggccctcgacggggactctcagagagtattctctgcatccgaggtcaggaagcacacgcctcctcgaccctacttacgtcgacctcccgaggtcctaggaccgaacggaacgctagtattaacttacgtcgtctacagcgagtcgggaaccgtacccggaccgtacgtacggtcggtcgggttcgggggttttccgggcggggtaacgggaccgaacggtccgttacggacccggttccggtacgggtccgaacccggg

SEQ ID NO: 224394 - DNA, 530 bp, Homo sapiens
  misc_feature: GYAE6OF01ETAS1.10.1.A01.1.454.CMB.1.raw
  modified_base (296)..(296): a, c, t, g, unknown or other
  misc_feature (296)..(296): n is a, c, g, or t
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
  modified_base (408)..(408): a, c, t, g, unknown or other
  misc_feature (408)..(408): n is a, c, g, or t
  modified_base (506)..(506): a, c, t, g, unknown or other
  misc_feature (506)..(506): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggagcgtggtccagcctgggagtccctgagactctcctgtgcagcctctgggttcaccttcaatacctatggcatgcactggggtccncgaggctccgaggcgaaggggctgggagtgggtggctcttatctcatntgagtaggtaaattgtttaaatttangtacagtactcggtagacggctatcacatctacaaganaaccaattccgaaggacctacccgttgtactctagacaaatgaactgacctagacgagcagacgacacggtcttagtttactagtggtacgacggaanaggacgacagtctagtacttaaac

SEQ ID NO: 224395 - DNA, 561 bp, Homo sapiens
  misc_feature: GYAE6OF01B45P0.10.1.A01.1.454.CMB.1.raw
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgccacgacggagtcgttggctgcagcagcacgacggccaccctccaagcctcctcctaccgacaggaactaacactccggccctacgagggtactctacagacgagtacttctctgcatcgagtcaggaacncacgacncctcctagacctattacgcgactccgagctacgacgacgacgtctagtacttacgtactacgctacacgactaggtacgggaccgtaccggtccgtacgaggtcggtccgggttcggggtttaccgggcgggaaccgggtaccgaacggtccgtacggaacccggttccgtacgggtccgtaacccggg

SEQ ID NO: 224396 - DNA, 561 bp, Homo sapiens
  misc_feature: GYAE6OF01EEDEA.10.1.A01.1.454.CMB.1.raw
  modified_base (361)..(361): a, c, t, g, unknown or other
  misc_feature (361)..(361): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagcctcctctccgacaggaataacactccggccctcgagggatctacagagagattctctgcatccaggtcaaggancacgacgccctacctacgacctattacgtaggaccttccaggtctagacgacggaagctgtaattattacgtcgctacgagcagtacgggacctacccgggcctacgtacggtcggtcggtttacgggggtttcggccggggtaacgggacccaaacgggtccgtacggtacccggttccggtacggtcgtaaacccggg

SEQ ID NO: 224397 - DNA, 570 bp, Homo sapiens
  misc_feature: GYAE6OF01EBJC6.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttgccacgacggagtcgtttggctgcagcagccaccgacgggcccacccctcccgaacgcctcctcctccgacaggaactaacactcccggccctcgacgggactctcgagagagtacttctctgcacgtccgaggtcgaaggaacgacacgacgcctccctacgtaccctacgttaccgtcggacctccgacggtctacgacgacgaagtctagtacttacttacgcgtctacacgcgagtacgggacgacccggctacgtagtcggtcggttggggtttcggccggggtacgggaccgacggtcgtacggacccgtccggtacggtcgtaacccgg

SEQ ID NO: 224398 - DNA, 515 bp, Homo sapiens
  misc_feature: GYAE6OF01E0Q1X.10.1.A01.1.454.CMB.1.raw
  modified_base (446)..(446): a, c, t, g, unknown or other
  misc_feature (446)..(446): n is a, c, g, or t
tcagcatagtagtgcacgaccggtgctcgatttagacgtctcatcagggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggactctcagagagattctctgcatccaggtcaaggaacgcacacgcctccctcgaccctattacgtcggacctccgaggctgacgacgaagctagtacttattactgctcagcagtcgggaccnccggcctcgagtggtcggttgggtttcggcgggacggaccgaagcgtacgaccgtccgtaggtcaccgg

SEQ ID NO: 224399 - DNA, 536 bp, Homo sapiens
  misc_feature: GYAE6OF01A40XI.10.1.A01.1.454.CMB.1.raw
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
  modified_base (452)..(452): a, c, t, g, unknown or other
  misc_feature (452)..(452): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagtcaccctcggtatccaaggacttgagacagaccgccacactcacctgcactggaacaacaacaatgtggccacgacggagtcgttggctgcagcagcaccgacgggccaccctccaagcctcctctccgacaggaactaacactccggccctcgacgggactcgtacagacgagacttctcngcactcgaggtcaggacncacgacgcctcctgacctatacgtcgactccgagtctacgacgacacgctagtattactactcgacttcgacgtcgagtacggacnccggtctcggagtcggtcggttggggtttcgggcggaacgggaccaacggtcgtacggtacccggtacgtcggtcgtaacccgg

SEQ ID NO: 224400 - DNA, 767 bp, Homo sapiens
  misc_feature: GYAE6OF01B5P1T.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcagtggtccaggcagggctgactcagcccaccctcggtactaccaaggacttggacgacacgaccgccacacctcacctgacacgtaggaacaacaactaatgttcggccacggacggagtcgttaggctgcagcagcaccgaggtccaccctccaacgcctcctaccgtaccgaacgaacggaaactaaccgacgtcccggaccctagaacgggtactaccgtacgaacggaagtacgtacttaccgtacgtcgtaccgtacgtaccggaagggtaccgaacggggaacctacccggaacccgtaaccggtcccccgtttaccccggtacgtaaacccgtaacgtttaaccgtaccgggtaaccgtaccgacgggtaccgtaacggaacccggtaacgtaaacggtcgttaacgggttaactttaaccgttaaccgttccgtaccgtaaccggtacgtactaaccggggtaccggaaccccgtacccggttacccgtacggtaacgggtccggggttaccgggtttcgggggtttacccggggaaccggggtaaccgggtaacccgaacggtacccggttaccggtaacccggttccccggtaacgggttcccgaaaccccgggg

SEQ ID NO: 224401 - DNA, 666 bp, Homo sapiens
  misc_feature: GYAE6OF01EH1BM.10.1.A01.1.454.CMB.1.raw
  modified_base (399)..(399): a, c, t, g, unknown or other
  misc_feature (399)..(399): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagctggcggagtcgtgggggagcgtggtccaggcctgggacgtccctgacgacctctcctgtgcagccctcgtgggttccaccctttcaaacttacctattggcctatcgccacgtcggggtcccgccgagggcctccgagggccgaaggggctgggaggtgggtggtctcgttatctcatatgataggaaattgtttaaattttangtacagtacctcggtaggaacgggtccgtacttccacctatccctaccgaagtaacgtaacctaacttacccgaacggtaaccctaccccgttaggtaacttaccgtagtaaccaaaagtacgaaccgacggtccgtaaggaacgtacgaccgtacgaaccggtacccgtacggtaccgttttaggttttaactttaccggttcggtacgacccggtaacgaacggtacgaccgaacggtccgttacggttaccttttaaaacccgg

SEQ ID NO: 224402 - DNA, 702 bp, Homo sapiens
  misc_feature: GYAE6OF01C597Y.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggaggcgtggtccagccgtgggaggtccctgagactctcctgtgcagcctcgtgggttcaccttcaatacctatcggcatgcacgtcgggtccgccgaggcctaccgaggcgaaggggctgggaggtgggtggctcgttatctctatatgataggtaaattaggtttaaaattttagtagtacgtaacgtaccgttaccggttagggaaacggggtcccgtaacttaccgtaaccctacttacccgttacccaaggtaacgtaacctaactttaacccggaacgggtaaacccctacccgttagttaacttaccgtacgtaacctaaagtaccggaaacgtaacggtacccgtaggaacggtaacggtacgtaacggaaccggaaacccggtaccgggttactttacggttttaacgtttaccgttacgggttacggacccggtaaacgaacggtacgtaccggaaggtccgttacggtaaccttttaaaacccg

SEQ ID NO: 224403 - DNA, 585 bp, Homo sapiens
  misc_feature: GYAE6OF01ARGQE.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgtttggctgcagcagcaccacgggccaccctcccaagctcctctccgacaggaactaacactccggccctcgacgggatcgtcagacgagtacttctctacgcactccgtaggtacaagggaacgacacacgccctacctcggaaccctacttacgtacggtacctcccgacggtacacggtaaccggacgtaacgcgtagtaactttagttaacctgtaccttcgtacgacgtacgtacgggaccgtacccggtcctcgtacggtcggtcggttcggggtttcgggcgggtacgggaccgacgtcgtacggtacccggtcgtcggtcgaacccgg

SEQ ID NO: 224404 - DNA, 894 bp, Homo sapiens
  misc_feature: GYAE6OF01DGR4I.10.1.A01.1.454.CMB.1.raw
  modified_base (171)..(171): a, c, t, g, unknown or other
  misc_feature (171)..(171): n is a, c, g, or t
  modified_base (360)..(360): a, c, t, g, unknown or other
  misc_feature (360)..(360): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagcttgggttttcctcgttgctcttttaagnggtgtccagtgtcaagtgcagctggcggagtcgtgggggagcgtggtccagcctgggaggtccctgagactctcctgtcgcacgccttcgtcgggttcaccgttctaatacctatggcatgcacgtcggtccgccaggcctccgaggcaaggggctgggaggtggtgggcttcttactctactagttangtaagttaggtaaaatttaggttttaaaaacttttttagtacggtactaaacggtacccgttaccgggttaacgggtaaaccggggtacccggttaactttaccccgtaaacccccggtaactttaccccggtttaaccccgaaacgggtaaaaccgggttaaaccctaaaaccggtttttaacccccgaaaacgggggttaaaaacccccctaaccccccggtttttaacggttaaacccgttttaacccgttacggggtaaaaccccttaaaaaacgggttacccgggtaaaaaccccgttaacggggtaccccccgtttaaaggggggaaccggttaaacgggtaacccggtttaaccggggaaaccccgggttaacccggaaacccgggggtttacctttaaacggtttttttaaaccggttaacccggtttacggggtttacgggtaacccgtaaaacgggaacccgggtaacggacccggtaaacgggttcccgttaaacgttaaacccggttttttaaaaaccccgg

SEQ ID NO: 224405 - DNA, 527 bp, Homo sapiens
  misc_feature: GYAE6OF01DPOSP.10.1.A01.1.454.CMB.1.raw
  modified_base (293)..(293): a, c, t, g, unknown or other
  misc_feature (293)..(293): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactgggaacaacaacaatgttggccaacgacggagtcgtttggctgcagcagcaccgacgggccaccctccaagcctccnctccgacaaggaactaacacgtcccggcctcgagggactctacgagagtagtacttcgtctgcactcgaggtcgaaggtagacacacgcctacctcgacctactactagacctcgacgtctcgacgacgaagtctagtattacttactcgctcagtcagtcggaccgaccgtcctcgagtcggtcggttgggtttcggcggacggacacgtcgtacgaccgtcgtggtcaccgg

SEQ ID NO: 224406 - DNA, 637 bp, Homo sapiens
  misc_feature: GYAE6OF01AIIHK.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccgagggccaccctccaacgctcctctccgacaggaactaacactcccggccctacgacgggatctcagagagtacgttctctcgcacgttccgaggtcgaaggtaacgcacgaacgtccctaccctacgaccctaactttacgtacgggtacctaccgacggtaccgtacggaacgaaccggtaacgcttacgtaacgtttacttacgtacgtacctacgtacgtcgtacgttacgggaccgtacccggtcctaccgtacggtacggtccgggtttagggggtttttacccggggcgggaacggggtaacccgtaacgggtaccggttacggtaccccggttacggttaccgggtccgtaaaccccggg

SEQ ID NO: 224407 - DNA, 679 bp, Homo sapiens
  misc_feature: GYAE6OF01EHE0V.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtactccgaaggacttgagacacgaccgccacactcacctgcactaggaacaacaacaatgttcggaccacgacggagtcgttggctgcagcagccaccgacggcccaccctccgaacgcctcctacctccgaacgaaggaactaaccgacgtcccggccctacgagggactcgtacgagagagtattctctagacacgtaccgaggtacgaaggaacgccaacgcgtaccccgtccgtacgaacccttaacgttacgtcggtaccctaccgtacggtaccgtacggaaccggaacgtaacggtacttacgttactttaacgttacctagtccgtaacgacgtacgtaacggtaccggggaaccctacccgggtcccttacggtacggtttaccgggtcggggttttaccgggggtttcggggaaccggggtaaccggggtaaccgtaacgggttacccggttaccggtaccccggtacggttaccgggaccggtaaacccggg

SEQ ID NO: 224408 - DNA, 729 bp, Homo sapiens
  misc_feature: GYAE6OF01A2V3F.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggagcgtggtccagcctgggagtccctgagactctcctgtgcagcctctgggttcaccttcaatacctatggcatgcacgtgggtcccgccgaggcctccgaggcgaaggggctgggaggtggggtggtcttcttacgtctcgatagtgaagtacggtaaattaggttttaaaattttagtacggtactaacggtaacccgttcccggttaagggtaaccgggggtacccgtaacttttacccgaaccccgtaacttaccccgtacccgaacgggtaaacgtaaaccttaaaccgtttaaccccgaaacgggtaaacccctaaccccggttagttaaccgttacgttaccgaactaaacgttacggaaaccgtacggtacccgttaggaacgtacggaccgtacggaaccggaccggtaaccgggttaccgttacggtttttaacgtttaccgttacgggttcgaccggtaacgaacggtacggaccgtaaggtaccgttacggttaacccgtttaaaaccg

SEQ ID NO: 224409 - DNA, 555 bp, Homo sapiens
  misc_feature: GYAE6OF01BSOW7.10.1.A01.1.454.CMB.1.raw
  modified_base (465)..(465): a, c, t, g, unknown or other
  misc_feature (465)..(465): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtggccacgacggagtcgttggctgcagcagcaccgagggcccaccctcccaacgcctcctcctccgacaggaactaaccatcccggccctacgaggggactctacagagagtacttctctgcactccgaggtacaggaacgcacgacgcctccctcgaccctagttacgtacggtacctccgagtcgtacgaccgacgagtcgtagtattatactgctcagacagtcggacnccggacctcgacggtcggtcggttacggggtttccggcgggtacgggaccgtaacgtccgtcggtaacccgtccgtcggtcgtaacccgg

SEQ ID NO: 224410 - DNA, 289 bp, Homo sapiens
  misc_feature: GYAE6OF01B74OS.10.1.A01.1.454.CMB.1.raw
  modified_base (286)..(289): a, c, t, g, unknown or other
  misc_feature (286)..(289): n is a, c, g, or t
tcagcatagtagtgcacgaccggtgctcgatttagacgtctcatcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagcccaaggctgccccctggtcactctgttcccacctcctccactactatgctgagcgggctggcaaggcgcatagnnnn

SEQ ID NO: 224411 - DNA, 640 bp, Homo sapiens
  misc_feature: GYAE6OF01AY9TF.10.1.A01.1.454.CMB.1.raw
  modified_base (316)..(316): a, c, t, g, unknown or other
  misc_feature (316)..(316): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtactccaaggacttggagacagaccgccacactcacctgcacgtggaacaacaacaatgttcggaccacgacggagtcgttggctgcgagcagcaccacgggccaccctcccaacgcctcctcctccgacaggaataacncgtccgcctcgacgggactctacaggagagtacttactcgtagcctactaccgagggttacaacgggaacgaccgaacaccggtcccctacccgttacggaaaccccttaacgtttaccgtacgggtaacccgttcccgaacgggtaccgtacggtaacccgggaacggtaacgccttaaggtaactttaacgttacgtacgtccgtaacgacgtacgacggtacgggaccgtacccggcctacgtacgggtcggtcggttcggggtttccgggcgggaacgggccaaggtccgtacggacccggttcgtagggtcccgaccgg

SEQ ID NO: 224412 - DNA, 608 bp, Homo sapiens
  misc_feature: GYAE6OF01B5FOJ.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacacgaccgccacactcacctgcacgtaggaaccaacaacaatgttacggccacgacggagtcgttggctgcagcagcaccgcggcccaccctccaacgcctcctctaccgacgaaggaactaacgacgtcccggcctcgaggactctacagagagtacttctctcgctacgtccgaggtacgaaggaacgaccacgtaccgtccctaccccgtacgtaaccctacgttaccgtacggtaccgtaccgacggtccaacggtaccggacgtaacgtcttacgtatttacgttacgtacgtctacgagacgtacggtcgggaaccctccggccttcgacggttcgggtcgggttcggggttaccgggacgggtacggacgtacggtcgtaccggtaccgtcgtacggtccgtaccgg

SEQ ID NO: 224413 - DNA, 567 bp, Homo sapiens
  misc_feature: GYAE6OF01AV1DB.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagccaccgacgggccacccctcccaacgcctcctctccgacaggaactaacactccggcctacgagggactcgtcgagagagtattctctgcatccgaggtacaggagcacacgtcctacctagaccctattaccgcggtacctccgaggctgaccgaacgagctagtacttaattacgtgcgttacgagctacggtgggaacccgaccggtctccgtacgggtcggtcgggtttaggggtttccgggacgggacgggaaccgtacggtcgtacggacccggttcgtaccgggtcgaacccggg

SEQ ID NO: 224414 - DNA, 634 bp, Homo sapiens
  misc_feature: GYAE6OF01BIQ12.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtggccacgacggagtcgttggctgcagcagcacgaggccaccctcccaagcctcctctccgacaggaataacacgtcccggccctacgagggactctacgagagagtacttctctgcagtccgaggtacgaggtaacgccacacgcctccctagaaccctacttacgtacggacctccgaggtctacgaacgacgaacgtctagtaacttagttacctcgacttacgagtccgaacggttacgggaacccgacccgggtacccttacggtaacggttccgggtaccggggttttcgggggttttacccggggaccggggtaacggggtaaccccgtaaacgggtcccggttacgggtaacccccggtttacccggttaacgggtacccggtaaaccccgggg

SEQ ID NO: 224415 - DNA, 554 bp, Homo sapiens
  misc_feature: GYAE6OF01CHMU7.10.1.A01.1.454.CMB.1.raw
  modified_base (170)..(170): a, c, t, g, unknown or other
  misc_feature (170)..(170): n is a, c, g, or t
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagnggtgtccagtgtcaagtgcagctggcggagtcgtgggggagcgtggtccagccgtggggacgtccctgagactctcctgtgcagccctntgggttccaccttcaatacctatggcatgcacgtgggtccnccgaggcctccgaggcaaggggctgggagtgggtggctcttatctctatatgatggaaattgttaaatttgtgctagtactccggtagaacgggcctatccacctatcctacgagagaactaacttccgaaggaaccctacctgtactctagacaaagtgaaccaggtcctaggacgagctagaccggtacgaccggtctttacgttttacgtacttggtacgacgacgagtacgcagtcctgtactttaaacg

SEQ ID NO: 224416 - DNA, 716 bp, Homo sapiens
  misc_feature: GYAE6OF01DJIZZ.10.1.A01.1.454.CMB.1.raw
  modified_base (228)..(228): a, c, t, g, unknown or other
  misc_feature (228)..(228): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactaggaacaacaanaatgttggccacgacggagttcgttggctgcagcagcaccgacgggcccaccctccaacgcctccctccgtacccgaacgaacggaaactaaaccgaccgtaccccggccctacgaacggggtactccgtacgaaggaacggtacgtaactttctacgtagacctacgtaccgtaagggtaccgaacgggaacgtaccgaaccgaccgtaccccgttacccgtacgtaacccctaacgtttaccgtacggtacccttacccgacggtaccgtacggaaccggtaacggtaacgtacttagtactttaacgttaccgtcgtaccgttacgaacggtacgtaacggtaccgggaaccgtacccggtaccgttaccggtacggttacgggttcggggtttaccgggggtttaccggggaccgggtaaccgggaaccgtaaccgggtccgttacccggtaacccggttccggtaccggtccggtaacccggg

SEQ ID NO: 224417 - DNA, 748 bp, Homo sapiens
  misc_feature: GYAE6OF01A04BP.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccacccgtcggtactccaaggacttgagacagaccgccacactcacctgcactggaacaacaacaatgtggccacgacggagttcgttggctgcagcagcaccgacgggcccacccctaccaacgcctccctcctaccgacaaggaactaaccgacgtccccggcccgtacgacggggactccgtaccgaaggagacgtacttcctctacggtcctacgttacccgaagggttaccgaagggtaacgccgaaccgaaccggtcccctaccccgtaccgtaaccctacgtttaccgtacggtaaccctacccgtaggtcccgtacgaaccgggaaccgtaacgtacgtacgttaacgttttaaccgttaacgttcggtacctaccgtaacgtaccggtaacggtcggggtaaccccgtacccgggtaccccttacgtaacgggtttcgggttacccgggggtttcggggggtttttacccggggaccgggggttaacccggggaaacccgttaaccggggtacccgggttaaccggtaacccgggtttaccccggttaacggggtacccggtaaaccccgggg

SEQ ID NO: 224418 - DNA, 608 bp, Homo sapiens
  misc_feature: GYAE6OF01BQQ57.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccgacgggcccaccctcccaagcctcctcctccgacaggaactaacacgtcccggccctacgacgggactcgtacagagagtacttctcgtcgactacgtccgaggtacgaacggaacgccaacgaccgccctacccgtacgaaccctaacttacgtcggacctccgaggtccgtacgacgaacgaacgtcgtagtaacttacgttactcgtactacgacgtacgacgtacgggaacccgacccggcctacgacggttcggtcgggtttacggggtttccgggcgggtaacgggaccgtaacggtccgtacggtacccgttccggtacggtccgtaacccggg

SEQ ID NO: 224419 - DNA, 776 bp, Homo sapiens
  misc_feature: GYAE6OF01CGU8T.10.1.A01.1.454.CMB.1.raw
  modified_base (175)..(175): a, c, t, g, unknown or other
  misc_feature (175)..(175): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcacatggagtttggctgagcgttgggttttcctcgttgcttcttttaagaggtntccagtgtcaagtgcagcgtggcggagtcgtgggggagcgtggtccagccgtggggacgtccctgacgaccttctcctagtcggctacgccttcgtcggttccacctttacaactacctagtggacagtcgctacgtcgggtcccgaccgacggtcccaccggagggacgaagggggccgttagggacgggttggggtacggtccttacgtttaacgtacctacgtaagttaagtacggtaagttaaacgggttaaatttaacggtttttaaaatttttacgacgttaacgtaacggtaccgttaaccgggtacgggtaaaccgggtacccgtaacgtttacccaacccgttaacttacccgtaacccggaaaggtaaaccgtaaaccttaaacgtttaaccccggaacggttaaaccccggtaacccctttaggtaaacgttaccgtaacgggaaacctaaaacgtacgaaccgtaaacgtcccgtaaggaacgtacgacgtacgaaaccgaccgtacggtactttaagttttaacgttacgtacggtgtaccggaaacgtagggacctaacgagtaccgttaggttaactttaaaccgg

SEQ ID NO: 224420 - DNA, 627 bp, Homo sapiens
  misc_feature: GYAE6OF01A2F16.10.1.A01.1.454.CMB.1.raw
  modified_base (375)..(375): a, c, t, g, unknown or other
  misc_feature (375)..(375): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgtttggctgcagcagcaccgacgggccaccctcccaacgcctcctctaccgacaaggaactaaccgactcccggccctcgagggactctcgagagagtattctcgtgctatccgaggtcaggaacncacacgtccctacccgtagaccctaattaccgtacggtacctcccgaaggcctacggacgtaacgaacgtctagtaatttaacttacgtcgtacctacgacgtacgaggtaccgggaccgacccggtcctacgtagggttccgggtacgggtttcgggggttttacccgggacggggtaaccggggtaacccgtaacgggtcccgttaccgggtaaccccggttccggtaacgggtcccgtaaaccccgggg

SEQ ID NO: 224421 - DNA, 718 bp, Homo sapiens
  misc_feature: GYAE6OF01BWZCO.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacacaacaatgtgccacgacggagtcgttggctgcagcagcaccagggccacccctcccaagcctcctcctccgacaggaataacatcccggccctacgaggggactctcgaaggagagtactttcctcttcgacctactacccggaaggtacgaagggtaacgacaaccgacggtaccccctacccgtacggaaacccctacgtttaaccgtagggtaaccctaccgaacgggtccctacgggacgtaacccggaaacgtccgttaacggtaacgtttaaccgtttaaccgtacgtaccttacgacggtacccgaaggttacccggggaaccgtaaccccggggtcccgttaccgtaacggttccggggtaccggggttttacggggggtttttacccggggaccgggggtaaaccggggtaacccggtaaacgggttaccccggtagggtaaccccccgggtttaccggttaaccggggtcccgtaaaccccgggg

SEQ ID NO: 224422 - DNA, 539 bp, Homo sapiens
  misc_feature: GYAE6OF01A27V5.10.1.A01.1.454.CMB.1.raw
  modified_base (328)..(328): a, c, t, g, unknown or other
  misc_feature (328)..(328): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccagggccaccctcccaagctcctctccgacaggataacatccggccctcaggatctcaganagattctctgcatccagtcgaggagcacacgcctccctgacctattacgtcgacctccgaggtctacggaccgacggaagctagtatttactacgtcgctacgagcagtagggaccaccggcctcgaggttcggcgggttcggggtttccgggcgggtaacgggtaccgaaacggtccggtacgtacccggtcctagggtcgtaacccggg

SEQ ID NO: 224423 - DNA, 704 bp, Homo sapiens
  misc_feature: GYAE6OF01A8G0U.10.1.A01.1.454.CMB.1.raw
  modified_base (334)..(334): a, c, t, g, unknown or other
  misc_feature (334)..(334): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagctggcggagtcggtgggggaggcgtggtccaggccgtgggacgtccctgacgtacctcctccgtgtcgccacgtccctcgttcgggttcccaccctttacgaacttacctagtcggactagtcgccgacgtcggggtcccnccgacggcctaccgacggacggaaggggtcgtagggagggttcgggtcgtcgttaccgttatccgtacgtatagtacgtaagtaggtaaaattagtttaaatttagacgtacgtaacgtaccgtcggtacggaacggtaccgttactaccaccgttactacccgtaccaagtaccgtaactaccgtaaccgaacgtaaccctacccgttagtactacgtacgaactaacgtaacgtaaccgacgtaccgtagaaggtaccgtacgtacgaccgtaccggtcggttaaccgttttagtttaccgttacgtcggttacgaccggtaacgaacggtacgacggtaactacgttaacgttaaccgttttaaccg

SEQ ID NO: 224424 - DNA, 674 bp, Homo sapiens
  misc_feature: GYAE6OF01D1WJV.10.1.A01.1.454.CMB.1.raw
tcagcatagtagtgcacgaccggtgctcgatttagacgtctcatcaggtgctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacacaatgtgccacgacggagtcgtttggctgcagcagcaccgacgggcccaccctccaagcctcctctccgacaggaaactaacacgtcccggccctacgaggactctacaggacgagtacttccgtctggaccacgttcccgaagggttaccaaggggaaacgtaccgaaccgtaaccgtccccttacccgtacgtaaccctaacgtttaaccgtacgggtacctcccgaacgggtccgtacggaaccggaacggtaacgtacgttacgtaactttaactttaccgttcgtaccttacgtaacgtacgtaacggttacgggaaccctacccgggtcccttacggtaacgggttccgggttacgggtttcggggttttccggggaccggggtaacgggaacccgtaacggtacgttaccggtaacccggttccggttaacgggtacccgg

SEQ ID NO: 224425 - DNA, 696 bp, Homo sapiens
  misc_feature: GYAE6OF01A6J87.10.1.A01.1.454.CMB.1.raw
  modified_base (316)..(316): a, c, t, g, unknown or other
  misc_feature (316)..(316): n is a, c, g, or t
  modified_base (417)..(417): a, c, t, g, unknown or other
  misc_feature (417)..(417): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagctggcggagtcgtgggggagcgtggtccagccgtgggacgtccctagacgctctccgtgtcgcagcctcgttgggttccaccttcaaacttacctatggctatcgcctacgtcggggtcccnccgacggtcctaccgagggccgaagggggtcgtagggaggttggggtcgtcttcttatcctcaatagtaggtaataggtaaaatttgttttaaaatttcgngtacgtaacgtacgttaccggtagggtaacggtccgtaacttaccgacctacgttaccctaccgaagtaacgtaacctaacgttacccgaaacggtaaccctacccgttagtaccttacgtacgaactaaagtaacgaaccgtacgtaccgtagaacggacgtcgtaacgaacccggtacgtaccggttacgtttacgtttaacgttacgttacgggtacgtaacccgaacggtacggtaacgacgtaacgtccttaaggttaaaccgttttaaacccg

SEQ ID NO: 224426 - DNA, 645 bp, Homo sapiens
  misc_feature: GYAE6OF01CFXYB.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttgctgcagcagcaccgacgggccaccctccaacgcctcctctccgacaggaactaacactccggccctcgacgggactcctacgagagagtacttctctgcactccgaggtcaggacgcacacgcctccgtacgacctacttacgtacgggacctaccgagggtacctcggtaaccgaccgtaaaggtccgtagttaacgtttaacttaacgttacgtccgttacgaacggtacgtaacggtcggggaacccgtacccgggtacccttaccggtacggtccggttaccggggtttccgggggttttaccggggaccggggttaaccggggaacccgtaaacgggtccggtaccggtaccccggttacccggtacgggttcccgaaacccgggg

SEQ ID NO: 224427 - DNA, 647 bp, Homo sapiens
  misc_feature: GYAE6OF01B268N.10.1.A01.1.454.CMB.1.raw
  modified_base (529)..(529): a, c, t, g, unknown or other
  misc_feature (529)..(529): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgtggccacgacggagtcgttggctgcagcagccaccgacgggcccaccctcccaacgcctccctcctccgacacggaactaaccactcccggccctcgagggtactctcgagaagacgtacttctctgcctacgtccgaggtcgaagggaacgccgaaccgacgtcccctaccccgtagtaacccctaagtttaccgtacggtacctcccgaggtcctaggacccggtaacgaacgtccgttagtactttaacttaccgtacgtacgtaccgagtccgtaacggtaccgggaaccnccccgggtacctccgtacgggttacgggttccgggtttagggggtttcccggggacggggtaacgggacccgaacggtccgttaccggacccggttccgtacgggtcccgtaaccggg

SEQ ID NO: 224428 - DNA, 746 bp, Homo sapiens
  misc_feature: GYAE6OF01EYEWA.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcagtggtccaggcagggctgactcacgccacccgtcggtactaccgaaggtacttggacgacgacgacccgccacactcacctgacacgtacggaacaaacaacaagttcggttacggaccgaacggtacggtaggttcggtttacggctgcgacgcagaccgaccgacgggacccacccgtaccaacgcctacccgtcctacccggaacgaacggtaaactaaccgtaccgttaccccgggacccttacgaacgggtactaccgtacgaacggacgtacgtacttccgtctacgacctacgtaccggtacggtacggaacggtaacgaccgaaccgtaccgtccctacccgtacgaaccctaacgtttaccgtacggtacccgtacgacggtacgtaccggaacggaacgtaacgtcgtacgttaacgtttacttaaccggtcgaccttacgacgacgtaggtacccgggaccgaacccggtccgtacggtaacggttcgggttcggggtttacgggtttccggggaacccgggtacggtaacccggtacgttaccgggtaccggtaacccgggttacccggtagggtcccggtaaaccccggg

SEQ ID NO: 224429 - DNA, 725 bp, Homo sapiens
  misc_feature: GYAE6OF01CZ77Z.10.1.A01.1.454.CMB.1.raw
  modified_base (282)..(282): a, c, t, g, unknown or other
  misc_feature (282)..(282): n is a, c, g, or t
  modified_base (323)..(323): a, c, t, g, unknown or other
  misc_feature (323)..(323): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcgaccacgggcccacccncccaagcctcctctcgacaggaactaacacgtcccggcccncgacggactcctacgagacgtagactttacgtcttcggactacgtcccgtaagggtacgaagggtaacgaccgtaaccgaccggtaccccttaccccgtacggtaaccccgtaactttaaccggtacgggtaacccgtacccgtaacgggtaccgttacggaacccgaacggtaaccggtaccgttagtttaacgtttaaacgttaccgttacgtacccttacgaacggtaaccgtaacggtacggggtaaccctaaccccgggtcccgtaccggtacgggttacggttccggggtttacgggggttttacccggggaaccgggggtaaccgggtaacccgtaacgggtcccgttaaccgggttaccccggttaccgggtacgggtcccggtaaaccccggg

SEQ ID NO: 224430 - DNA, 608 bp, Homo sapiens
  misc_feature: GYAE6OF01AWV04.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctgggcggagtcgtgggggagcgtggtccagccgtggggacgtccctgacgactctcctgtcgcagcctcgtgggttcaccttcaactacctatggcatgcacgtcgggtccgccgaggcctccgagggcgaaggggctgggaggtgggtggctcttatctctatatgataggtaaatttagtttaaattttatgtactagtacgtccggtaggaacgggtccgtaattccacctactccctaccgaacgtacgaacctaacttacccgaacggaaccctacccgttagtaactactacgaactaaacgtacgaacctacgtaccgtagacgacgtacgacggaacgacgtacggtcttagtttacttacgtggtcgaccgtagaggtacgacgacgtcgtacgtacgtttaaaccg

SEQ ID NO: 224431 - DNA, 730 bp, Homo sapiens
  misc_feature: GYAE6OF01DEOYB.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcacatggagtttgggctgagtcgttcgggttttcctcgttgtcttcttttaagaggtgtccagtgtcaagtgcagcgtggcggaggtcgtgggggagcgtggtccagccgtgggacggtcctgacgtctctccgtgtcgcacgtccttcgtcgggttacctaaccttactaacttacctagtcggactagtcgaccgtaccggttcgggtcccgacccgacggtcccgtaccggaggacggaaggggtcgtagggtacgggttcgggtggtccttacgttactcgttacgtaagttaagtaggtaacgttaaaggttaaaagtttaagtttttaaaacgttttgtacgtaacgtaacggtaccgttaccggttaagggtaacgggtaccgtacttaccgtaacctacgtacccttaacgaacggtaaacgtaaccgttaaaccgttacccgaaacggtaaaccctacccgttacgtaactactaacggaaccaaagtacgaaacgtacgtaccgtagacgtacgctacggaactacgtacgtacgttagtttacgttacgtaggcgaacgacgtaaggactacgagtacttaagttaccctttaaacgg

SEQ ID NO: 224432 - DNA, 692 bp, Homo sapiens
  misc_feature: GYAE6OF01DVELB.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactaggaacaaacaacaatgttggccacgacggagtcggttggctgcagcacgccgaccgacgggacccacccgtacccaacgcctcctccgtaccgaacaaggaaactaacacgtcccggacccgtacgaacggtactacgtacgaacggagtacgtatttctctacgacctacgtaccgaggtaccgaagggaacgaccgaaccgacgtacccctacccgtaccggtaacccttacgtttaaccgtacggtaacccttaccggaacggtccgtaacggaaccggaaccgaacgtacgttacgtaagtttaacttacgtacgtacctacgacgtacgtaacggtacggaaccgacccgggtccttacggtacggtttccgggtccgggtttagggggttttcccgggacggggtaaccgggtaccgaaacggtccggtaccggttaacccggttacggtaccgggtacgaacccggg

SEQ ID NO: 224433 - DNA, 543 bp, Homo sapiens
  misc_feature: GYAE6OF01EOJFZ.10.1.A01.1.454.CMB.1.raw
  modified_base (366)..(366): a, c, t, g, unknown or other
  misc_feature (366)..(366): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggagcgtggtccagccgtgggagtccctgagactctcctgtgcagcctctgggttcaccttcaatacctatggcatgctactgggtccgccaggctccgaggcaaggggctgggagtgggtggctcttatctcatatgtatggaaatgttaaattttangtactagactcgtagaacgggcctattcacctatcctaccaagacgaactaacttccaaggaacctaccctgtaacttcgtagacaaattcgaaacagtacctagagagctaggacgtacgacgtcgttagtttacttaacgtgtcggacgtacacgacgcagctgactttaaaccg

SEQ ID NO: 224434 - DNA, 825 bp, Homo sapiens
  misc_feature: GYAE6OF01EFUVE.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcaggactgactcagccacctcggtactccaaggacttgagacagaccgccacactcacctgcactggaacaacaacatgttcggccacggacggagtcgtttggctgcagcagcaccgacgggcccaccctaccgaacgcctcccgtcctcccgaacgacggaaactaaccacgttaccccgggcccttacggaacggggtacttaccgtacgacggacgtaaggtacttctacgtcgaccgtacgtacccgtaacgggtaccgaagggaaacgccgtaacgaccccggtaccccttcccctaaccggtaaccccttaacgtttaccggttacggtaaccccgtttacccggaagggtaccgtaacgggaaaccggtaaccggtaggtaccgtacggtttaaacgtttaacctttacggttaccggtaccttacggtaacggtaccgtaacggggttaccgggaaccccggtacccgggttaacccgtttaccgggaaccggggttttaccgggggttacccgggggtttttcgggggggtttttaaccccggggggccgggggtaaaaacccggggggttaaccccggaaacccggggtttcccgggttaaccccgggttaacccccggggtaccgtttaaacccggggggtcccgtaaaaccccccggggg

SEQ ID NO: 224435 - DNA, 777 bp, Homo sapiens
  misc_feature: GYAE6OF01D5HFL.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcaggtcggtccaggcgagggctgactcacgcccaccctcagccgtcgtccggggaccccgggcgaggacgggtccaccgtattccgttctttggttcgtacgggaacgccgaacgtcctaccgtaagttcgggtacggggaagaagtaattaaagtggttagttaaccggttacggtaaccgaggtaccgtaaccgggtaccccgaacggggaaaccccgaccccctaaaactcccgtactaacgtacttaaacgttaacgtaatttaccggccgggtacccgtcccgtacgggtaccgggtccctaacggtaccgtctttccgtcgtcggtacctaccgtaacggtcgtacggacctacccgtcgaccggtccccttccgtacggcctaacgtccggagggtcgggtcccgttaccgggtcggagtacgtcggaccgtcttagttaactttacgttacgtggttagtacgtggtaaggtagggtactacggaacgtacgtcgttaaggtagtccgttacgtttaggttcggttaaccggttaaccggacggttacccggggaactaccgggtcccttacccgttacccggttaagtaccccgaaccgtacccggaaacccggtcccctaaacccg

SEQ ID NO: 224436 - DNA, 525 bp, Homo sapiens
  misc_feature: GYAE6OF01AVUFU.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcgagggactctcagagagacttctctgcatccaggtcaggaagcacacgcctccctgacccattactcggactccaggctagacgacgaagtctagattatactgacctcagcagtcgggaccaccggcctcgagtcggcggttggggtttccgggcgggtacgggaccgaacggtccgtacggacccgtccgtaggtccgaaccggg

SEQ ID NO: 224437 - DNA, 734 bp, Homo sapiens
  misc_feature: GYAE6OF01AHGMI.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccgacgggaccaccctcccaacgcctcctcctaccgacaaggaactaaccacgtcccggccctacgacgggtactccgtacgaaggacgaacgtacttccgtacgttcgacctaacgtaccgtaggttacgaacgggaaacgccgaaccgaccggtacccctaccccgttaccgaacccgtacgtttaaccggtaccggtacccgtacccggaaccgggtaccgtacgggaaccggtaaccgaacggtcttaacggttaactttacgtttaaccgtcggtaccgtaccgtacgaccgtacggtacggggaacccgacccgggtaccgttaccggtacgggttcgggttccggggtttacgggggtttttacccggggccgggggtaaccggggtaaccccggtaaacgggtcccggttaccgggtaaccccggttacccgggttaccgggttcccggtaaaccccgggg

SEQ ID NO: 224438 - DNA, 644 bp, Homo sapiens
  misc_feature: GYAE6OF01BH1XG.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacacgaccgccacactcacctgccacgtagggaaccaacaacaatggttcggaccacggacggtagtcggtttggcctgcacgcgacgccaccgacgggcccacccctacccaacgtcctccctcctacccgaacaacggaactaacctacgtccccgggaccctacggacgggtactcgtacgaagacgtagtacttctctgacctactaccgaggtaccgaggaagccaaccgtaccgtcccctcctaacgaaccctaacgtttaccgtacggaaccctccgacggtcgtacggtaccgaaccgagtacgttagtaatttactaccgtgtacctacggacgtacgtacggtaccggacctccggacctacgtacggtcggtcgggtttcgggttacggcgggtaacggacccgtaggtccgtacggtcccgtacgtcggtcgtaacccgg

SEQ ID NO: 224439 - DNA, 682 bp, Homo sapiens
  misc_feature: GYAE6OF01BNKDB.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagcgtggcggagtcggtgggggagcgtggtccagccgtgggacgtcctgacgactctccgtgtgcgacgtcctcgttcgggttcctaccttacaacttacctagtcggactatcgcctacgtcgggtcccgccgacggcctaccgagggacgaacggggcgtagggaggtggggtcgtcttcttacgtctacatagtgtagtaggtaaatttagtttaaatttagacgtacgtagtacgtaccggtaggaacggtacctacgttaccactactaccgtacgaagtaacgtaacgtaacttaccgaacgtaacctaccttgtaaccttcgtacgtaactaaacgtacgtaaccgcgtaaccgaggaacgtacggtaccgtacggaaaccgtaccggttacgttaccgtttaggttttaaccttacggtacggtaccgaccgtaacgaaggtaccgtacgtaacgtccgttaccgttaacgttttaaacccgg

SEQ ID NO: 224440 - DNA, 884 bp, Homo sapiens
  misc_feature: GYAE6OF01B1BT2.10.1.A01.1.454.CMB.1.raw
  modified_base (556)..(556): a, c, t, g, unknown or other
  misc_feature (556)..(556): n is a, c, g, or t
tcagcatagtagtgcacgaccggtgctcgatttagacgtctcatcaggggctccaaacagagcttcagcaagcataggtgggaatctgcaccatcgcccgtgggctctcgcctcctcctcgaccctcctcactcactctgcgtagtcgtcgtaggtcggaccgaggcgagggtctacgacctacgaccgtcccaccgtcggtaacctacggaaggtactacggaacgaccgaccgacctaccacacaccgacgtcgacgtaacggaacggaaacaactaacgtacgtcggtacggaccgaacggtacggttcggttcggttacggcgtacgacgacgaccgacggaccgaccggacccggaccctacccgtaccgaccgtccctacccgtaccgtaaccgaaacggtaacgtaaaccgtaacccgtccggtaccccggtaccgtacgggtaccgttaccgtaccgtaacggaacggtaacgtaccgtttaccgtttaccgtacgtaaccggtaccgtaaccggtacggtaaaccgggacgggaaaccggttaaccnccggtaaccccgttaccggttaaccccttaaccggaacgtttaaccccgtaacgttacgggtaacgaacccggttacggacggttaacggaacccggaacggtagtaacgtttagttaaaccgttttaacgttcgtacccggtataaccggtacggtaacgacggtaaccgggccgtaacccgttcgggtacttacggggtccgggtttttaccgggggtacgggtttaccgggggtaccggacggggtaaaacccgtcccgggttacgtttcccgggtaaaccccgggaggtttaaaccccgggccggggtaaacctacccccgggg

SEQ ID NO: 224441 - DNA, 653 bp, Homo sapiens
  misc_feature: GYAE6OF01BC8X1.10.1.A01.1.454.CMB.1.raw
  modified_base (300)..(300): a, c, t, g, unknown or other
  misc_feature (300)..(300): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtctgggggagcgtggtccagccgtgggagtccctgagactctcctgtgcagcctcgtgggttcaccttcaatacctagtggcatgccacgtcggggtccnccgaggcctccgaggcgaaggggctgggagtgggtgctcttatcgtnatatgataggtaaattgtttaaaattttngtactaagaccttacggaggaacgggccctattaccaacctacgtacctaccgaagaacgtaacctaacgttacccgaaacggtaaacccgtacccgttacgttaactccgtaacggacctaaaaagttccggaaacctacggacccgttagggaacgtacggaccgttacggaaccggtaacgtaccgggttacgtttacgggttttaacttacgtgggttaccgacggtaacgaagggtacgaccgtaagtaccttacggttaacctttaaaccg

SEQ ID NO: 224442 - DNA, 696 bp, Homo sapiens
  misc_feature: GYAE6OF01B0F9X.10.1.A01.1.454.CMB.1.raw
  modified_base (422)..(422): a, c, t, g, unknown or other
  misc_feature (422)..(422): n is a, c, g, or t
tcagcatagtagtgcacgaccggtgctcgatttagacgtctcatcgaggggctgggagaggagcccagcactagaagtcggcggtgtttccattcggtgatcagcactgaacacagagactcaccatggagtttgggctggagtcgttgggttttcctgttgcttacttttaaggagtgtccagtgtcaagtgcagcgtgggcggtagtcggtgggggagcggtggtccaggccgtgggacggtccctggacgtaccttcgtccgtggtcgccgtacggtcctcggttcgggttacctaccttacctaaacgttacctagtcggctaagtcgccgtacggttcgggcccgaccgtaggccgtacggacggacggtaacggggcgtacgggtagggttgggtcggtcgttctttacgtcgtanagttaagtagagtaaggttaaattagttttaaatttcgacgcgtaacgtaccgttacggtaggtaacggtcctacgttacaccgtagtcccgtaaccgaaggtaacctaacgttaaccgttacccgaagtaaccctaccttagtacttacgacgtaacaacgtcgaacgtacgccgtaaggacgtacgacgacgacgtacgtacgtagttacgtttcgtacggtcgtagggacctaaggacgtacgactaaggccttaaggttaccctttaacg

SEQ ID NO: 224443 - DNA, 703 bp, Homo sapiens
  misc_feature: GYAE6OF01CS9M2.10.1.A01.1.454.CMB.1.raw
  modified_base (192)..(192): a, c, t, g, unknown or other
  misc_feature (192)..(192): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcacgccaccctcggtatccaaggcttganacagaccgccacactcacctgcactacggaacaacaacaagtgttggccacgacggagtcgttggctgcagcagcaccacgggccaccctccaacgcctccctctaccgacaacggaaactaaccgacgtcccggaccctcgaacggggtatccgtacgaggaagacggtaactttcgtccgtggacctatacccgtacgggtaccaaacggggaagaccaaccgacgtaccccgttacccctacggtaacccctaacgtttaccgtacggtacccttacccgaacgggtacccgttacggaaccgaacggtaaacgtacgttacgttaagtttaactttaaccgtcgttacgttaccgaagtaccgaaggttaccgggaacccgtaccccggtaaccgtcgtaacggttcggtaccggggtttacggggtttttccgggacggggtacgggaacccgtaacgggtccgttacggacccggtttaccggttacgggttacccgtaaccggg

SEQ ID NO: 224444 - DNA, 571 bp, Homo sapiens
  misc_feature: GYAE6OF01DXUYO.10.1.A01.1.454.CMB.1.raw
  modified_base (375)..(375): a, c, t, g, unknown or other
  misc_feature (375)..(375): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagctggcggagtcgtgggggagcgtggtccaggccgtgggacggtccctgacgactctcctgtgcagcctctgggttcaccttcaatacctatggcatgcacgtcgggtccgccgaggctccaggcgaaggggctgggagtgggtgctcttatctcatatgataggtaaatgtttaaaatttntgactaagtacgtaccggtagaacgggccgtataccactactctaccagacgactaatccaagaaccaccctagtactctgaacaaatcgaaacgacgaccgttaggaagacgcgtagaccggaacgccggtacttcggtttaacttacgtggttacgacggtacaacggacgacgagtcgtcgtatttaaacccg

SEQ ID NO: 224445 - DNA, 630 bp, Homo sapiens
  misc_feature: GYAE6OF01AF4X0.10.1.A01.1.454.CMB.1.raw
tcagcatagtagtgcacgaccggtgctcgatttagacgtctcatcaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagctggcggagtcgtgggggagcgtggtccagccgtggggacggtccctgacgactctccgtgtcgcagccctcgttgggttccaccttcaactacctatggctagtcgcacgtcgggtcccgccgaggcctccgagggacgaaggggcgtgggacggtggggtcggcttcgttatccttcatagtgtagttaggtaaatttagttttaaattttagtgtactacgtaccgtcggtagggtaacgggtcctattccaacctactcctaccgaagacgtaactaacgttaccgaacggtaaccctacctagttactactacgtaacaagtacgaacgacgtaccgtaggacgacgtcgacggaccaccggtaccggtcgtttaagtttacgttacgttaggtcgaccgacgaggactacagtcgtacgtacgtttaacg

SEQ ID NO: 224446 - DNA, 877 bp, Homo sapiens
  misc_feature: GYAE6OF01DUKTA.10.1.A01.1.454.CMB.1.raw
tcagcatagtagtgcacgaccggtgctcgatttagacgtctcatcaggggctccaaacagagcttcagcaagcatagtggaatctgcaccatgccctgggctctgctcctcctgaccctcctcactcactctgcagtgtcagtggtccaggcagggctgactcagccaccctcggtatccaaggacttgagacagaccgcacactcacctgacactagggaacaacaactaagtcgttacggaccgaacggtacggacgttacgtttcggctggacgacggcacgacctaccgaacgggccccaccccgtacccgaacgtccctacccgtaccgtaccgtaaccgaacgggtaaacttaaaccgtaccggtaccccgggtaccccttacggaacggggtaacttaccgttacgaacggtaacggaacgttacgtttaccgttcgtacggtaccgtaaacgttaccccggtaaacggtaccggtaaacgggaaaccgacccgtaacctaacccggttacccccgtacccccgttaaccgtaaccccgttaacgttttaacccggaccgggttaacccgtaacccggtaacggtacccggttaaccgggaaacccggtaaccgtaaacggtacgtttaacggttaacgttttaaaccgtttaaccgtttcggtaaccttaccggttaaccggaccgttaacggttacccggggaaacccgttacccggggtaccccgtttacggtaaccgggtttacgggttacccggggtttcgggggttttacccgggaccggggttaacgggtaaccccggtaaacgggttccggtaacccgggttaacccggttaccggttaaccgggtaccggtaaaccccggg

SEQ ID NO: 224447 - DNA, 848 bp, Homo sapiens
  misc_feature: GYAE6OF01C7ZSG.10.1.A01.1.454.CMB.1.raw
  modified_base (151)..(151): a, c, t, g, unknown or other
  misc_feature (151)..(151): n is a, c, g, or t
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcacatggagtttggctgagtcgtggtttcncgtgctcttagagtgtcagtgtacagtgcagngtggacggngtggagggggacgcggtcgtaccgcggtccgtggggtacgttcccgtaggacgtaccctcctccgttggtacggctaaccggtccttcggttcgggttacctacccgttataaccgttaccttagcggacctagttcggacccgtgttaccgggtcccgcccgaacgggtccgtaccgaacgggaaccgggttaaccgggggtcgggttacgggtacggggttcgggttcggtccgtttaacgtttaccgttaacgtgttaaagttacgttaaggttaaaaggttaaacggtttaaaagttttaagtttttaaacgtttcggaacgttaacccgtaaaccggtttaacccgggtaacccgggttaagggaacccgggttaccttaaaccgttacccgtaaccttaccgtaacccgtaccgtaaaacgaaccgttaaaccgtaacccgttacccggtaaaccctttaaaccccgtttaaccgtttacgtaaccgttaagaaaccgtaaacgtaaccgaaaccgtaccggacgttaagaccggtacgtaaccggtacgaaccgttacggtccgtttaactttaacggtttacgtcggtaagtacggaccgtacgaacgtcggacgttacgaacgttacgtttaacgtttaccgtttcg

SEQ ID NO: 224448 - DNA, 793 bp, Homo sapiens
  misc_feature: GYAE6OF01B5QAO.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcagtcggtccaggcgagggctgactcacgcccaccgtcggtactccgaaggtacttgacgacacgaccgccaacacctccacctcgacgacgtacggaaacaacaacgtaagtcggtacggaccgacggacggtacgttcggttggctgacgagcgacgacgaccgaccggacccacccgtaccgaacgtccctaccctccgtaccgaaccgaacgaactaaccgacccgtacccggacccgttacggaaccggtactaccgtaacgaaggtaacggtacgttaacgttccgtacgtaccgacgtaaccgtaccggtaacgggtaacgaacgggaaccaccgaaccgtaccggtaccccttacccggtaaccgtaaccttaaccgttaaccggtaccggtacccgttaccggacggtacctaacgggaaaccgtacgtaaacggtctttaaacggttaacttttacccgttacggtaccgtaccgttaaccggacgttacggtaaccggtaccgggacccgtacccgtcgttaacggcgggttaccggggtttaccgggtttcgggggttaccggaccggggtaaaccggtacccggacgttacccggttacggtaccccgggtttacaacccgggtcccgtaaacccgggg

SEQ ID NO: 224449 - DNA, 698 bp, Homo sapiens
  misc_feature: GYAE6OF01B1QIS.10.1.A01.1.454.CMB.1.raw
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctctcactcactctgcagtgtcagtggtccaggcagggctgactcagccaccctcggtactccaaggacttgagacagaccgccacactcactncactaggacaacanaatgtgccacgcggagtcgttggctgctagcagccaccgacgggcccaccccgtacccaacgtcctccgtccgtaccgacgaacgggaactaacgaccgtccggacccttacggacgggtactccgtacgaacggtacgacgtacgttctacgtcgtacgtacgtccgaagggttaccgaacgggtaacgaccgtaaccgtaacccgtccccgttaccccgtacgtaaccccgtaacgttttaccgacgggttaaccccgttaccggacgggtaccgttacggaaccggtaacggaacgtccgttagtaacgttttacgtaaccgtcgtacttaccgacggttaccgaggtacccggaccgtacccggtaccgtcgtacgggttcgtcgggttccgggtttaccgggacggggtacggtacccaacgggtcccgttacggaaccccgttcggtaacggtccgtaaccccggg

SEQ ID NO: 224450 - DNA, 633 bp, Homo sapiens
  misc_feature: GYAE6OF01CAXMC.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagcccaccctcggtatccaaggacttgagacagaccgccacactcacctgcactaggaacaacacatgtggccacggacggagtcgttgctgcagcagccacgacgggcccaccctcccaagcctcctctccgacagaactaacacgtcccgccacgaggctcacgagacgagtattcctctgctactccgaggtcgaaggaagccaacgacgtccccgttacccctaggaaccccttaagtttaccgtacgggacccttacccggaggtaccctacgggaaaccgtaacgaacgtccgttaagtacttttaacttaccgtcgtaccgttacgtaacgctaacggttccggggaaaccctacccggtcctacggttacggtccggttaccgggttttcggggtttacggaccggggtacggtaacccgaagtccggttacggaaccgtccggtaagggtccccgaacgg

SEQ ID NO: 224451 - DNA, 770 bp, Homo sapiens
  misc_feature: GYAE6OF01AMWS7.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcacgccacctcggtatccaaggtacttgagacacgaccgccacactcacctgcactgggaacaacaacatgtgccacgacggagtcgttggctgcagcagcaccgagggcccaccctcccaacgtcctcctacctccgaacgaggaaactaacctacgtcccggtccctacgacggggtactcgtacgaaggtaacgtacgtaatttccgttactcggtactaaccgttccggaacgggttaccgaacgggtaacggtccgaaccgaacggtcccccttacccgttacggtaaccccctaacgtttacccggttacgggtaaaccctacccgggaaaccgggtccgttaaccgggaaaccggtaaaccggtaaacgtaccgttaacggtttaactttaaacgtttacccgtacgggtactacccgttaacggaccctaagggtaccgggtaacccgaacccgggttaccgttaccggtaacgggtccggtttacccgggggtttacggggttttaccggggacccggggtaaaccgggttaaccgaaaccggttccggtaacccgggttaacccggttcccgtaacccgggttacggaaaccccggg

SEQ ID NO: 224452 - DNA, 721 bp, Homo sapiens
  misc_feature: GYAE6OF01AGBHY.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacatgtgccacgacggagtcgttggctgcagcacggaccaccgacgggcccacccctacccaacgtccctcccgtacctacccgaacgacggtaaactaaccgacgtccccggccctacgtacgggactccgtacgagacgagtacttcctcgtcgacctacgtaccgacggtacgtacggaacgtccgacgtaccgtcccctaccccgtacgaaccccttaacgttaccgtacggtaccctacccggtacggtccgtacggaacccggaaccggtaacgtcgttacgttaacttttacgttaccgtacgtaccttaccgtacggtaccgtaacggtaccgggtaacccggtacccggtcccgttacggtaccgggttacgggttccgggtttacgggggtttacgggacccggggtaaccgggtaacccgtaacgggtcccgttaacccgggttaccccggttaccgggttaaccggtcccggtaaaccccggg

SEQ ID NO: 224453 - DNA, 680 bp, Homo sapiens
  misc_feature: GYAE6OF01DPX89.10.1.A01.1.454.CMB.1.raw
tcagcatagtagtgcacgaccggtgctcgatttagacgtctcatcagggggctccaaacagagcttcagcaagcatagtgggaatctgcaccatgccctgggctctgctcctcctcgaccctcctcactcactctgcagtgtcagtggtccaggcgagggctgactcacgccaccctcggtactaccaaggtacttgagacacgaccgccacacctcacctgcacgtacgggaacaaacaacaatgttcggccacgacggacgttcgttggactacgagcagccaccgacggcccaccctacccaacgtcctccctccgtaccggaacgaacggaaactaacctaccgtcccggcccgtacgacggtactctacgagaagagtactttctcgtcgaccacgtaccgacggtacgaacggaacgcaacgtaccgtccctaccgtacgaacctacttacgtcggacctccggacggtacgtacggacgaacgtaacgtcttagtaactttactacgtcgtacgtacgacgcgtaacggtaccggacccgacccggtccgttacggacggttcgggtcggggttttcgggggtttaccggggaccggggtaacgggaccggtaacggtcggttacccggttaacccgggttacccgttacgggacccgtacggtaaccccggg

SEQ ID NO: 224454 - DNA, 808 bp, Homo sapiens
  misc_feature: GYAE6OF01D5P04.10.1.A01.1.454.CMB.1.raw
tcagcatagtagtgcacgaccggtgctcgatttagacgtctcatcaggggctccaaaacagagcttcagcaagcatagtgggaatctgcaccatgccctgggctctgctcctcctgaccctcctcactcactctgcagtgtcagtcggtccgaggcgaggctgacctcacgcccacccgttcggtactaccgaaaggtacttaggaacgaccgaacggaacccgaccaacctacctccaacctcgacctacgtaacgggaaacaaaacaaactaagtcggttacggaccgaacggacgggtacgttcggtttcggcgtcgacgacgcgacgaccgaaccgaccgggaccccacccgtacccgaacgtcccttcccgtaccgtaccgaacgaacggtaaactaaccgaccgtccccggacccgtacggaacggtacctccgaacgaacggtacgtacgttaacttcgtacgtacgacctacgtaccggtaaggtaccggtaacggaacgtaccgaaccgaccccggttaccccgttacccgtaacgtacccttaaacggttaccgtaccggtaccctacccggtacggtaccgtaaccgggtaacgaaccggtaacgtcgttaacgttactttaacgtttaccgaccggtactaccgaacgtacggtacggtaccggtaacccgtaccggttaccggtcgtaacgggttcggttaccggggtttcggggtttaccggaccgggggtaaccggtaaccggacggttaccggtaccgggtacccggttaccggtcggacccgtaacccggg

SEQ ID NO: 224455 - DNA, 879 bp, Homo sapiens
  misc_feature: GYAE6OF01DDSS9.10.1.A01.1.454.CMB.1.raw
tcagcatagtagtgcacgaccggtgctcgatttagacgtctcatcaggggctaccaaacagagcttcagcaagcatagtgggaatctgcaccatgccctgggctctgctcctcctcgacctcctcactcactctgcagtgtcagtcggtccaggcagggctgactcacgccacctcggtactaccgaaaggtcttagacgacacgaccgccaacactcaacctgccaacgtacggaaaccaaacgaactaagtcggttacggacctaaccggacggtacggttcggtttcggactcgcgacgacacgaccgaccgacgggacccaacccgtaccaacgtcctccctaccgtaccgaacgaacggtaaactaaccgacgtacccggtacccgtacgacggggtaactccgtaacgtaacggaacggtaacgttaaacggttttcctaccggttacggtaacccgtaaccgttaacccgggttaaacggggttaaccggtaaaacggggtaaaccgacccgtaaaccggtacccgtaccccccgtttacccgtaaaccgggtaaaccccttaacggtttaaacccggtcggttaaacccgtaaccggtaaccgggtacccggttaacggaaacccggtaaaccgggtaaccgtaacgtttaaccggttaacgttttaaacgttaccgtacgtaccgttaacggaaccgttacgtaacggttaacccggggaacccgtacccgggtacccttacggtacgggttacgggttacccggggttttaagggggttttacccgggaccgggggtaaaccgggaacccgtaacggtaccggtaacccggttacccgttaaccggtaccggtacggtaaaccccgggg

SEQ ID NO: 224456 - DNA, 718 bp, Homo sapiens
  misc_feature: GYAE6OF01AD8XO.10.1.A01.1.454.CMB.1.raw
  modified_base (333)..(333): a, c, t, g, unknown or other
  misc_feature (333)..(333): n is a, c, g, or t
  modified_base (400)..(400): a, c, t, g, unknown or other
  misc_feature (400)..(400): n is a, c, g, or t
tcagcatagtagtgcacgaccggtgctcgatttagacgtctcatcaggggctccaaacagagcttcagcaagcatagtgggaatctgcaccatgccctgggcctctgctcctcctgaccctcctcacctcactctgcagtgtcaggtggtcaggcagggctgactcgacgccctacctcggtactccgaaggcttggacgacacgaaccgcaccactccacctgccgacgtacgggaaccaacgaactaactcggttacggaccgacggacggtacggttcgttcggctgctacgcacggccaccgacgggcccaccgtccgaactccgtccnccgtaccgacacggtaacacgtacgtcccggcctacgacgactccagacgacgaacgtacttcgctnaccgtacgtcgacggtcgaacggtacacgtaccgaccgtccctaccgtacgtaacccgtaacgttaccgaacgtacccgaccgtaacggtcctacggacccggttaacgaagttccggtaaggtttaacttacggttaaccgtcggtaccttccgtaacggacccgttagtaccgggtaacccgtacccggtccgtaccggttaagggtcccgggttccgggtttacgggggttccgggaccgggggttaaccggaaccccgggaggtcccgggttccgtttaaaccggcccggtttaacgcccgggttaaacccggg

SEQ ID NO: 224457 - DNA, 771 bp, Homo sapiens
  misc_feature: GYAE6OF01ETX4I.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagagactcaccatgggtagtttgggctgagtcgtttgggttttcctcgttgtcttacgttttaaggaggttcgtccaggttcgtacaagtgccagtcgtggggcggtaggtcgggagggggacggtcggtcggtaccgaggtcccggtggggaccgtcccgtaggacgtccttcgtccgtggtcgacgtacgtccgttcggttcgggttacctaccttactaacttacctagtcggacacgtcgtaccgtacggtccgggtcccgaccgtacggccctaccggagggaccggaacggggtcggtacggggtagggttcgggggttcgtaccgtttaccgtttagttctacgtaagttagtaaggttaagtttaaggttaaaaactttaagttttaaagttttagacgtaacgtaacggttaccgttaaccgggttaagggaacccggttcgttaacgtaccgtaaccctctaccgtaaccgaaggaactaaacctaaccgtacccgaaacgtaccccgttacgtactacgtacctagaaccgtaagtagacctacgtacgagacgtagactaacggaaccgtacgtacgttcttaaggtttacgtacgtggtacgacgtaacgaggtccgaacgtatcgttaaccgtagttttaaccg

SEQ ID NO: 224458 - DNA, 783 bp, Homo sapiens
  misc_feature: GYAE6OF01B27Q1.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcaggtggtccgaggcgagggctgactcacgccctacccgtcggtactaccgaaggacttgacgacacgacccgccacacctcacctgaccacgtacgggaaccaacaacgtaagtcggttacggaccgaacggtacgggtacgttcggtttggctgacgacgcacgcaccgacggcccaccctaccacgtcctcctccgtaccgaacgacggtaactaacgaccgtacccggcctacggacgggtactaccgacgacggtaacgtacgtacttcctacgtacgtacctacgtaccggacggtaccggaacgggaaccgccgaacccgtacccggttaccccgttacccgtaacgtaacccttaaccggtttacggtacccgggtaacccgtccgggtaaccgggtaccggttaacccgggaaaccggttaacggtaccggttacgttaacggtttaacttttaacgttacccggtacggtaccgtacggacgtaccggtaacgggtacccgggtaacccgtaccccgggtacgtaccggttagggttcccgggtttacggggttcggggtttacccggggacgggtaaccggtaccgtacggtacggtacccggtaccggtacggtcggtaccgtacccggg

SEQ ID NO: 224459 - DNA, 683 bp, Homo sapiens
  misc_feature: GYAE6OF01BVQ0D.10.1.A01.1.454.CMB.1.raw
  modified_base (462)..(462): a, c, t, g, unknown or other
  misc_feature (462)..(462): n is a, c, g, or t
  modified_base (621)..(621): a, c, t, g, unknown or other
  misc_feature (621)..(621): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcaccatggagtttgggctgagcgttgggtttttcctcgttgtcttacgtttttaagaggtgtccagtgtcaagtgcagcgtggcggagtcggtgggggaggcggtggtccaggccgtggggacgtccctgacgcctctccgtgtcgcacgtccttcgttcgggttacctaaccctttacaaacttacctagtcggactagtcgacctacggtccgggtcccgccgacgggtcctaccggagggaccggaagggggcgttgggagggttggggtcggtcctttcgttaacgtctactaagttagtagtaagttaaggtaaatttaagttttaaattttagngtactacgtaccgtaccggtaggaacgggtcctattaccactactccgtaccgaaggtaactaactaacgttacccgaaacgtaaccctacccgttatactacgtagaactaaagacgtaacgcgtactaggacgtacgagtacgacgtacgtacgttntttacgtttaactgttacggtcgaccgtagacggtacgcaaggtccttaagtacctttaacg

SEQ ID NO: 224460 - DNA, 851 bp, Homo sapiens
  misc_feature: GYAE6OF01DFQEW.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcagtcggtcaggcgaggctgactcgacgccctaccgtcggtactaccgaaggtacttaggacgaccgacgacccgaccaacacctaccaccgtcgaccgacgtacggaaacaaacgaaacgtaacgttcggttacggaccgtaacggacgggtacggttccggtttggaccgtacgacgacgcgacggaccgacccggaccgggacccctaacccgtcccgaaccgtcccttacccgtaccgtacccggaacgtaacgggtaaacctaacggtacccgtaccccgggtaccctaacgggacgggtaaccttccgtaacggaacggtaacggacgtttaactttcccgtcgttaccggactaaccgttaccggtaacggtacggaaacgggaacacccggtaccgacccgttaccccgttacccgttaacgttaacccgttaacgttacccggttaacggaacccgtaccggacggtaaccggtaccggaaaccgttaacggacggttaacgttagtttaaaccgttacggtttaccgaccgttaccgtacggaccgttaacgaacccggggtacgggaaccccgttacgggtcccttacgggtacgggttccgggttacggggtttaccggggttaccgggtacggggaaaccggtaccgtacggtaccggtacgggtaacccgttcgggtaaccggccgtaaccccggg

SEQ ID NO: 224461 - DNA, 832 bp, Homo sapiens
  misc_feature: GYAE6OF01DX1B2.10.1.A01.1.454.CMB.1.raw
tcagcatagtagtgcacgaccggtgctcgatttagacgtctcatcgaggggctccaaacagagcttcagcaagcatagtgggaatctgcacatgccctgggctctgctcctcctcgaccctcctcactcactctgcagtgtcagtggtccgaggcgagggctgactcacgcccacccgtcggtactaccgaaggtacgtagacgacgacgacccgccaccactacacctcgcacgtacggaacaacaacagtgttcgaccgacggacggtagttcgttaggctgacgacgcgacgccgaccgacggcccacccgtaccacgtacctcccgtaccgtacccgaacgaacggtaaactaaccgtaccggtaccccggacccgtacggaacgggacttaccgtaaccggaaggtaacgtaacgttacgtttacgtctacggaccgtacgtaccggtacgtacggaaccgggtacaccgaaccgtcccggtaaccccttcccgtaaccggtaaccctttacggttaaccgttaccgggtacccgttaaccgggagggttacccgtaacggaacgggtaaccgttaaggacccgtttacgtttaaacgtttacgttacccgttagtaccgaacggtaccggtacgggtaaccggtaccgggaaccctccccgggttacgcgggtttaaccggggttcccgggggtttcgggggttttaaaccgggggttcccggggaaacggggtaacccggggtaaccgttaaccggggttcccggtaaaccggggttacccccgtttaaccgggggttacccgtaacccggttaaacccccgggg

SEQ ID NO: 224462 - DNA, 744 bp, Homo sapiens
  misc_feature: GYAE6OF01CXES4.10.1.A01.1.454.CMB.1.raw
  modified_base (450)..(450): a, c, t, g, unknown or other
  misc_feature (450)..(450): n is a, c, g, or t
  modified_base (597)..(597): a, c, t, g, unknown or other
  misc_feature (597)..(597): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcacctcactctgcagtgtcagtggtccaggcagggctgactcacgccaccctcggtactaccgaaggtacttgagacacggaccgccacacctcacctcgacacgtacgggaaacaaacaactaacgtcgttacggccgaacggtaccgggtacggttcggtttggcctcgcgagcgacgccgaccgaccggggaccccaacccctcccgaaacggtcccttccctaccgttaccggaaccgaaacgggtaaaacttaaaccgaccgttaccccggaccccgtacggacggggtactacgtacgacggaagaacgttacgtttaccncgtctactacgtaccgaaggttacgaagggacgacgaacctacgaccctaccgtacgaccttacgttaacgtacggtaccctaccgacggtaccgtagaaccggtaacgtacgacttagtacgtttaactacgtacgtacctcgaanaccgtacggtacgggaccgtacccggtcgtaccggtagggttcggtcggggtttcggggtttaccggggacgggggtaaccgggtaaccgtaacggtccgggttaacggtacccggtttaaccggtacgggttaccgtaaacccggg

SEQ ID NO: 224463 - DNA, 628 bp, Homo sapiens
  misc_feature: GYAE6OF01EPL3Z.10.1.A01.1.454.CMB.1.raw
  modified_base (351)..(351): a, c, t, g, unknown or other
  misc_feature (351)..(351): n is a, c, g, or t
  modified_base (380)..(380): a, c, t, g, unknown or other
  misc_feature (380)..(380): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcagctggcggagtcgtgggggagcgtggtccagcctgggaggtccctgagactctcctgtgcagcctcgtgggttccaccttcaatacctatggcatgcacgtcgggtccgccgaggcctccgaggcgaagggctggaggtggtggctacttatctctatntagagtaggtaaattagtttaaattttangtcgagtaccgtcggtaggaacgggccctagttaccaaccgtcttcctaccgaagacgtaacctaagttacccgaaggtaaccctacccgttagtaacttaccgtagaactaaacgaacgaaccgtagacccgtagaaggacgaccgtaggacccgtacgaccggttacgtttagtttaacgttaccgttgggtaccgtaccgaaggtaacgtacgtacgaagtcgttacggtaacttttaaacccgg

SEQ ID NO: 224464 - DNA, 308 bp, Homo sapiens
  misc_feature: GYAE6OF01AF8FS.10.1.A01.1.454.CMB.1.raw
  modified_base (302)..(308): a, c, t, g, unknown or other
  misc_feature (302)..(308): n is a, c, g, or t
tcagcatagtagtgcacgaccggtgctcgatttagacgtctcatcagggatctcagagagattctctgcatccaggtcaggaagcacagcctccctgaccattactggactccaggctgacgacgaagctgattattacgtgctcagcagtcgggacacccggcctcaggtgtcggttgggttttcggcggagggaccaagctgaccgtcctaggtcacggcccaggctcgcccctcggtcactctcgttccccaccctcctccactactatgctggacgcgggctggcaaggcgcagtagnnnnnnn

SEQ ID NO: 224465 - DNA, 695 bp, Homo sapiens
  misc_feature: GYAE6OF01C3BC5.10.1.A01.1.454.CMB.1.raw
  modified_base (385)..(385): a, c, t, g, unknown or other
  misc_feature (385)..(385): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcgagggctgactcacgcctacccgtcggtactaccgaaggtacttgagacacgaccgccacactcacctgcacgtaggaacaaacaacaagtgttacggccaacggacggtagttcggttgcgtcgcgagcacgcgaccgacgggacccacccgcccaacgtcctccctcctccgaacgaagaactaaccgacgtcccggccctcgaacggtctcgacagacgtagtacttcncgtcgctacacgtacggtacgaacggtacgaccgaacaccggtaccttacccgtacgtaaccgtaacgttactacggaccgttaccgaggtccgtaacggaacgaacggtaacgtacgtacgtactttaacgtttagtacgtacgtacgacgtacgtaacgggtaccggtacccggacccgtaccgttcggtacgggttcgggttccggggttttaggggtttacccggggtacggggaacgggtaaaccggtaacggtaccggttacccgggtacccggttaccggtaacgggtccggtaaaccccggg

SEQ ID NO: 224466 - DNA, 727 bp, Homo sapiens
  misc_feature: GYAE6OF01CZ3J1.10.1.A01.1.454.CMB.1.raw
  modified_base (152)..(152): a, c, t, g, unknown or other
  misc_feature (152)..(152): n is a, c, g, or t
  modified_base (210)..(210): a, c, t, g, unknown or other
  misc_feature (210)..(210): n is a, c, g, or t
  modified_base (409)..(409): a, c, t, g, unknown or other
  misc_feature (409)..(409): n is a, c, g, or t
tcagcatagtagtgcacgaccggtgctcgatttagacgtctcatcaggggctccaaacagagcttcagcaagcatagtgggaatctgcaccatgccctgggctctgctcctcctcaccctcctcactcactctgcagtgtcagtcggcaggnagggctagactcacgccctaccgtcggtactaccgaaggtacttagagacacggaccnccacactcacgtgacacgtaggaacaaacaactaaagtcgttacgaccgaacggacggtaggttcggtttggcgtcgacacgcaacgacgaaccgacggaccaaccctaccaacgtacctcctacgtaaccgaacgaacgaaactaacacttaccggccctagacgggtactcgtacgaaggtacgaagtacttcctanacgactacgtacccgtaaggtaccggaaagtaacggaccaaccgtaaccgtaccccgttcccgtaactaaacccgtaacgtttaaccgacgggtaaacctccggaacgttaccgtaacggaacgaaccggtaaacgtacgtagttaacttttaacgtaaccgttaggtaccttacgacggtacgtaacgggtacgggtaacccgtaccggtaaccttcggtaaaggtcggttcgggttacggggtttacggggacgggaaacgggttacgaaaccggttcgttaacccggacggttacccgtaggttaccgaacccgg

SEQ ID NO: 224467 - DNA, 973 bp, Homo sapiens
  misc_feature: GYAE6OF01CLRUQ.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgacctcctcactcactctgcagtgtcagtggtccaggcagggctgactcacgcccacccgtcggtataccgaaggtaccttggaacgacacgaccgccactacctacacctgaccgaacgtacgggaaacaaaccaacgtaaagttcggttacggacccgaacggtaaccggggtacgtttccggttttcgggaccgttacggaccgaacgacgacggacccgaaacccggaccgggacccccctaaccccgttaccccgaaaacggtcccttccccgttaacccgttaccggaaccgtaaagggtaaaccttaaaccgaccgtaccccgggtaccccgttacggaaccggggaactttacccgacggtaacggtaacggaacgtttacggtttccctacgtttaccgggaacctaaccgttcccgggtaaacgggttaccggaaaccggggtaaaccggaccccttaaaccgggtaccgttacccccccgggttaaccccctacgggttaaaaccccctaacggttttttaacccggacgggtaacccccgtttaccggaaccgggttacctaaacccggggaacctaaacgggtaaccgtaaccgtttaacgttaacgtttttaacccgttaccggttacgtaaccctttaccggaacgttacccggttaaacgggtccccggggtaaacccgttacccgggtaccttaccgggtaccgggtttacgggtttaccggggggtttttacccgggggtttaaccggggcccgggggaaaacgggttaacccgcggttaacccgggtaacggttaccccccggtttaaaccgggttcgggtaaccccgtaaaccccggg

SEQ ID NO: 224468 - DNA, 775 bp, Homo sapiens
  misc_feature: GYAE6OF01BG5GC.10.1.A01.1.454.CMB.1.raw
tcagcatagtagtgcacgaccggtgctcgatttagacgtctcatcaggggtctgggagaggagcccagcactagaagtcggcggtgtttccattcggtgatcagcactgaacacagaggactcaccatggagtttggctgagtcttgggttttcctcgttgcttctttaagaggtgtccagttgtacaagtgcaggcgtgggacggtagtcggtgggggaggtcgtcgggtaccaggtccggtggggtacggtccctaggacgtacttcctccgttggtgaccgtacgtcccgttcgttacgggttccctaacccgttactaaacttaacctagtcgggtactagttacgacgtaccggttacggggtacccgccgtaacgggtccgtaccggaaggaccgggaaacggggtccgtaaggggtaacgggtcggggtacggtccgttacgtttaacgtaccgttataagttaacggttaggtaacggttaaaggtaaactttaaggttttaaaatttaagtcgtaacgtaagttaacgtaccgggtaaggtaaccgggtccgtaacgtaccgaacgttactaccgtaacgaacggtaacgtaacgtaacgtaaccgtaaccggaaacccgttaccgtacgtaactctaacggtaacaagttaacgaaccgtcggaacgtagaacgtagaccgtagtaaccgacgttacgtacgttagttacgttacgtggtacgacgtacgaaacgtacgacgtagtactaaacgttctttaacgg

SEQ ID NO: 224469 - DNA, 598 bp, Homo sapiens
  misc_feature: GYAE6OF01AYW60.10.1.A01.1.454.CMB.1.raw
  modified_base (290)..(290): a, c, t, g, unknown or other
  misc_feature (290)..(290): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggcttgagacagaccgccacactcacctgcactggaacaacaacaatgttggccacgacggagtcgtttggctgcagcagcaccagggccaccctccaagctcctcnccgacaggaactaacactccggccctcacgggactccgtacacgagagacttcgtctgcactccgaggtaccaaggtaacgccacgacgtcccctaccctgtaacccctagtttaccgcggactacccgaggcctacggacgacgaaacgtctacgtaacgttacttacgtgccttacgacgtactagtaccgggacctacccgggacctcgtaacgggtcgtccgggtttcggggtttaccggcgggtaacgggacccgtaacggtcgtaccggtacccggttacccgtacgggtcccgaacccggg

SEQ ID NO: 224470 - DNA, 778 bp, Homo sapiens
  misc_feature: GYAE6OF01CA5SM.10.1.A01.1.454.CMB.1.raw
  modified_base (717)..(717): a, c, t, g, unknown or other
  misc_feature (717)..(717): n is a, c, g, or t
tcagcatagtagtgcacgaccggtgctcgatttagacgtctcatcgagggggctaccaaacagagcttcagcaagcatagtgggaatctgcaccatcgccctgggctctgcctcctcctcgaccctcctcactcactctgcagtgtcagtcggtaccgaggcgagggctgactcgacgccctaccgtcggttacaccgaaggtaccgttaggaacgaccgaacggacccgaccacgaccgtccaaccgtgccgaacgtacgggaaaccaacaaactaagttgtacggacccgaacggtacgggtaacgtttcggttcggaccgtacgcgaacggccgacggtacccgaacccggaccggacccaccccgtacccgaacgtccctaccctaccgaccgaacgtaacggaaacctaccgacgtccccgaccgtggaacggctacacgagtagatcctcgtacacgtccgaacgttccggaagtacgaacgggacctacgaacgacccggtaccctaccgtacgaacccgttaacgttaaccgaccgttactaccggaggtcctaacggaacggtaacgacgttacgtagttaactttaccgaacgtccgacgtaccacggtagtacccgggtcggaaccccgtcggtacgtccggttggttaccggggtttacgggttaccggggttaccgggaaacccggggaccgggttaaaccccnggggttaaccccgttaccgggttaacccgtacccgggtaccgtaacccggtaaaccccggg

SEQ ID NO: 224471 - DNA, 827 bp, Homo sapiens
  misc_feature: GYAE6OF01ELYF2.10.1.A01.1.454.CMB.1.raw
  modified_base (688)..(688): a, c, t, g, unknown or other
  misc_feature (688)..(688): n is a, c, g, or t
  modified_base (737)..(737): a, c, t, g, unknown or other
  misc_feature (737)..(737): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggtaggtttgggctgagtcgttgggttttccttcgttcgtcttcgtttaagtaggtgtcctagtgtcaaggttttttttcgagcgtggcggtacggtcggtaggggtaggcggtcggtccgacggtccggtgggtacggtcccgtgtacgtaccgtccgttccgtcggtcgtccgacgtacccgttccggttccgggttacctacccgttacctaacttaaccgtagtcggtacgtacgtcgtccgtaccggttccgggtacccggtacccggtaccggtacccgtacccggaacgggtaaccgggtaacgggggtcggtacggggtacggggttcggggttcgggttccgttaccgttaaccgttacccttacgttaacgttaagttaacggtaaggttaaaggtttaaaagtttaaaggttttaaaacgttttaagtacggtacgtaacgtaaccggttacggttacgggtaacggtacccgtaactttaccgaacccgttagttcccgaacaacggtaacgtaaccttaaccgtaccggaaccgtaactaccccgttntaactctaacgtaactaaacgtcgaaacgcgtaacgtagacgtagtacncggtaactaccgtcggtactttaaggttcttacggtacgtcggaccgaacgaggtaccctagtaacttacggtcttaaaccgttttaacg

SEQ ID NO: 224472 - DNA, 811 bp, Homo sapiens
  misc_feature: GYAE6OF01CLJGB.10.1.A01.1.454.CMB.1.raw
  modified_base (97)..(97): a, c, t, g, unknown or other
  misc_feature (97)..(97): n is a, c, g, or t
  modified_base (277)..(277): a, c, t, g, unknown or other
  misc_feature (277)..(277): n is a, c, g, or t
  modified_base (529)..(529): a, c, t, g, unknown or other
  misc_feature (529)..(529): n is a, c, g, or t
  modified_base (600)..(600): a, c, t, g, unknown or other
  misc_feature (600)..(600): n is a, c, g, or t
tcagcatagtagtgcacgaccggtgctcgatttagacgtctcatcaggggctgggagaggagcccagcactagaagtcggcgtgtttccattcggtnatcagcactgaacacagagactcaccatggagtttggctgagtcttgggttttcctcgttgcttacgttttaaggacggttgttcccaggttacgttaccaaaggttgaccgagtccgtaggcggtaacgtcgtggggggaatcgtacggttccgaggtccgtaggggtcggttaccccngaacggtaaccttccggttcccgtaggtcgtacctaggtacccttcggttacgggttacctaacccgttttaacgaacgttaacccggttagtccggactacgttacggcctaccggtacgggttcccgacccgtaaggtcccgtaccgacgggacgtaaacgggggtccttaggggagtcggggttacgtactttcgtaatcccgtacgtaagtcgttgaaccgttagtaaacgttgttttaaaacgtttnaccgtacgtacgtacgttccggttaggaaccggtaccgatttacccacgttacttccgtacctaaagggtntaaacccggtagttaccccaaggtacccgtacttggtaactgtaacgtaacaattacggaaccacggttcctagacggtacccgtgtaaccggtacgacccgttacggtacgtaacgggtttttcctacccggttaggtacccggttaccaaaccggggttagtaaccggtcggtaaacccggttaacgtccgtttaaacccgttaacggg

SEQ ID NO: 224473 - DNA, 728 bp, Homo sapiens
  misc_feature: GYAE6OF01EYJY2.10.1.A01.1.454.CMB.1.raw
  modified_base (639)..(639): a, c, t, g, unknown or other
  misc_feature (639)..(639): n is a, c, g, or t
  modified_base (719)..(719): a, c, t, g, unknown or other
  misc_feature (719)..(719): n is a, c, g, or t
tcagcatagtagtgcacgaccggtgctcgatttagacgtctcatcaggggctccaaacagagcttcagcaagcatagtgggaatctgcaccatgccctgggctctgcctcctcctcgaccctcctcactcactctgcagtgtcagtggtccaggcgagggctgactcacgccctacccgtcggtactaccgaaaggtacttggaacgaccgaccggacccgacccaacctaccgtaccaccgtcgaccgtaaccgtacgggaaaaccaaacgtaaactaagttcggttcggacccgaacggtacgggtacgttcggtttggactgacgagcgacgacccgaaccggaccgggcccccaaccccgtacccgaaacggtcccttaccccgtaccgtacccggaacgtaaacggtaaaccttaaccgacccggttccccggacccttacgggaacgggtacctacgtacgaaggacgtaacgtacttaccgtactcgaccctacgtaccggacggtaccgtaacggacgaccgtaaccgcccgtacccgtacccgtaacgtacccttaacgtttaccggacgtacccctacggtacgtaccgtaacggaaccggaactaacggtctagttaacttcgttacncgtactcgatacgacggtcgaccctgcctaggcgttcggtcggttagggtacggcggtacgacacgtcgtacgacgtcgngtcgaccgg

SEQ ID NO: 224474 - DNA, 609 bp, Homo sapiens
  misc_feature: GYAE6OF01A368T.10.1.A01.1.454.CMB.1.raw
  modified_base (396)..(396): a, c, t, g, unknown or other
  misc_feature (396)..(396): n is a, c, g, or t
tcagcatagtagtgcacgaccggtgctcgatttagacgtctcatcaggggctccaaacagagcttcaggcaagcatagtgggaactactgcaccatgccctgggctctgcctcctcctgaccctcctcactcactctgcagtgtcagtggtccaggcagggctgactcagcccaccctcggtactccgaaggcttggagacagacccgaccacacctcacctgcacgtgggaacaacaacaatgtcgaccacggacggtagtcgtttggctgcagcagcaccacgggcccaccctccaacgctcctctaccgacaggaactaacacgtcccgacctacgaggactctcgagagagtacttctcgtgacacgtcacggtacgaggaacgcacgaccnccctccgacgtaccctacgttacgagtacctaccgaggtctacgaacggacgaacgtcgtagttacttactacctcgtctacgagtacgtaggtaccggaccgccggtaccgttagacggttcggtcgggtttccgggggttacgggccggggaacggtaaccggaacgtccggttaccggacccgttccgtaacgggtcccgtaacccgggg

SEQ ID NO: 224475 - DNA, 794 bp, Homo sapiens
  misc_feature: GYAE6OF01BG7I6.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcgagggctgactcacgcccaccctcggtatccaaggacttgagacgacgacccgaccacacctccacctgacacgtagggaaccaacaactaagtgttacggcccgacgacggtagttcgttggctgcagcagccaccgacggccctaccctcccgaagcccttcctaccgtcccgaacgtacggaaactaaccgtaccgtacccccggccctacggacgggtaccttaccgtaccgaaggtaacgtaacgtactttacccgtgtacgggtaccctaacgtaccggtacgggttaaccggaaggtacgaccctaaccgtaccggtccccctacccgtacgtaacccgtacgtttaaccgtacgggaaccccttccgaaagggttcccgtaacggtaacccggtaacggtaacgtccgttaacggttaaccttttacggttaccgtaccgtaaccggttaaccaccgggtaaccgtaccgggtaccgggtaacccctaacccgggttccgttaacggtacgggttccgggttacccggggtttttgggggttacccggggaccggggttaaccggtaaacccggcgggtttacccggacgggttaaaccccggttcgttaaacccggggtacgaacccccggg

SEQ ID NO: 224476 - DNA, 767 bp, Homo sapiens
  misc_feature: GYAE6OF01BQ5NT.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccagtggtagtttggctgagtcgttcgggtttttcctcgttgtcctttacgtttttaaggaggttcgtcctaaggttgtacaaggttcgacaggtcgtaggggccgggtaggttcgggtggggggagtcggttcggtccgacggtccggttagggggaccgttccccgtaggtaaccgtccttccgtccgtggtcgaccgtacgtcccgttcggttcggttacctaccttactaacgttacctaggtcggactagtcgaccgtacggtccggggtcccaccgacggtccgtaccggaggaccggaaggggtcgtagggtagggttgggtacgtccttacgttacgtcgttaacgtagtaacggtagttaaacgttaggttaaaactttagtttaaaactttgacgtacgtaacgtaccgtaggtacggaacggtccgtactaccaccgtaatcccgtacgaagtaacgtaacctaacgtaccgaacgtaacctaccgtgtaactcgtaagaactaacgtacgaacgtacgtaccgtagacgtcgacaaccgtacgtaacgtcttacggtttacgttacgttcgacggtacccggtagaaccctaagggtactacgtaagttcgtaacgtttaacctttaaacgg

SEQ ID NO: 224477 - DNA, 670 bp, Homo sapiens
  misc_feature: GYAE6OF01CKG8D.10.1.A01.1.454.CMB.1.raw
  modified_base (532)..(532): a, c, t, g, unknown or other
  misc_feature (532)..(532): n is a, c, g, or t
  modified_base (550)..(550): a, c, t, g, unknown or other
  misc_feature (550)..(550): n is a, c, g, or t
  modified_base (574)..(574): a, c, t, g, unknown or other
  misc_feature (574)..(574): n is a, c, g, or t
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcagtcggtccaggcgagggctgactcacgccctacccgtcggtactacccgaaggtacttagacgacgacgaccgccacacctcacgtcgctacgtacggaacaacacgtaagtcgtcgaccgacggtacggtacgttcggtttaggcctgacgacgcgacggccaaccgacgggacccctacccgaccgaacggtccctaccctccgtaccgaacgtaacggtaaacctaaccgacccgttaccccggacccgtaaggtaccgggtacttcccgtaacgaaggtaacggtacttaccgtttccgtaccttacgacccgtacgttcccggaaaggtacccgaagggtaccaccggaactccggccctacgtacgtaactctaacgtcgacnccgagtctggacagactnagtatacttcagacgtgacgacgngtaccggaacctcgtcgagtcgttcggtcgggtttcggggtacgacggggtacgtaccgaggttccggaccgtaccggtccagggtcctaacccgg

SEQ ID NO: 224478 - DNA, 662 bp, Homo sapiens
  misc_feature: GYAE6OF01CJ6YV.10.1.A01.1.454.CMB.1.raw
  modified_base (174)..(174): a, c, t, g, unknown or other
  misc_feature (174)..(174): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
  modified_base (497)..(497): a, c, t, g, unknown or other
  misc_feature (497)..(497): n is a, c, g, or t
tcagcatagtagtgcacgaccggtgctcgatttagacgtctcatcgaggggctgggagaggagcccagcactagaagtcggcggtgtttccattcggtgatcagcactgaacacagaggactcaaccagtggagtttggctgagcttgggttttcctcgttgcttctttaaggngtgtccagtgtacaagtgcagctggcggagtcggtggggagcgtggcccaggccgtgggacgtccngatctcnctgcgcncgcctgtcggtctaccttanaactacctgtggctagtgaccgtacggtcgggtacccgacgacggtcccgtaccggacgggtaccggaacgggggtcgtaggggtacggggtcggggtcggtccttactttacgtcttactagtatagtaagtaaggtaaactttaagtttaatttagtcgacggtacgtaccgttacggtacggtaacggtaccgtacttacccgaccgtactcctacgganaacgtaactaaccgttaccgaacgtaacctaccgtatactcgtaagaactaagacgtaacgacgccgaagtacgacgtacaacggtacctacgtaccgtcgtttagtttaccgtacgttggtcgtacgacgtagaccgtacgacgttactgttaccgttttaacg

SEQ ID NO: 224479 - DNA, 671 bp, Homo sapiens
  misc_feature: GYAE6OF01CBK2X.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgcctcctcctgaccctcctcactcactctgcagtgtcagtggtccaggcgagggctgactcacgcccacccgtcggtactaccgaaggtacttagacgaccacgaccgccacacctcacctgcctacgtacggaacaacaactagtgttacggaccacggtacggtagttcgttggcctgcagcacgaccaccgaccgggtacccaccccgttacccacgtcccttcctaccgtaccgaacgaacggtaaacctaaccgtaccgtaccccggcctacgacggtactccgacgtaaggacgtagtacctttctacgtcgactacgtaccgtaggtaccgacggaactcccaacgtccgtcccgtccgaactaccgtacgtttaccgcggtacctccgacgtcgtacgaacgtcgaacgtactacgtactttactacgctacgtacgactcgacgggtaccgaccgcccgtcgtacggtacggttcgggtcggggtttcgggttacgggtaccggaacggtaccggtaacgtccgtaccggtacccgtggtacccgtcgtaaccccgg

SEQ ID NO: 224480 - DNA, 787 bp, Homo sapiens
  misc_feature: GYAE6OF01CE0ID.10.1.A01.1.454.CMB.1.raw
  modified_base (315)..(315): a, c, t, g, unknown or other
  misc_feature (315)..(315): n is a, c, g, or t
tcagcatagtagtgcacgaccggtgctcgatttagacgtctcatcaggggctccaaacagagcttcagcaagcatagtgggaatctgcaccatgccctgggctctgctcctcctcgacctcctcactcactcgtgcagtgtcagtcggtccaggcagggctagacctacgtcgacccacccgttcggtactaccgaaacggtacttcggaacgaccacgacccgacaccgtactaccacctcgaccgtacgtagggaaaccaacaactaaggtcgttaccggaccgtacggtaacggtacgttcggttcgtcgtnacgacgtacgacgaccgaccgaccgggacccctaccccgtaccgtaacgtccctaccgttacccggtaccgaacgaaacggtaaactaacccggtaccgtacccccgggtaaccttaccgggtaaaccgggtctaaccggttacgaaacgggtacgttaacggttactttaccgtcgtacgacgtaaccgtccggtaggtacgaacgggtacaccgacccgtaccggtccctaacgtccgtaaccgttaacgttaaccggtacgtcccgtaccgaccggtaacgtaccgaaacggtcaaacgtcgtactttaacggttactacggttacgtccggtaactacggtcgtaacggtaccgggtaccctacccggtacggtcgttaccggttcggggtttccggttaggggtacccggacgggttaacggacggtaccggttactcgggtaacccgttcgtacggacccgtacgg

SEQ ID NO: 224481 - DNA, 825 bp, Homo sapiens
  misc_feature: GYAE6OF01EGD6T.10.1.A01.1.454.CMB.1.raw
  modified_base (177)..(177): a, c, t, g, unknown or other
  misc_feature (177)..(177): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcacatggagtttgggctgagtcgttgggttttcctcgttgcttactttttaaggnggttgtaccagtgtacaagtgacagcgtggcggagtcggtgggggaggtcgtggtccagtccgtgggacgtccctgacgaccttcgtccgtgtcgccgacgtcccgttcgttcgggtttacccaccccgtttactaaacttaccttaggttcggtcctaagttcgacccgtacggttccggggtccccgccgacggtcccgtacccggaagggaccggaacggggtccgtaggggtagggttcgggggttcgtaccgttacgtttaactccgttactaagttagttaaggtaacgttaaggttaaaagttttagttttaaaattttacggaggtaaccgtaaacggtacccggttaccgggtaacgggtaaccgggttaccgttaacgtttaccccaaccgttaacgttacccgtacccgtaaaggtaaccttaaaccgtaaccgttaacccgaaacggtaaaccctacccgttagtactacgtagaaactaaacgtaaccgtaaacgcgtacgtaggaacgtacggaccgtacggaaccgtaacggtacccggttagttttaacggtttaaccgtttaggttacggtaccggaaccgtacgtaacggacgtacgtaaggttccttaaacggttacttttaaacccgg

SEQ ID NO: 224482 - DNA, 758 bp, Homo sapiens
  misc_feature: GYAE6OF01A46N4.10.1.A01.1.454.CMB.1.raw
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcaggctgactcagccaccgcggtatccaaggacttgacgacagaccgcacactcactgcactggaacacaacatgtcgccacgagagtcgttggctgnagcagctaccgaggccaccccgtccaacncctcctctccgacaggaaactacgacgtcccggacctacgtacggactccgtacgaacggtaacggactacttcgtacgttacgccacctccgtaacgggaccgtaacggaaacgtacccaacgtaccgaccccgttacccgtacggtaaccccttaacgtttaccgtccggtaaaccgtaccgtaaacggtccggtaaaccggaaccggtaaaccggaaacgttacctaacgggtttaaccgttttaacgtttaacccgtacgggaaccctttacggacgtacccggttaagggtacccggggtaaaccccttaacccgggccccgttaaagtaccgggggttaccggttaccgggggttttacccgggggggttttaccggcggggggtaaacccgggtaacccgtaagggttacccccgggtttacgggtaaacccccggttccgggttaaccgggggttaccaaaccccgggggg

SEQ ID NO: 224483 - DNA, 820 bp, Homo sapiens
  misc_feature: GYAE6OF01AN7OL.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcgacgcccacccgtcggtatccgaaggtacttgacgacacgaccgccaccactcacctgccacgtagggaaccaaacaacaagtggttcgaccgacggtacggagtcgtttggctcgcgagcgacgcctaaccgacgggacccaccccgtacccaacggtccttccctccgtacccgaacgtaacggaaacttaaaccgaaccgttccccggcccgtacgaacggggtactacgtacaagggaacgacgtacttacctcgtacgaccgtacgtacccgtacgggtacgaacgggacgaccgaaccgacgtcccccgttacccgtacgtaaccccgttaattaccggtaccggtaacctcccggtaacggtaccttaaccggaaccggtaaccgaaacggttcttaaccgggttaattttaaaccgttaccgtaccggttacccgagttacgggaacggtacggttaccccgggaaccgtaccccgggttccgtaccggtaacgggttccggggtttacccggggttttaccggggggtttacccggggtaacggggggaaaccccgggtaacccccggttaaacggtacccgggtttaaccccggggtaaccccccgtttacggggttaaacccggttcccggtaaaacccccgggg

SEQ ID NO: 224484 - DNA, 680 bp, Homo sapiens
  misc_feature: GYAE6OF01CFELP.10.1.A01.1.454.CMB.1.raw
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (588)..(588): a, c, t, g, unknown or other
  misc_feature (588)..(588): n is a, c, g, or t
tcagcatagtagtgcacgaccggtgctcgatttagacgtctcatcgaggggctccaaacagagcttcagcaagcatagtgggaatctgcacatgcccgtggctctgctcctctcgacctcctcactcactctgctagtcgtacaggtggtaccgaggccgagggtcctagtacctacgaccgtaccctacccgttcggtaacgtaccgaaggtacttagacgacacggacccgaccaacacctaccactgaccgacgaacggaaacaaacgaatacgtggtcggaccgaacggacggtagttcggttaggctggaccgagacacgacctacggacggaccccaccctaccgaagccctaccgtacgtacgaacgaggtaaaccaacgtaccgtcccggacctaggtacggntccgacgaagngtaacttcttacgtctaggacctacgtaacggtacggtacgaacgggtacaccgtaacggacccgttacccgtaccggtaacgtaactaccgttaacgtaccggtaccctacggacggtacgtaacgacggtaacgagtacgttataacgtttagcgtacgacgtnaacggactacgggacgtaccgacccgtgtacgtaggtcggttgggttcgggtacggacgtacgacctagcgtaaacgcgtacgagcgaaccg

SEQ ID NO: 224485 - DNA, 728 bp, Homo sapiens
  misc_feature: GYAE6OF01D2CR8.10.1.A01.1.454.CMB.1.raw
  modified_base (136)..(136): a, c, t, g, unknown or other
  misc_feature (136)..(136): n is a, c, g, or t
  modified_base (582)..(582): a, c, t, g, unknown or other
  misc_feature (582)..(582): n is a, c, g, or t
tcagcatagtagtgcacgaccggtgctcgatttagacgtctcatcaggggctccaaacagagcttcagcaagcatagtgggaatctgcaccatcgccctgggctctgctcctcctgaccctcctcactcactcgtncagtgtacagtcggtcaggcgagggctgactcacgccacctcggtactccgaaaggtacttaggacgaccgacgacccgaccacctacctccacctcgaccgacgtagggaaaccaaacaacaagttcgtcggaccacggtacggacggttcggttcggaccgtgacgagactacgaccaccgacggccccaccccgttaccgaacgccttcccgtacctaccgaacgtacgaaacctacaccgtccccgggaccctacgaaggtactcgtaacggagtacgtaggtacctttcgacttcggactacggtacccgtaacggggtaccaaaaggggacctaccgaaaccgtcccgtaccctccgttaacaccgtttaaactacgttaccggaccctacggaccgggaactacggaaacggagtacgtaccttagttattaaccgttnacgtcctacgtagaccgtaacggtacggacgtaacccgtccgtaggtaacgggttccgtttcggggttaggggttacccggaaggggaccggtaacccggttaagggccttaacccgggtaccgttcggtacggtcgaaccccggg

SEQ ID NO: 224486 - DNA, 812 bp, Homo sapiens
  misc_feature: GYAE6OF01EOAA6.10.1.A01.1.454.CMB.1.raw
  modified_base (161)..(161): a, c, t, g, unknown or other
  misc_feature (161)..(161): n is a, c, g, or t
  modified_base (180)..(180): a, c, t, g, unknown or other
  misc_feature (180)..(180): n is a, c, g, or t
tcagcatagtagtgcacgaccggtgctcgatttagacgtctcatcgaggggtctgggagaggagcccagcactagaaggtcggcggtggttccattcggtgatcagcactgaacacagaggactcgaccagtcggagttgggctgagcgttgggttttccngttcgcttacgttttaagnggtcgtaccagtgtcaagtgcgagacgtgggcggtagtcgtgggggagcggtggtcccaggccgtacgggacgttccctggacgacttcgtccgttcgtcgacgtacggccttcggttcgggttacctaccgttactaacgtacctagtcggtacctattcggaccgtacggtacggggtcccctacggtacggtcccgtaccgaacgggtcgggtaaacggggttccgtaggggttacgggttcggggttacggtacttaccgtttactccgttacagtacgtacgaacggtttaccggtaaaacgttttacggtttaaacttttagaccgttaccgtaacggttacgttacccgggtaagggtaaccgggtcgtaaaccgtttaccgaaccgtacgttacccaaaccggtaacgtaaacgtaacccgttaacgttaacccggaacggaaacccttacccggtatacgttaaccgtaacgaacgtaaacggttacccaacggtaccgtaccgtaaggacctacggttaccggacgaaccggttacgtaccggtacgtttaacgtaacgtttacggtgaccggtaccgtaacggagtccgaagttacgacctttagtacccgttttaaccgg

SEQ ID NO: 224487 - DNA, 688 bp, Homo sapiens
  misc_feature: GYAE6OF01DFE54.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgacctcctcactcactctgcagtgtcagtcggtccaggcgaggctgactcgaacgcccgtacccgtcggtataccgaaggtacttaggacgacacgacccgaccgacacctcaccgtcgacacgtacggaaacaacaaccagtcggttacggaccgaacggtacggagttccgtttgggactcggtacagacgacgccgaccgaccgggtacccaccctaccggaatcccgtcccgttccaccgaactaacgggtaacttaaaccgccgtacccggaccctgacggggtactacctacgtaagtacgacgttaacgttcctagtaccgaccgtaactaccggtaagtcgaaggacgtacaccgtcgtaacccgttccgaacggttacccttaacgttaccgacgtacccgacgtcgacgtacgacggagtaacgtcgtaagttctattactcggaccctagaccgtagacggtacgtaccgaccgtaccgtcgtacggtacggtccggtttaggggttcccggagggttaaccggacctacgtgacccgtaccgtaccggtagtccggaaccg

SEQ ID NO: 224488 - DNA, 762 bp, Homo sapiens
  misc_feature: GYAE6OF01BPSHS.10.1.A01.1.454.CMB.1.raw
  modified_base (300)..(300): a, c, t, g, unknown or other
  misc_feature (300)..(300): n is a, c, g, or t
tcagcatagtagtgcacgaccggtgctcgatttagacgtctcatcaggggctccaaaacagagcttcagcaagcatagtgggaatctgcaccatgcccgtgggcttctgcctcctcctcgacccctcctcactcacctctgcagtgtcgaggtcggtccaggcgagggctgacctcacgccctacccgttcggtactaccgaaggtacttagaacgacacgacccgaccaccacctcgacctgaccacgacggaacaaacaacaagtgtcggaccgacggacggtagttcggttcggctnacgacggcacgaccgacccgaccggccctacccctaccgacgtcctcccgtcgtaccgaacgaagaaacctaaccgtaccgtccccggtcctacggaacggtctcgaacgaagacgtaacgtactttctcgtacacctaccgtaccggacgtaaccgacggaacctaccaaccggttaccccgcccgttaacccgtacgtaaccccgttaacgttacccgggtaccggtaccgtacccggacggtaccgtaaccggaaaccgggttacaacggttaccttaaggtaactttacgttaaccgtcgaacgtacgaggtaaccgttcggaaccgggtacccgccggttaccttcgggttaacggtccggggttcggggttttaccgggtacggggacgggaacccggacgggttacctaccgggtaaccggtacccggtaacgggtaccggacccggtaacccgg

SEQ ID NO: 224489 - DNA, 583 bp, Homo sapiens
  misc_feature: GYAE6OF01B6RLS.10.1.A01.1.454.CMB.1.raw
  modified_base (105)..(105): a, c, t, g, unknown or other
  misc_feature (105)..(105): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (267)..(268): a, c, t, g, unknown or other
  misc_feature (267)..(268): n is a, c, g, or t
  modified_base (271)..(271): a, c, t, g, unknown or other
  misc_feature (271)..(271): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
tcagcatagtagtgcacgaccggtgctcgatttagacgtctcatcgaggggctccaaacagagcttcagcaagcatagtgggaatctgcaccatgccctgggctntgctcctctcaccctcctcactcactctgccagtcgtcagtgtccaggcagggctggactcacgccctacctggtactaccgaaggacttgacgacncgaccnccanactcgacctgcacgaggaacaacacaagtgtcgacacgacgngtcgttgntncannacngaccgacggccacctccganctcnccgcacgagactacgacgtccgacctacgnggactcgacagagacgtntctcngactcacgtagacgagacactacgactcccgtacgtactaccacggtttacncgtaccgtacgngacgtacgacgaacgttacggacttacgtaacgtttcgtaacctgttcctacgtacgaccagggttaccgaaccgtcccggtacgtacgacgtccgggttacgggttaccgggttcgggacggttagggaccccgaggtccgacggttacccgtctccgggtaaccaccgg

SEQ ID NO: 224490 - DNA, 882 bp, Homo sapiens
  misc_feature: GYAE6OF01EXNQ5.10.1.A01.1.454.CMB.1.raw
tcagcatagtagtgcacgaccggtgctcgatttagacgtctcatcgaggggctccaaacagagcttcagcaagcatagtgggaatctgcaccatcgcccgtgggctctgcctcctctcgaccctctcactcactctgcagtgtcgagtcggtaccgaggcgagggctacgactaccgacgccctacccgttacggtaactaccgaaagggtacttaggaacgacgaaccggaacccgaccaacctacctaccgtaccgtacgaccgtaaccggtaaccgggaaaacctaaaccgtaaacgtaacgtttcgggttaccggacccgtaaacgggtaccgggtacggtttacggtttacggtcgtacggacgtaacggaccggaaccgaccccggtaaccggtaccccgggtaccccctaacccccgtaccgtaaacccggttcccttaccccgtaccggaacccggtaaacggtaaacgtaaacccgtaaccgtacccggtaccccgggtacctaaccgggtaagggttacctaccgtaagaaggtaacgtacgttaacttccgtacgttacgacccgttaacggtaccggtaacgggtaacaacggaacccgtaccgacccgtaccgttccccgtaaccgttaacccgtaacgtaaccgtttaccggaccgtaccgtaccgggaggtaaccgtacggaaacgtaccggtaagtacctaagtttacgttaacgtacgtacccgtagacgtacggtagtaacccggtacgacccggttaccgtcgtaggtcggttaccgggtcgggtttacggtaacccggggacgtaacgggaaccgttcggtaccggtacgttaaccggtaaccggtcggtaacgaccccggg

SEQ ID NO: 224491 - DNA, 884 bp, Homo sapiens
  misc_feature: GYAE6OF01EX1F2.10.1.A01.1.454.CMB.1.raw
tcagcatagtagtgcacgaccggtgctcgatttagacgtctcatcgaggggctccaaacagagcttcagcaagcatagtgggaatctgcaccatcgccctgggctctgctcctcctcgaccctcctctactcacttctgctagtcgtcaggttcggtccaggtcgagggcttagactcacgcccacccgtcggtactaccgaaggtcttagagaccgacggacccgtccaaccaccttccaccgtacgccgtaacggacgggaaaccaaactaacgtagtcggttacggacccgtacgggtaacggtacggtttccggtttacgactcggaacacggaccacgtaaccccggaaccggaccgggtaccccctaccccgtacccgaacggtcccttacccgtcccgaccggaaccgtaaaggtaaacctaaccgtaccggtccccggtacccggttaacggacgggttacttaccccggaaggtaaacggacggttaacgtttaccttttcccgtacctacggttacccgaacggtttacccggacgggttaaccgaacggggtaaaccctacccgaacccgtaccccggttaacccccgttccgttaaacccgggtaaaccctttaaccggtttaacccggtaaccggttacccgaacccggtttaccggaccggtaaaccgggtaacccggtaaaccgggtacgttaaccgggtttaacttaacctttaaccgttaccggttaccgtaccgttaaccgaacgttaacgggacggtaacccggccggtaaccgtccggtaccgggtacggttacgggttcgggttacggggttaccggacgggtaccgtacgacgtacgcgtaccgttcgtacgtcggtaaccg

SEQ ID NO: 224492 - DNA, 776 bp, Homo sapiens
  misc_feature: GYAE6OF01ANW0D.10.1.A01.1.454.CMB.1.raw
  modified_base (742)..(742): a, c, t, g, unknown or other
  misc_feature (742)..(742): n is a, c, g, or t
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcagtggtccaggcagggctgactcacgcctaccgtcggtactaccgaaggtacttgagacgaacgacccgaccaaccacctaccacctcgaccgtaacgtacgggaaaaccaaacgaaacgtaacgttcggttacggacccgaaccggtaaccgggttacggtttaccggtttcgggtccgttacggaccgtaacgggaccgtaacggacccgaacccgggaccggggtaccccctaacccccgttaacccgaaccgtccccgttacccgtacccggtaacccggaacgtaaacggtaaaccgttaaacccgtacccggtaccccgggacccgtaacggtaacgggtaacttaccgtaccgaaggtaacgtacgtaacttcgtacgtacgacctacgtaccgtacggtacgacggaacgcaaccgtccgtacctaccgtagtaccctacggttaccgcgtaacctccgggagtaccgtacgaaccgtaagtacttagtacttaattacgtacgtacgactacgacgtacgtacggacccggtaaccgtccggtactcggtacggtcggttacgggttacgggtacgggacggtaggtaccncggttccgaccgtacggtcgtacgtcgtaaccgg

SEQ ID NO: 224493 - DNA, 799 bp, Homo sapiens
  misc_feature: GYAE6OF01BTU8R.10.1.A01.1.454.CMB.1.raw
tcagcatagtagtgcacgaccggtgctcgatttagacgtctcatcaggggctaccaaacagagcttcagcaagcatagtgggaatctgcaccatcgccctgggctctcgctcctcctcgaccctctcactctactctgctagtcgtcgtaggtcggtaccgaggcgacgggtctacgactcgaccgtccctaccgttacggtactaccgtaaggtacttaggaacgaccgaaccgacccgaccaacctacctacctaccgtcgaccgtaaccggtaaacggaaaaccaaacgtaacgtaacggttcggttaaccgggaccgtaccggtaggttacggtttcggttacggctcggacgagtccgacgaccgaaccgcccggacccctacccgtaccaccgtccctacccgtaccgtaccgaacgaaacgtaaccctaacgtcccggtccccgtaccgtaacggtacggtcctaacggacgtaacggtaacgttacctttaaccgtccgttaacctacgggacccttaacgggtaacccggtaaggtaaccggaacgtaaccgacctacccggtaccctacccgtacctaacgttaaccgttacgtacggttacccgtacgaccgtcggtaaccgacggtaaccgacgtacgttatacgttaacttctagttcccgagttacacgtacgttcggaccgtaccgtacgtctacgtcgggttacgtccgggtttagggccgggaaccggtcgttaaccggcgttacggttaccgaacccggttacggtcggcccgtacccggg

SEQ ID NO: 224494 - DNA, 808 bp, Homo sapiens
  misc_feature: GYAE6OF01EYNI6.10.1.A01.1.454.CMB.1.raw
  modified_base (567)..(567): a, c, t, g, unknown or other
  misc_feature (567)..(567): n is a, c, g, or t
tcagcatagtagtgcacgaccggtgctcgatttagacgtctcatcaggggctccaaacagagcttcagcaagcatagtgggaatctgcaccatcgcccgtgggcttctgcctcctcctcgaccctcctcactcacgttctgcagtgtcgagtcggtccaggcagggctgactcacgcctacccgtggtactccgaaggtccttggacgacacggaccgtccaccactccaccgtgaccacgtacggaacaacgaactaaggttcggttaccggaccgaacggtaccgggtaacggtttacggttttcggcgtaggaccaacgccgtaacggacccgacccggacgggacccctacccccgtacccgtaacgcccttaccgtaccctaccggaacgtaagggtaaacctaaccgtaccggtaccccggacccgttcgaagggtacctaccgtacgaaggtacgacttaccttccgtagtcgacttaccgtaccgacgggtacgtaacggaccacaaccgtaccgtccccttaccgaccgtaaccttaacgtaccgtaccgggtacccnccgtacggtaaccggtacgaaaccggtacgagtaccggttattaacgttactttaccggacgtacccgttacggtaacgtcgtaaccgggtaccggtaccccgaccggttacccgtcgggtaacggtttccggggttaccgggttttgggggttaacccgggaaccgggttacgggaaccccgtacgggtacccgtaccggttaccccgggtaaccgggttacgggacccgtaaccccggg

SEQ ID NO: 224495 - DNA, 785 bp, Homo sapiens
  misc_feature: GYAE6OF01D89J0.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagctggcggagtcgtgggggagcgtggtccaggccgtgggacgtccctgacgactctcctgtcgccagtcctcgtcgggttccaccttcaaacttacctagtcggctatcgctacggtcggggtcccgccgacgggtcctaccggagggtaccggaagggggtcgtaggggacgggttcggggtggtccttacgtttactcgtacgtaatttagtaggtaagttaagggtaaaacttttaggttttaaaatttttagacggtaaccgtaaacggttacccgttaccgggtaagggtaaccgggtcccgtaagtttacccgaaccttacgttacccgtaccgaaaggtaaccgaacttaacgttacccgaacgggtaacccctacccgttagttacttaccgtacggtaaactaaacgtacgtaaaccgtacgtacccgtaaggacggacgtaccgtaaccggaaccggaaccggttaccggtacgttttaacggttttaacgtttaccgtacgggttacccggaacgggtaaccgaaacgggtaccgtaccggtaagtttacccggttaacgttaacccgtttttaaacccggg

SEQ ID NO: 224496 - DNA, 485 bp, Homo sapiens
  misc_feature: GYAE6OF02HN0HV.10.1.A01.1.454.CMB.1.raw
  modified_base (336)..(336): a, c, t, g, unknown or other
  misc_feature (336)..(336): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctccaagctcctctccgacaggaataacatccggcctcagggatctcagagagattcnctgcatccaggtcaggagcacagcctccctgaccattactggactccagctgacgacgaagctgattattactgctcagcagtcggacaccggcctcgagtcgtcggtgggtttcggcggtaggacgagctgaccgtcgtaggtcacgg

SEQ ID NO: 224497 - DNA, 492 bp, Homo sapiens
  misc_feature: GYAE6OF02FRIO7.10.1.A01.1.454.CMB.1.raw
  modified_base (338)..(338): a, c, t, g, unknown or other
  misc_feature (338)..(338): n is a, c, g, or t
tcagcatagtagtgcacgaccggtgctcgatttagacgtctcatcaggggctccaaacagagcttcagcaagcatagtgggaatctgcaccatgccctggactctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattcnctgcatccaggtcaggaagcacagcctccctgaccattactggactccaggctgacgacgaagctgattatactgctcagcatggacaccggcctcgagtgtcggtggtttcggcggtaggaccgaaggcgtggaccgtccgtacggtcgacgg

SEQ ID NO: 224498 - DNA, 537 bp, Homo sapiens
  misc_feature: GYAE6OF02GAVKF.10.1.A01.1.454.CMB.1.raw
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
  modified_base (518)..(518): a, c, t, g, unknown or other
  misc_feature (518)..(518): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggtttcctcgttgctcttttaagaggtgtccagtgtcaagtgcagctggcggagtctgggggaggcgtggtccagcctgggaggtccctgagactctcctgtgcagcctctgggttcaccttcaatacctatggcatgcactggggtccnccaggctccgaggcaaggggctgggagtgggtggctcttatctcatatgatggaaattgttaaatttngcagactcgtagaggcattcactatctaccgagtacgaacaacttccgaacggaacctaccccgttagtaacttctaggactaaaatacgaaaccagtcctaggaagcgacgtagacgacgacggtcttagtttattactggtcgacgtacaggngaccagctagtacttaacg

SEQ ID NO: 224499 - DNA, 498 bp, Homo sapiens
  misc_feature: GYAE6OF02GHB53.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcaggggatctcagagagattctctgcatccaggtcaggaagcacagcctccctgaccattactggacctccaggctgacgacgaagctgattattactgctcagcatgggacaccggcctcacgtgccggttgggtttcggcgggtagggaccgaggcgtgaccgtccgtaggctaaccgg

SEQ ID NO: 224500 - DNA, 475 bp, Homo sapiens
  misc_feature: GYAE6OF02FXIIR.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccacctcccaagctcctctccgacaggaataacatccggcctcagggatctcagagagattctctgcatccaggtcaggaagcacagcctccctgaccattactgactccaggctgacgacgaagctgattatactgctcagcatggacaccggcctcagtgcgtggtttcggcggaggacagctgaccgtctaggtcacgg

SEQ ID NO: 224501 - DNA, 554 bp, Homo sapiens
  misc_feature: GYAE6OF02J1DBO.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgccacgacggagtcgttggctgcagcagcaccgagggccaccctcccaagcctcctctccgacaggaactaacacgtccggccctcgagggactctcagagagtattctctgcatccgagtcaggacgcacacgccctcctcgacctattaccgtggacctccgaggtctacgaacgacgaagtctgtattactactgtactacgagtccaagtcggaccgaccgtcctacgaggttcggtcgggtttggggtttccggacgggtaacggacccgtaaggtccgtacggtacccggttacccgtacgggtacccaaccggg

SEQ ID NO: 224502 - DNA, 292 bp, Homo sapiens
  misc_feature: GYAE6OF02IZ7QP.10.1.A01.1.454.CMB.1.raw
  modified_base (287)..(292): a, c, t, g, unknown or other
  misc_feature (287)..(292): n is a, c, g, or t
tcagcatagtagtgcacgaccggtgctcgatttagacgtctcatcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagcccaaggctgccccctcggtcactctgttccccgccctcctccactactatgctgagcggctggcaggcgcatagnnnnnn

SEQ ID NO: 224503 - DNA, 588 bp, Homo sapiens
  misc_feature: GYAE6OF02H40AX.10.1.A01.1.454.CMB.1.raw
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtctgggggagcgtggtccagcctgggaggtccctgagactctcctgtgcagcctctgggttcaccttcaatacctatggcatgcacgtggggtccnccaggcctccgaggccaaggggctgggagtgggtggctcttanctcatntgataggtaaattgtttaaatttngcagtactccggtagaacgggtcctattcgacctatcctaccagacgactaattcccgaaggaaccctaccttgtaactctacgaactaaagttacgaaactacggtaccctaggaacgtacgtcgtaacgaccgtaaccacgggttctttaggttttaacttaccggttgtacgaccggtacgtacggacggctacggtcttacggtacctttaaacg

SEQ ID NO: 224504 - DNA, 705 bp, Homo sapiens
  misc_feature: GYAE6OF02JTZ79.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacacaatgttgcacgacggagtcgtttggctgcagcagcacgagggccacctccaagctcctctccgacaggaactaacactcccggccctacgacgggactcgtacgaagacgtacggtacttccgtactcgacctagtcccgtaaggtccaagggtaacgccgaacgaccgtacccgttaccccgtagtaacccgtaacgtttacccgtagggtaaccccttaccggaaggtcccttacgggaaacccggtaaccggtaaacggtccgttaacggtaacgttttaaaccgttaccgtacggtaccttaccgaaggtaccgttaaacgggtaccgggtaacccgaacccggggttccctacggtaacggttcggtaccgggttttacggggttttccgggaaccggggtaaccgggtaaccgaacgggttccgttaccgggtaacccggtttcccggtaacgggttacccgaacccgggg

SEQ ID NO: 224505 - DNA, 629 bp, Homo sapiens
  misc_feature: GYAE6OF02H999N.10.1.A01.1.454.CMB.1.raw
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
tcagcatagtagtgcacgaccggtgctcgatttagacgtctcatcagggggctccaaacagagcttcagcaagcatagtgggaatctgcaccatgccctggggctctgctcctcctgaccctcctcactcactctgcagtgtcagtggtccaggcagggctgactcagccaccctcggtatccaaggacttgagacagaccgccacactcacctgcactggaacaacaacaatgttggccagacggagtcgtttggctgcagcagcacacgggccaccctccaagctcctcnccgacaggaataacactccgcctacgaggactccgtnagagagtacttctctgcactccgaggtacgaaggaacgcacgacgtccctaccctacgaacctattaccgtacggtactaccgacggtactacggaaccggacgaacgctaggtaactttaacgttaaccgtgtaccttacgacgtaccgtacggtacgggacccgtacccgggtccttaccggtaagggttcggtccgggtttaccgggggttttccggggacccggggtaacgggtacccggaacggtaccggttaccggtaaccccggttaccggttaccgggtccgtaaccccggg

SEQ ID NO: 224506 - DNA, 568 bp, Homo sapiens
  misc_feature: GYAE6OF02JMBHP.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggcccaccctcccaagctcctcctccgacaggaataacatcccggccctcagggatctcagagagtacttctctgcactccaggtcaggaacgcaacacgccctccctgaccctattaccgtcggactccgaggtctacgaacgtaccgaagtcctgtaattacttactgtacttcgagtacagtcggaaccgacccggcctcgagtcggtacggtttgggttttaccggggcgggtacggggacccgaacggtccgtaccgggtacccggttaccgtacgggttaccgaacccggg

SEQ ID NO: 224507 - DNA, 555 bp, Homo sapiens
  misc_feature: GYAE6OF02IKYUI.10.1.A01.1.454.CMB.1.raw
  modified_base (348)..(348): a, c, t, g, unknown or other
  misc_feature (348)..(348): n is a, c, g, or t
  modified_base (372)..(372): a, c, t, g, unknown or other
  misc_feature (372)..(372): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagcgtggttttcctcgttgctcttttaagaggtgtccagtgtcaagtgcagctggcggagtcgtgggggagcgtggtccaggcctgggaggtccctgagactctcctgtgcagcctcgtgggttcaccttcaatacctagtggcatgcacgtcgggtcccgccaggctccgaggcgaaggggctgggagtgggtgctcttatctcatntgataggtaaattgtttaaatttngacagtacttcggtaggaaggcctactacacctatcctacagacactaacgttaccgaacgtaaccaccttagtactctacgaactaaagtacgaacacgaccgtagacgacgtacgtacgacgaccgacgtactttacgttacttacgtagtcgacgtacagacgcagctacgtacttaacg

SEQ ID NO: 224508 - DNA, 546 bp, Homo sapiens
  misc_feature: GYAE6OF02GZRO5.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagcctcctctccgacaggaactaacatcccggccctcgacgggactcctacgagagagtattctctgcatccgaggtcaggaacgcaacacgccctccctcgacctattacgtcggacctccgaggtctacgacgaacgaacgctagtattattactgctacagcagtcggaccaccgcctcgaggtggtcggttacggggtttcggacgggtacggtaccgaacggtcgtacggtacccgtccggttacggacgtacccgg

SEQ ID NO: 224509 - DNA, 495 bp, Homo sapiens
  misc_feature: GYAE6OF02HWFST.10.1.A01.1.454.CMB.1.raw
  modified_base (370)..(370): a, c, t, g, unknown or other
  misc_feature (370)..(370): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggagcacgacgcctcccngacctattactggacctcgagctgacgacgaagctagtattatactgctcgagcagtcggacaccgcctcagtgcggttgggtttcggcggacggacaggctagtacccggtcgtaggtcaccgg

SEQ ID NO: 224510 - DNA, 534 bp, Homo sapiens
  misc_feature: GYAE6OF02HE211.10.1.A01.1.454.CMB.1.raw
  modified_base (269)..(269): a, c, t, g, unknown or other
  misc_feature (269)..(269): n is a, c, g, or t
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (362)..(362): a, c, t, g, unknown or other
  misc_feature (362)..(362): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggagcgtggtccagcctgggaggtccctgagactctcctgtgcagcctctgggttcaccttnaatacctatggcatgcactgggtcccgcaggcctccaggcaaggggctggagtgggngctcttanctcatatgatggaaattgttaaatttangcagactcgtagaggcattcacatcncaganacatcagacacctgtatcnacaaatcgaacacgacctgaacgtacgctacgacgaaccacggtactttacggttttaataccgttaggtacggaccgtaacgtaggaaccgtcgaacggtcttacggtaacctttaaaccg

SEQ ID NO: 224511 - DNA, 535 bp, Homo sapiens
  misc_feature: GYAE6OF02FOTDE.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctccaagctcctctccgacaggaataacactccggccctcagggatctcagagagattctctgcatccagtcaggaagcacacgcctcccgtgaccattactcggactccaggctgacgacgaacgctgatttactactgctacacgcaagtcgggacacccggcctacgaggtcggtcggttcggggttttccggacgggtacgggaccgtaacggtccgttaccggacccggttaccttacgggtctaacccggg

SEQ ID NO: 224512 - DNA, 587 bp, Homo sapiens
  misc_feature: GYAE6OF02GZ7DH.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagttcgtttggctgcagcagcaccgagggcccaccctcccaagcctcctcctccgacaaggaactaacacgtcccggccctcgagggactctacgagagagacttctctgctactccaggtcaaggacgcacacgccctaccctcgacctattacgtggacctccgaggtctagacgaacgacgtcgtagtacttaacttactcgtactcgtacgactaaggtacggaaccgtaccgtcctacgaggtacggtcgggttcggggttttaccggggacgggtaaccgggtaccgtaacggtccggttacggtacccggtaccgttacgggtccgtaacccggg

SEQ ID NO: 224513 - DNA, 507 bp, Homo sapiens
  misc_feature: GYAE6OF02IANOT.10.1.A01.1.454.CMB.1.raw
  modified_base (364)..(364): a, c, t, g, unknown or other
  misc_feature (364)..(364): n is a, c, g, or t
  modified_base (388)..(388): a, c, t, g, unknown or other
  misc_feature (388)..(388): n is a, c, g, or t
tcagcatagtagtgcacgaccggtgctcgatttagacgtctcatcgaggggctccaaacagagcttcagcaagcatagtgggaatctgcaccatgccctgggctctgctcctcctgaccctcctcactcactctgcagtgtcagtggtccaggcagggctgactcagccaccctcggtatccaaggcttgagacagaccgccacactcacctgcactggaacaacaacatgttggccacgacggagtcgtttggctgcagcagcaccagggccaccctcccaagcctcctctccgacaggaaactaacactcccggccctacgaggggactctacagagagattctctgcatccaggtcaggancacagccctcctgacctattacgnggacttccgaggctgacgagaagctgattattactgtcctcagcagtgggaaccaccggcctacgagtggcggttgggtttcggcggtaggacgagcgtgacccgtcgtaggtcaccgg

SEQ ID NO: 224514 - DNA, 584 bp, Homo sapiens
  misc_feature: GYAE6OF02IXYBK.10.1.A01.1.454.CMB.1.raw
  modified_base (400)..(400): a, c, t, g, unknown or other
  misc_feature (400)..(400): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttcggccacgacggagtcgttgctgcagcagcaccagggccaccctccaacgcctcctcctccgacacggaactaacactcccggcctcgaggactctacagtacgagtattctactgcatccgaggtcaaggacgtacgacacgcctaccgtacgacctagttacnggtacctcacggctagacgacgaacgctagtacttattacgtacgtcttacgacgtacgtaacgtcggaaccgtaccggtcctacgtacggtacggtcgggttacgggttttacgggccgggtaacgggaacccgaacggttccggtaccggtaccccggtaccgttacggtacgtaaccccgg

SEQ ID NO: 224515 - DNA, 585 bp, Homo sapiens
  misc_feature: GYAE6OF02JDP1V.10.1.A01.1.454.CMB.1.raw
  modified_base (154)..(154): a, c, t, g, unknown or other
  misc_feature (154)..(154): n is a, c, g, or t
  modified_base (292)..(292): a, c, t, g, unknown or other
  misc_feature (292)..(292): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttccncgttgctcttttaagaggtgtccagtgtcaagtgcagctggcgagtctgggggagcgtggtccagcctgggaggtccctgagactctcctgtgcagcctctggttcaccttcaatcctatggcatgcacgtgggtccnccaggctccaggcgaaggggctggagtgggtgctctatctcatntgatggaaattgttaaatttgngtcagtactcggtagacggccgtattcgaccatcctcaganacaattccgaagaaccaccctagtactcgtagtaccaaagttaccgaaactacgaccttaggaacgtacggacgtacggaaccgtaccgtaccgggttctttaacggttttaacttaaccgttcggtacggaccggtaaaccgtacgggacggtaccgacggtaccgttacgtaacgtttaaaccg

SEQ ID NO: 224516 - DNA, 678 bp, Homo sapiens
  misc_feature: GYAE6OF02JM8NX.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggagcgtggtccagccgtgggaggtccctgagactctcctgtgcagcctctgggttcaccttcaatacctatggcatgcacgtcgggtccgccaggcctccgaggccgaaggggctgggaggtgggtggctcgttatctacatagtgagtaggtaaaattgtttaaattttagcgtactagtaccgttccggtaggaacgggtccgtattaccgaaccctacttacctaccgaggtaacgtaacctaaacgtttacccgaaacggtaaccctaacccgttacggttaacttccgtaacggtaacctaaaacgttacggaaacctaacggtacccgtagggaaacgtacggtaccgttaacgggaaccgtaaccgtaccgggtacgtttaacggttttaacgttaaccgttcggttacgaccgtaacgtacggtacgtaccgtaacggtcgttacggtaaccgtttaaaccg

SEQ ID NO: 224517 - DNA, 523 bp, Homo sapiens
  misc_feature: GYAE6OF02GRK9M.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagcctcctctccgacaggaactaacatcccggccctcagggactctcagagagtattctctgcatccaggtcaaggacgcacacgcctccctcgaccattacgtcggacctccaggctgacgacgaagctgattattactgctcacgcacgtggaccgaccgcctacaggtcgtcggttcgggttttcgggcgggtacgggaccgacggcgtacggtacccggtcgtacggtcgaccgg

SEQ ID NO: 224518 - DNA, 503 bp, Homo sapiens
  misc_feature: GYAE6OF02GM1B8.10.1.A01.1.454.CMB.1.raw
  modified_base (360)..(360): a, c, t, g, unknown or other
  misc_feature (360)..(360): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctcctccgacaggaataacactccggccctcgacgggatctcagagagattctctgcatccaggtcaggancacagccctccctgacccattactcggactccgaggctcgacgacgagctgattatactgctcgagcagtacggacaccggcctcagtgtcggttgggtttcggcggacggaccaggcgtcgaccgtcgtacggtcgtaccgg

SEQ ID NO: 224519 - DNA, 704 bp, Homo sapiens
  misc_feature: GYAE6OF02J2D77.10.1.A01.1.454.CMB.1.raw
tcagcatagtagtgcacgaccggtgctcgatttagacgtctcatcagggctccaacagagcttcagcaagcatagtgggaatctgcaccatgccctgggctctgctcctcctgaccctcctcactcactctgccagtcgtcagtggtccaggcagggctgactcacgccacccgtcggtactccgaaggacttgacgacacgaccgccacactcacctggccacgtagggaacaacaacaatgttcggccacgacggacgtcgttggctgcagtcagccacgacgggccacccgtccaagcctacctctaccgactaacggaactaaccacgttcccggccctacgacgggaactctaccgaggactagtacttcgtacgcgtaccacgtcccgtaacgggtcaacgggtaaacgcccgaacgaccgtaccccgttaccccgtacggtaaccctacgttaaccgtcggtaaccgttacccgacggttccgtaccggaacgaccgtaacgtaccgtaggtaactttacgttaaccgtacgtaccgttaccgacgttaccgagggttaccggaaccgtacccggtacccgtaccagggttacccgggtcggggtttacgggttttccgggaacggggtaacccgggttaacccgaagggttcccgtacgggtaccccgttaccgggtaccgggtcgtaaccccggg

SEQ ID NO: 224520 - DNA, 524 bp, Homo sapiens
  misc_feature: GYAE6OF02GAEL7.10.1.A01.1.454.CMB.1.raw
  modified_base (500)..(500): a, c, t, g, unknown or other
  misc_feature (500)..(500): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtctgggggaggcgtggtccagcctgggaggtccctgagactctcctgtgcagcctctgggttcaccttcaatacctatggcatgcacgtgggtccgccaggcctccaggcaaggggctggagtgggtggctcttatctcatatgatggaaattgttaaattttatgacagtactcgtagaagggccgattcacatctccagacacattccgaacgaacctaccctagtactctagactaaatgaacacgcctagagacgcgtagacgacgacgcttgtttaactacttcggtagccgaanaggacgcagtctacgtacttaacg

SEQ ID NO: 224521 - DNA, 670 bp, Homo sapiens
  misc_feature: GYAE6OF02IS14Q.10.1.A01.1.454.CMB.1.raw
tcagcatagtagtgcacgaccggtgctcgatttagacgtctcatcagggggctccaaacagagcttcagcaagcatagtgggaatctgcaccatgccctgggcctctgctcctcctgaccctcctcactcactctgcagtgtcagtggtccaggcagggctgactcagccacctcggtatccaaggcttgagacagaccgcacactcacctgcactaggacaacaacaatgttgccacgacggagtcgtttaggctgcagcagcaccgagggcccaccctcccaacgtcctaccctctccgacaggaactaacacgtcccggaccctcgacgggtactccgtacgaggacgtagactttcgtactcggtacctacgttcccgaagggttaccgaacgggaacggacctaaccgaccgtccccttaccccgtacgtaccctaacgtttaccgtacggtaaccctcccgacgggtccgtacggtaaccggaaccgtaacgtcctagggtaatttaaccgttacgtcgtacctacggacgtacgtacggtcgggaccctaccggtaccctcgtaacggttcggttccgggtttacgggttttccgggacgggtaaccgggtaccgacggtaccggttaccgtacccggttacgttacgggtaccctaaccggg

SEQ ID NO: 224522 - DNA, 611 bp, Homo sapiens
  misc_feature: GYAE6OF02HXZEN.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttgccacgacggagtcgtttggctgcagcagcaccagggccaccctccaagcctcctctccgacacggaataacactcccggccctcgaggactctacagagagtattctctgacatccgaggtcgaaggaacgcaccacgcccctccctacgtaccctaattaccgtacggtaccctccgaacggtccgtaggaaccgaaccgaagtcctaagtaactttacgttaacctgtactacgacgtcaaggtcgggaaccacccggtcctacgtacggttcggtccgggttttcggggtttccgggacgggtaaccgggaacccgtaacgggtccggttaccgggtaaccccggttaccggttacgggtaccgtaacccggg

SEQ ID NO: 224523 - DNA, 543 bp, Homo sapiens
  misc_feature: GYAE6OF02FI9PV.10.1.A01.1.454.CMB.1.raw
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (386)..(386): a, c, t, g, unknown or other
  misc_feature (386)..(386): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgtttggctgcagcagcaccagggccacctccaagctccnctccgacaggaataacatccggccctcagggatctcagngagattcnctgcatccaggtcaggancacacgcccctcgactacctagtcgtacgaccncgacgtctacgacgaacgctcattattactcgtcgtactacggacacgtacggtacggaccgccgtacctagcggtcggttcggggtttcgggtaccgggacgggaccggtaacgcggtaccggtcccgtaccggacggttacgccgtaaccccggg

SEQ ID NO: 224524 - DNA, 584 bp, Homo sapiens
  misc_feature: GYAE6OF02GNANW.10.1.A01.1.454.CMB.1.raw
  modified_base (368)..(368): a, c, t, g, unknown or other
  misc_feature (368)..(368): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggcccaccctcccaagcctcctctccgacaggaaactaacatcccggccctcgagggactctcagagaagacttctctgacatccaggtcaagggancaacgagccctcccgtcgaccctaacttacgtcggacctccgaggtctagaaccgacgaagtctaggtatttagttacctgtctacgacgctaagtacgggaaccgacccgggtcctacgacggttcggtccgggtttcggggttttcgggaccgggtacggggaccgtaacggtcggtaccggtacccggtccgttacgggtaccgtaacccggg

SEQ ID NO: 224525 - DNA, 676 bp, Homo sapiens
  misc_feature: GYAE6OF02IV2HA.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtggaacaacaacaatgttaggccacgacggagtcgtttggctgcagcagcaccacgggcccaacccctcccaacgcctcctcgtccgaccgaggaactaacacgtccggccctacgacgggatcgtacaagagtagtactttctcgtacgactactaccggaacggtacgtaagggaacgtccgaaacgtaccgtacccccgttcccgtaacggtaaccctacgtttaaaccgtccggtaacccggttacccgaacggtaccgtacggaaacccggtaaaggtaaccgtaccgttagtaactttacttaccgtacgacttacggactcgaacgtaccggaacgtcccgtaacgtcgtacgggtcggttcgggttaaccggggtttccgggaacggggtaaccgtaaccggtacggaccggttaccggtaaccggttacccgtacgggtactaaccccgg

SEQ ID NO: 224526 - DNA, 525 bp, Homo sapiens
  misc_feature: GYAE6OF02GTJTL.10.1.A01.1.454.CMB.1.raw
  modified_base (433)..(433): a, c, t, g, unknown or other
  misc_feature (433)..(433): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctccaagcctcctctccgacaggaataacatccggccctcgagggactctcagagagtattctctgcatccaggtcaaggacgcacacggcctcccgtgaacctattaccgtggaacctccgacggtctcgacgacgagctagattactacgtcncttacgagtacagtcggaccnccggctacgnggtcgtcggttgggttcggcgggtacggacaggcgtcgcccgtacgttacggctaacccgg

SEQ ID NO: 224527 - DNA, 618 bp, Homo sapiens
  misc_feature: GYAE6OF02HAAM5.10.1.A01.1.454.CMB.1.raw
  modified_base (272)..(272): a, c, t, g, unknown or other
  misc_feature (272)..(272): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagttcgtttggctgcaggcagcaccgnggccaccctccaacgctccctctccgacgaaggaactaacacgttcccggccctcgacgggactctacgagagagtattcgtntcgactactccgaggtacgaggaacncgacacgtccctcccgtacgaccctacgttacgtcggtacctccgacggtcgtacgaaccgacgaacgtcgtatactttagttaacgtcgtactacgagtacagggtaccggaaccgacccggtccgttacgtaacggttcgggtaccgggtttacggggttttacgggaccggggtacgggtaaccgtacggtccggttacggacccggtttaccggtacggtaccgtaacccggg

SEQ ID NO: 224528 - DNA, 721 bp, Homo sapiens
  misc_feature: GYAE6OF02JMMH9.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccaccacctcacctcgaccacgtacgggaaacaacaacaagtcggttacggaccaacggtacgggacgtttacggtttggctagcgagccgacgccgaccgacgggacccaccccgtaccaacggtccctacccgtaccgtacccgaacgaacggtaaacttaaccgacgttaccccggacctacggacggtactaccgtacgtaagacggtaagtacgtttactcgtcgctacgtaccgaaggtcgaagggtaacaccgtaaccgaccgtccccgtaccgtacgtaaccgtacgttaccgtaccgaccctaccgacgttcgtacggaaccgacgaacgtcctaagttacgttactaacgtctacgtacgagtacgtacggtacggaaccgtcccgtaccgtacggtacggttcgggtaccgggtttacgggggttacccggggaacgggtacccgggtaacgaccggtttaccgggtaaccggtaccccggttaccggtaccgggtaacgtaacccccggg

SEQ ID NO: 224529 - DNA, 531 bp, Homo sapiens
  misc_feature: GYAE6OF02HY5OM.10.1.A01.1.454.CMB.1.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (381)..(381): a, c, t, g, unknown or other
  misc_feature (381)..(381): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgccactgggaacaacaacaatgttggccacgacggagtcgtttggctgcagcagcaccagggccaccctccaagctcctctccgacaggaataacntccggccctcagggactctcagagagattcnctgcatccaggtcaggagcacacgccctcctgacctattacnggacctcgagtctagacgacgaagctaggtacttattactcgacttcgacgctagtcggaccgaccgccttcgagtcggtcggttcgggttttcgggcgggtacgggaccacggtccttacggacccgttcggtacggtaccgtaaccgg

SEQ ID NO: 224530 - DNA, 501 bp, Homo sapiens
  misc_feature: GYAE6OF02HWYY9.10.1.A01.1.454.CMB.1.raw
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgaggagtcgtttggctgcagcagcaccagggccaccctcccaagctcctctccgacaggaactaacatccggccctcagggatctcagagagattctctgcatccaggtcaggancacngccctccctgacattacnggactccagctgacgacgagctgattattactgctcancagtggaccacgtcctnagtcggcgttggggttttccggcggtagggaccgtagccgtaggacccgtccgttacggtctaaccgg

SEQ ID NO: 224531 - DNA, 550 bp, Homo sapiens
  misc_feature: GYAE6OF02H2U5G.10.1.A01.1.454.CMB.1.raw
tcagcatagtagtgcacgaccggtgctcgatttagacgtctcatcaggggtctgggagaggagcccagcactagaagtcggcggtgtttccattcggtaatcagcactgaacacagaggactcaccatggagtttgggctgagctgggttttcctcgttgctcttttaagaggtgtccagtgtcaagtgcagctggcggagtctgggggagcgtggtccagcctgggagtccctgagactctcctgtgcagcctctgggttcaccttcaatacctatggcatgcactgggtccgccaggctccgaggcaaggggctggagtgggtgcgtcttatctcatatgagtaggaaattgttaaattttatgacagactccggtagtaacgggccgtattacacctatcctacaagacgtactaactccgaacggaacctaccctagtactctagaccaaatgaacagacctagagacgtcgtgaaccgacacggtcttgtttacgttcgtcggtacgtcgaacgagtacgcgagcgtaacgtacttaactttccg

SEQ ID NO: 224532 - DNA, 699 bp, Homo sapiens
  misc_feature: GYAE6OF02H31U7.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtactccaaggacttgagacacgaccgccacacctcacctgcactagggaacaacaacaatgttggccaacgacggagtcggtttggctgcagcagacaccgacggcccaccctcccaagtcctccctcctccgaacgaacggaaactaacgtacgtcccggacccctagacgggactccctagacgaggacgtaacttcgtactcgtacaccgtccgtaacgggtacgaaacgggaacgaccgacccgtaaccggcccccttacccgtaccgttaacccgtaacgtttaccggtaccggtaaccctaccggtacggttaccgtacggaaccgtaacggaacgttacgtacgttaacgttactttaaccgttcggtaccttacggaccgtacgtacggtaacgggacccgtacccgggacccttcggtaacggttcggttaccgggtttccggggtttacggggaccggggtaccaacgggtccgtacggtacccgttacggtacggtaccgaccggtacccgg

SEQ ID NO: 224533 - DNA, 618 bp, Homo sapiens
  misc_feature: GYAE6OF02H2BV1.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcaggtctgactcagccaccctcggtatccaaggacttgagacagaccgccacactcacctgcactggaacaacaacaatgttggccacgacggagtcgtttggctgcagcagcaccgacgggccaccctcccaagcctcctctccgacaaggaactaacactcccggccctcgacgggtactcctacagagagtacttctctcgctactccgaggtcaagggtaagcaaccacgccccttccctacggtaccctagtttaccgtcggtacctccgacggtcctagaaccggaccgaagtctacggtaacttttaacttacgtcgtacctacgacgacgtacggtacgggtaccgacccgggtcctacgacggttacggtcgggtttacggggttttccgggccggggtaacggacccgtaacggccgtaccgggtacccggttaccgtacgggttcgaaccccggg

SEQ ID NO: 224534 - DNA, 741 bp, Homo sapiens
  misc_feature: GYAE6OF02HS437.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgttgccacgacggagtcgtttggctgacagcagcaccgacgggcccaccctcccaacgcctcctctccgacaacggaataaccacgtcccggccctacgaggggacttccgtacacggaagacgtaatttcctcgttcggacctaacttacccgaacggttacggaacgggaaacgtacccgaacgtaaccggcccccgtttaccccgtacggtaaaccccgtaacgtttaacccgttaccgggaaacccgtttccccgaaacggggttcccgttaagggaaacccggtaaaccggtaaacgtcccgtaaggttaacctttaaacgtttacgtacgtaccgtacgaaccggtcgtaacggttaacgggacccgtaacccgggtcccttacggtaccggttcgggtaccgggttttacggggggtttaccggaaccgggggtaacgggtaaccgtaacgggtcccgttaccgggtaacccggtccgttacgggtacctaaaccccgggg

SEQ ID NO: 224535 - DNA, 600 bp, Homo sapiens
  misc_feature: GYAE6OF02H58TQ.10.1.A01.1.454.CMB.1.raw
  modified_base (257)..(257): a, c, t, g, unknown or other
  misc_feature (257)..(257): n is a, c, g, or t
  modified_base (346)..(346): a, c, t, g, unknown or other
  misc_feature (346)..(346): n is a, c, g, or t
  modified_base (394)..(394): a, c, t, g, unknown or other
  misc_feature (394)..(394): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttgccagacggagtcgtttggctgnagcagcaccacgggcccaccctccaagcctcctcctccgactaggaactaacactccggccctcagggactctcagagagtattctacngtcatccaggtcaaggtacgcacacgccctccctagacctacgttacnggaccttccgaggccttagaaccggaaccgaagtcgtagtaagtttaacttaacctcgtaccttacacgtaccgaacggttcgggaaccacccgggtaccttaccgtagtccgggtacggtttccgggggttttccgggccggggttaacgggacccgtaaggcccgttacggaccccgggtttacgttacgggtccgaacccggg

SEQ ID NO: 224536 - DNA, 702 bp, Homo sapiens
  misc_feature: GYAE6OF02GD720.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtagggaaacaacaaacaagtgttcggccaacgacggtagttcggtttggctgcagcagccaccgacgggcccacccctccaagcctcctctaccgacaaggaactaacgacgtcccggccctacgacgggacttccgtacgaagacgtaacgtactttccgtctacgtacctacgtacccgaagggttaccgaaagggtaaccgaccgaaccgtacccgtccccgtaccccgtacgtaaccctagtttaaccggtaccggacccgtcccggaacggttacccgtacggaaacccggtaaccggaaacgtccgtaagttaacgttttacgtaccgtcgtacctaccggactacgacggttacggacccgacccggtcctacgtacggttcgggtccgggtttacggggtttccgggaccgggtaaccggaaccggtacggtccggttaccgggtacccggttacggtaccggtaccgtaacccggg

SEQ ID NO: 224537 - DNA, 593 bp, Homo sapiens
  misc_feature: GYAE6OF02FJLSM.10.1.A01.1.454.CMB.1.raw
  modified_base (300)..(300): a, c, t, g, unknown or other
  misc_feature (300)..(300): n is a, c, g, or t
  modified_base (373)..(373): a, c, t, g, unknown or other
  misc_feature (373)..(373): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcagctggcggagtcgtgggggaggcgtggtccagcctgggacggtccctgagactctcctgtgcagcctctgggttccaccttcaatacctatggcatgcacgtgggtccncaggctccgaggcaagggggctgggaggtgggtgctcttatctcatatgtatggtaaaattgtttaaattttngacagtactccggtagaacgggcctattccaactatcctacaagacaactaacgttaccaacggaacctacccgttgtaactctagaactaaagtacgaaacgtacgtacctagaacgacgactaggaccgtaccgtacggtacgtttagttttaacgttaccgttcggtacgaccgtaacgtaggacgtaccggagtaccgttacgtaactttaaaccg

SEQ ID NO: 224538 - DNA, 599 bp, Homo sapiens
  misc_feature: GYAE6OF02IYPFP.10.1.A01.1.454.CMB.1.raw
  modified_base (487)..(487): a, c, t, g, unknown or other
  misc_feature (487)..(487): n is a, c, g, or t
tcagcatagtagtgcacgaccggtgctcgatttagacgtctcatcaggggctccaaacagagcttcagcaagcatagtgggaatctgcaccatgccctgggctctgctctcctgaccctcctcactcactctgcagtgtcagtggtccaggcagggctgactcagccaccctcggtatccgaaggacttgagacacgaccgccacactcacctgacacgtgggaacaacaacaatgttggccacgacggagtcgtttggctgcagcagcaccgacgggcccaccctcccaacgcctccctcctacccgacaacggaactaacactcccggccctacgacgggtactccgtacgagacgtacgtattctctcgctactccgtaggtcgaacggacgaccgaacacgtccctacccgtacgaacctattaccgtacggtacctaccgacggtctacggacgacgaacgtctagtactttacttaccgtnactcacgctacggtcggaccgaccggtcctcgacggtggtccgggtttggggtttccgggacgggtacgggactacggcgttacggaccgttccggtacgggtcaacccggg

SEQ ID NO: 224539 - DNA, 731 bp, Homo sapiens
  misc_feature: GYAE6OF02IHMCT.10.1.A01.1.454.CMB.1.raw
  modified_base (174)..(174): a, c, t, g, unknown or other
  misc_feature (174)..(174): n is a, c, g, or t
  modified_base (372)..(372): a, c, t, g, unknown or other
  misc_feature (372)..(372): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtntccagtgtcaagtgcagctggcggagtcgtgggggagcgtggtccagccgtgggagtcctgagtactctcctggtgcacgtcctcgtcgggttcaccgtttcaacttcctagtggtccagttcgcctacgtcgggtcccgccgacggcctccgaggccgtaaggggtctagggacggtgggtaggtcctacgtttacnctcgaatcgtagagttaaggtaaatttacggttttaaaatttgcgtaaccgtacggtaaccgttaccggtaagggtaaaccgggtacctaacgtttacccgaaacccgttagtcccgttaacgaacggtaaacgtaacctaaaccgttaccgaaacggtaaccttaacccgtagttaactcgtaaccgtactaaaacgtcgtaaaccacggtaccgtaagacggtaacgtaccgtaacggaaccgtacgtaccggttacgttttaaccgtttaacgttaaccggttgaaccggtaaccgtaacgttaaaggccggtaacccgttaacgtccgtttaccgtaaaccgtttttaaacccgg

SEQ ID NO: 224540 - DNA, 675 bp, Homo sapiens
  misc_feature: GYAE6OF02JGXM2.10.1.A01.1.454.CMB.1.raw
  modified_base (360)..(360): a, c, t, g, unknown or other
  misc_feature (360)..(360): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggtttcctcgttgctcttttaagaggtgtccagtgtcaagtgcagctggcggagtcgtgggggaggcgtggtccagccgtgggaggtccctgagactctcctgtgcagcctctgggtcaccttcaatacctatggcatgcactgggtccgccaggcctccgaggcaggggctggagtgggtgctctatctcatatgatggaaatgttaaatttgngctagtctaccgtaggaacggtccgtattacgacctattccgtacctagacgaactacttacccaagggtaacctaaccccgttggtaacttaccgttagacctaaaacgttcgaaaaccctacgtaacccgttacgggaaagttaaccggtacccgttaacgggaacccgtaaaccggtacccggggttacggtttaaaccggttttttaacgttaacccgttcggggttaaccgggttacccggtaaaccggttaacgggtaaccggtaccggtaaaccggttccttaccggggttaaaccttttaaaccccg

SEQ ID NO: 224541 - DNA, 732 bp, Homo sapiens
  misc_feature: GYAE6OF02G81H7.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcagctggcggagtcgtgggggaggcgtggtccagccgtgggacggtccctgacgactctcctgtgcagcctcgtcgggttccaccttacaactacctagtggctagtcgcctacgtcggggtccccgccgacgggcctaccgacggacggaacgggggctgggagggtgggtggtccttcgttactcgtctaattgtagtaagtaaggtaaaacttttaagttttaaaattttagtacgtacgtaaggtacccgttacgggtagggaaaccggggtccttaacgtttacccgaacccttaacgttacctaaccgtacgaacggtaaacctaacgttaccgaaacggtaaccctaccgttacgttaactccgtacgtactaaaagtaccgaacgtaccgtacgtagaacgacggtaccgtaaggaaccggtaacgtaccgggttacgttttaaggttttaaccttacggttacgggttaacggaccgtaacggttaacggaccggtacgtaccggtacgtttaccggtaaacttttaaacccgg

SEQ ID NO: 224542 - DNA, 629 bp, Homo sapiens
  misc_feature: GYAE6OF02FUI8G.10.1.A01.1.454.CMB.1.raw
  modified_base (240)..(240): a, c, t, g, unknown or other
  misc_feature (240)..(240): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagacccgccacactcacctgcactggaacacacatgtgcacgacgngtcgttgctgcagcagcaccgaggccacctccaagctccctcgtccgacaggaactaacactcccggccctacagggactctacagacgagtattctctagcctacgtccaggtacaggaacgaccacacgccctaccctacgacccatttaccgtcggacctccgacgggtcctacggaaccgaccgtaaacgtccgtacgtaactttaacgttactcggaccttaccgaaggtaccaacgttacggggaacccacccgggtacccttacgacggttcgggtaccgggtttacgggggttttacccggggaccgggaaccggggtaccgtaaaccgggtccgttaaccgggaccccggtttacccgtacgggttacccgtaacccggg

SEQ ID NO: 224543 - DNA, 533 bp, Homo sapiens
  misc_feature: GYAE6OF02FYRLW.10.1.A01.1.454.CMB.1.raw
  modified_base (316)..(316): a, c, t, g, unknown or other
  misc_feature (316)..(316): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (433)..(433): a, c, t, g, unknown or other
  misc_feature (433)..(433): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactccacctgcactgggaacaacaacaatgttggccacgacggagtcgtttggctgcagcagcaccacgggccacccgtcccaagcctccctcgtccgacaggaactaaccntcccggacctcgagggactctcagagacgattctctncactccagtcagancacngccnccngaccattacngacctccgagcacgacgacgaacgtctcgaattatactgactcgngactacgacgggaccaccggtcctcgagtcggttcggtcgggtttcggacgggtaggtaaccgacggtcgtacgtacccggtcgtacgggtcctaaccgg

SEQ ID NO: 224544 - DNA, 649 bp, Homo sapiens
  misc_feature: GYAE6OF02J30TX.10.1.A01.1.454.CMB.1.raw
  modified_base (114)..(114): a, c, t, g, unknown or other
  misc_feature (114)..(114): n is a, c, g, or t
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
  modified_base (356)..(356): a, c, t, g, unknown or other
  misc_feature (356)..(356): n is a, c, g, or t
  modified_base (517)..(517): a, c, t, g, unknown or other
  misc_feature (517)..(517): n is a, c, g, or t
tcagcatagtagtgcacgaccggtgctcgatttagacgtctcatcgaggggtctgggagaggagcccagcactagaagtcggcggtgtttccattcggtgatcagcactgaacncgagcgactcacgagtggtagttggctgcgtcgttggtttccctgttgacgttacgtttaagcggttctaccgaagttgacaagtcgctacggcgtggcggaggtcggtcggggactcgtcggtcncggtcgtgggacgtcctaggactcgtcncgtagtcacgtcgtccttcgtacgtacctacgttactaaccgttctagtcgacgtacgcgtaccgcggtccggtcacgtagcgtacgnggtaggcgtgaggtgtcggtatctacttacgctagagtcgatagtaacggttattacgttaatcgacgacgacgtcgacgtcgtacggtctactacgactacgtacgacgtacgtaacgtaccgtacgtaaccgtaaccgtactacgttacgacgtacganaacgtaagtacgacgttcgacgtacgacgtagaccgtagacgtacgttcgacggttttacgaccgttggaaccgttacgaaccgtacgaccggtcgtaaccgtcgttaaccggttacttaaccggtttacgg

SEQ ID NO: 224545 - DNA, 676 bp, Homo sapiens
  misc_feature: GYAE6OF02IZ1YM.10.1.A01.1.454.CMB.1.raw
  modified_base (221)..(221): a, c, t, g, unknown or other
  misc_feature (221)..(221): n is a, c, g, or t
  modified_base (546)..(546): a, c, t, g, unknown or other
  misc_feature (546)..(546): n is a, c, g, or t
tcagcatagtagtgcacgaccggtgctcgatttagacgtctcatcgaggggctccaaacagagcttcagcaagcatagtgggaatctgcaccatgccctgggctctgctcctcctgccctcctcactcactctgcagtgtcagtggtccaggcagggctgactcgagcccacccgtcggtactccgaaaggtcttggagacagaccgcctacactcacctnccacgtacggaacaactaaacaagttggttcgaccacgacggtagtcgttgacgtgcagcagcaccgacgggaccaccctaccgaacgtcctacctctccgacgaagaactaacaccgtaccggccctacgacggtactccgtacgagtacgaaggtcttactactcggacactccgtaacgtacggaacggacgaccacgaacgccccgttaccgtaccggaactaccgttaacggtaccgaccgttaccgaacggcgttaacgaccggaacggtaacgacgttacgtaacggtttactaaccgttcgaccttacgtaccgtanacggtacggaaccgttaccggaccttacgaggttcgggtcgggtttaccgggttttaccgggaccgggtaacggttaaccggtacggtccggtaccggttaccggtaaccggtccgtacgggtaacccgg

SEQ ID NO: 224546 - DNA, 701 bp, Homo sapiens
  misc_feature: GYAE6OF02GXCCI.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcaggtcggtccgaggcagggctgactcacgccacccgttcggtactccgaaggacttgagacagacccgcacactcacgtgcacgtaggaacaaacaacgaatcggttcggaccaacggacggacggttcggttggactcgacgacgcgagccaccgacgggaccccacccctacccgaaggtccctcccgtaccgtaccgaacgaacggtaaacttaacgacccgtacccggtcccgtacgacggtacctacgtacgaaacggtagtaacgtacgtcttcgcgacctaccgtaccgaggtcgaacggaaccgcgaaccgacgtccccttaccggaacgtaaccctaattaccggtccggaacctacccggtaacggtccgtaacggaaaccggcgtaaacgccggttaagttaacgtttaaacgtccttacgtccaacgtacgacctaaggtaccggaccgtacccgtcctagtcggtacggttcgggttcgggtttccgggaacggtacggaaccgaacgtcggtaaccgtacccggttcggtacccggtagacccggg

SEQ ID NO: 224547 - DNA, 730 bp, Homo sapiens
  misc_feature: GYAE6OF02JS6JY.10.1.A01.1.454.CMB.1.raw
  modified_base (586)..(586): a, c, t, g, unknown or other
  misc_feature (586)..(586): n is a, c, g, or t
tcagcatagtagtgcacgaccggtgctcgatttagacgtctcatcaggggctccaacagagcttcagcaagcatagtgggaatctgcaccatgccctgggctctgctcctcctgaccctcctcactcactctgcagtgtcagtggtccaggcagggctgactcagccacccgtcggtactccaaggtacttagagacacgaccgaccacactccacctgaccacgttacggggaaaccaaacaaccgtaacgtcggttacgggacccaaccgggaccggtacggttacggtttcggccgtgacgagcgacgaccgaacccggacgggtacccaaccccgttaccgaacgtcccgtacccgtcctacccggaccgaaggaaactaaccgtaaccgtacccggtcccctacgacgggtaactccgtacgaacgacgtaacggtacttacgtctacggactacgtccgaggttaccggaggaacgtaccgactcggaccccttccacggtacctacgttacgtacggtaccgtaccgtcggacgtaccgggtacgaaccggagtaccgtacgtaacgttactttaccgngttaccctgaacggactacgggtacggtacccaccgggtaccgtacgtacgggttcggtacggggtttacgggtttaccggggacgggtaaccggtacgtacggccgtaccggtaccgggttaccgtacggtcccgtaacccgg

SEQ ID NO: 224548 - DNA, 594 bp, Homo sapiens
  misc_feature: GYAE6OF02F7XA5.10.1.A01.1.454.CMB.1.raw
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (479)..(479): a, c, t, g, unknown or other
  misc_feature (479)..(479): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgcacactcacctgcactggaacaacaacaatgttggccacgacggagtcgtttggctgcagcagcaccgagggccaccctccaacgcctcctcnccgacaggaactaacnctcccggaccctcgacgggtatcctacagagagtattctctgcatccgaggtcaaggaagccaacacggcccttaccctacggtaaccctattaccgcgggtaaccctccggaacggtctacggaccgaacgtaacgtctagtaactttattaccgtagtcctacgacgntaacgtgggtaccgacccggtcctcgtaggtacggtccgggtttaggggtttaccggcgggtaacggaccgtaacggtcggtaccggaccggttccggtaggtcccgtaaccggg

SEQ ID NO: 224549 - DNA, 652 bp, Homo sapiens
  misc_feature: GYAE6OF02HCS3C.10.1.A01.1.454.CMB.1.raw
  modified_base (475)..(475): a, c, t, g, unknown or other
  misc_feature (475)..(475): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtcggtccaggcagggctgactcacgccaccctcggtactccgaaggtcttggacgacgacgaccgaccacacctcacctgcacgtaggaaacaacaacgaagttcggtacgaccacggacggacgttcggttaggctgcagcacgccaccgacggacccacccgtaccacgtcctcctccgaccgaacgaacggtaactaaccgtaccgtccccggtcctacggaacggctacgtacgacggaagacgttacttccgtagtcgactacgtacgaggtacgaggactaccacgaccgtcccctaccgtacgtactacgttaccgcggtaaccncggtacgcgtacgaacgacgtaacgcttaagtacttacgttactcgactagaccgactagggtaccgaccgaccggttccgcgtacggtccgggttcgggttccggggttacggaccgggtaaccggaaccgtacgggtcctacgggtaacccctttgggaacgtccgtaacccggg

SEQ ID NO: 224550 - DNA, 569 bp, Homo sapiens
  misc_feature: GYAE6OF02HROJ8.10.1.A01.1.454.CMB.1.raw
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggagcgtggtccagcctgggagtccctgacgactctcctgtgcagcctctgggttccaccttcaattacctatggcatgcacgtggggtccncaggcctccgaggcaaggggctgggagtgggtgctcttatctcatatgagtaggaaaattgtttaaattttngnacgtactccgtagaacgggcctattcactatctcagagacaattccgaaggtaaccacccttagtactctagaactaaatagaacacgccgtgaacgtagacgtacggacgacgaccggttactttacggtttacttaccgttaggtacgaccgtacgtacggacgtaccgtaggtaccttggaaccttttaaacg

SEQ ID NO: 224551 - DNA, 735 bp, Homo sapiens
  misc_feature: GYAE6OF02JJ604.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaagggacttgagacagaccgccacactcacctgcactgggaacaacaacaatgttggccacgacggagtcgtttggctgcagcagcaccgagggtcccaccctcccgaacgcctcctccgtaccgaacgaacggtaactaacgtacgtcccggccctacggacgggtactccgtaccgaaggacgtaacgtactttccgtacgtacgaccgtaacgttccccgaagggttaccgaagggaacggtacccgaaccgaaccggtaccccgttaccccgtacgtaacccttaagtttacccgtacgggtaaccccgtacccgtacgggtccgtttaacggaacccggtaaccgggtaacgtacccgtaagttacgtttaacggttacctcgtaaccgtaccggtacgtaccgtaacgggtaccggtaacccggtaccgtacccgtacgttagggtaccggtttccgggggttttaggtacccggggtaacgggacccggttaacgtacccggtcggtacccggtacccggttacggtaccggtaaccgtaccccggg

SEQ ID NO: 224552 - DNA, 625 bp, Homo sapiens
  misc_feature: GYAE6OF02HXKBH.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgacctcctcactcactctgcagtgtcagtggtccaggcagggctgactcagccacctcggtatccaaggacttgagacagaccgccacactcacctgcacgtggaacaacaacaatgttgccacgacggagtcgttgctgcagcagcaccgacgggaccaccccgtccaacgcctcctcgtccgaacacggaactaacacgtcccggccctacgacgggactctacgagagagtacttctctcgtacactccgaggtacgaaggtaacgccacgacgtcccctaccgtacgaaccttaagtttaccgacggtaaccctccgaggtaccgtacggaaccgacgtaacgcttagtaatttaacgttacgtcgtactcgacgacgtaaggtcggaaccgtcccggtactacgtacggtcggtaccgggttttcggggttaccgggacggggtacgggaacccgtaacggtccggttaccggtacccggttaccggttacggaccgtaacccggg

SEQ ID NO: 224553 - DNA, 657 bp, Homo sapiens
  misc_feature: GYAE6OF02HIA17.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacagaccgccacactcacctgcactaggaacaacaacatgtgaccacgacggtagttcgttcggctgcagcagccaccgacggcccacccctacccgaacgccttccctccgtacccgacgaacggaaactaaccgacgtccccggacccgtacgacgggactccgtcaagagagtacttcgtcgtagcacgtccgacggtacgacggaacgaccacgaccgtcccctacccgtacgtaacccgtaattaccgtacgtacctaccgacggccgtacgaaccggaacgtacgtcgtagtattacgttactcgtctacgacgtactacggtcggtaaccgtaccgtccgtacgtaacgggttcgggtacgggtttccgggggtttacgggaccgggtaacgggaaccggttaacggtccggtacccgggttacccggtaccggttaaccggtccggtaaccccggg

SEQ ID NO: 224554 - DNA, 765 bp, Homo sapiens
  misc_feature: GYAE6OF02IX2CF.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctccttctgaccctcctcactcactctgcagtgtcagtggtccaggcagggctgactcagccaccctcggtatccaaggacttgagacagaccgccacactcacctgcactggaacaacaacatgttggccacgacggaggtcgtttggtctgtcgagcacgcaccgacgggacccgacccctaccccgaaacgtccgtccctccgtaccgaccaacgggaactaaacacgtcccggccctaccgtacgggaactctacacggagagtattctcgtgactacgtccgaacggtcgaacgggtaagccaacgacgtaccccgtacccgttacggaacccttaactttaaccgtacgggaacccgtttcccgaagggtccgttaacgggaaccgaaccgggtaaagtccttaggttaacttttaacgtttaaccttccggtaccgttacgaacgaccgtaacgggttcggggaaccccgaacccgggttccccgtacgtaacgggtttcggggttaaccggggttttcccgggggggtttttaacgggggacccccggggttaaagggggaaccccggtttaaacgggccccgtttaaccggggggtaaccccccgggtttttaacccggggtttacggacccccggggttaaaccccggg

SEQ ID NO: 224555 - DNA, 497 bp, Homo sapiens
  misc_feature: GYAE6OF02H3C5A.10.1.A01.1.454.CMB.1.raw
  modified_base (378)..(378): a, c, t, g, unknown or other
  misc_feature (378)..(378): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (455)..(455): a, c, t, g, unknown or other
  misc_feature (455)..(455): n is a, c, g, or t
tcagcatagtagtgcacgaccggtgctcgatttagacgtctcatcagggggctccaaacagagcttcagcaagcatagtgggaatctgcaccatgccctgggctctgctcctctgaccctcctcactcactctgcagtgtcagtggtccaggcagggctgactcagccacctcggtatccaaggacttgagacagaccgcacactcacctgcactggaacaacacaatgttggccacgacggagtcgtttaggctgcagcagcaccagggccacccgtccaagctcctctccgacaggaataacatccggccctacacgggatctcagagagaattctctgcatccaggtcaggagcacagcctcctagacattacgngactcaggctggacacgaagctagattatactgcagacgnacngggacaccggtctcgagtgcggttgggtttcggnggaacgggaccaaggtcgtcgacccggtcgtacggtctacgg

SEQ ID NO: 224556 - DNA, 656 bp, Homo sapiens
  misc_feature: GYAE6OF02ITO07.10.1.A01.1.454.CMB.1.raw
  modified_base (179)..(179): a, c, t, g, unknown or other
  misc_feature (179)..(179): n is a, c, g, or t
  modified_base (354)..(354): a, c, t, g, unknown or other
  misc_feature (354)..(354): n is a, c, g, or t
  modified_base (406)..(406): a, c, t, g, unknown or other
  misc_feature (406)..(406): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagtcgttgggtttttcctcgtttgcttactttttaaagnggtgtccagttgtcaagtgcagctggcggagtcgtgggggagcgtggtccagccgtgggacgtccctggacgtactctccgtgtcgcagtcctcgttcgggttcctaccttcaaacttacctagtggcatcgctacgtcgggtccgccgaggcctccgaggcgaaggggctgggnggtgggtgcttcttagtctcattatgataggtaaatttagtttaaagttttngtacgacgtacgttaccggtaggaacggtccgtataccgacctacgttcctaccgaagtaacgtaactaaccgttaccgaacggtaaccctacccgttagtcttaccgtagtaactaaacgtacgaacacgtaccgtagaacgtacgacgtaccgaccgtaacgtacgttcgttttacggttttacgttacgttggtaaccgacggtaacgacggaacgtccgtacggtacgttacgtaacgtttaaccg

SEQ ID NO: 224557 - DNA, 836 bp, Homo sapiens
  misc_feature: GYAE6OF02GCB99.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacacctcaccgcactacggacggaacaacaactagttcggtaccgaccgaacggacggtacgtttcggtacgtcgtcgacgacgacgaccgaccaccgggaccggccccctaaccccgtaccgaacgtcccttaccgtaccggtaaccgtaacggaaacggtaaacctaaccgtacccggtaccccggtaccctagggaaccggtactaccgacgtaaggacgtaacgttcttacctacgacgtactaccgtacggtacggtacggaaggaccgaccgaaaccgcccttccccgtacccgtaacgtaaccttacgttaccggaccgtacccgtaccgggacgttacggtaaaccggaacccggtaacggtacgttaccgtttaagttaaccgttttacgttaccgtaccgttaacccgaaccgttacggtaaccgttaccgggggtaaccggtaaacccccgggcccgtttacccggtaacggttcggggttacccggggtttcgggggtttttacccggggggttaacccggggaacggggttaacccccggtaaggttacccggggttacccgtaacccccggggtttaaccgggttaaccggtttacccggtaccgggaaacccccccggg

SEQ ID NO: 224558 - DNA, 785 bp, Homo sapiens
  misc_feature: GYAE6OF02HZAG5.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcacatggagtttggctgagcttgggttttcctcgttgcttcgttttaagaggtgtccagtgtcaagtgcagctggcggagtcgtgggggagcggtggtccgagccgtgggacgtcccgtgacgactccgtccgtagtcgcacgtccgtcgtcgggttcctacctttacaaacttaccgtagtcggtactagtcggaccgtaccggtcggggttcccgacccgtagggtccctacccggacggaccgggaacgggggtccgttagggggaggtttcgggggtcggtaccgtttacttaacgtccgttactaagttacgtaggtacgtttaaaggttaaaacgttttaaggttttaaaattttagtacgtaaacgtaccggttaacgtttaccgggtaagggaaccgggttaccgttaaccgtttacccgaaccttaaccgttcctaaccggaacgtaaccgtaaccgttaaacgttacccggtaaacggtaacccgtaacccgttacgttaacgttccgaacgtaacgtaaacgtaacgaaccgtaccgtacgtaacgacgaaccggtacgaccggaaccggtactaccggttacgttttagttaaccgttacgtacggtacgacgtaacgagtacgacgttacgacgttacgtaacctttaccg

SEQ ID NO: 224559 - DNA, 785 bp, Homo sapiens
  misc_feature: GYAE6OF02GTSOB.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcagctggcggagtcgtgggggacgcgtggtccaggccgtgggacggtccctgacgacctctcctgtgcacgccttcgtcgggttccaccgtttacaacttaccgtagtcggcagttcgcctaccgttcggggtcccgccgagggtccctaccggacgggccgaacgggggtctaggggaggtggggtcggtccttacgttacgtcctactaagttgtacggtaagttagggtaaaattttacggtttttaaaattttacgtcgtaacgtaacgtacccggtttaccgggttaaggggaaaccggggtacccgttaactttacccgtaacccgtaacgtttacccgttaaccgaaacggtaaccgtaaacctaaaccgtttacccggaaaaccggtaacccccgttaaacccgtttagttaaccgttcctaacggaaccttaaaagtaaccggtaacccgtacgtaccgtaaggtaacgtacggtacctaaggacccgtacgtacgggttactttaggttttaacgttacgttcggtaacggtaccgtaaggaacggtacggaaccgttacggtaccgttacgtaaccttttaaccg

SEQ ID NO: 224560 - DNA, 759 bp, Homo sapiens
  misc_feature: GYAE6OF02I1IYA.10.1.A01.1.454.CMB.1.raw
  modified_base (257)..(257): a, c, t, g, unknown or other
  misc_feature (257)..(257): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtcggtccaggcagggctgactcacgccacctcggtactaccgaaggacttaggacgacacgaccgccaccactcacctcgccacgtagggaaacaacaacatcgtcgccacggnggagttcgttggctgcagcacgcaccgacgggcccacccgtaccgaagtcccgtcctccgtaccgaacgtaacggaaaccttaacgacgtccccggtccctacggacggtacttccgactaacggaacgtacgtcttactcgtcgtacaacgtcggtaaacggtacgaacgggtaacaccgactaccgtaccccgtacccgtacgaacccgttaacgttacgtaccggtaccgtacccgagggtcccgtaaggaaacccggaacgtaacgtacggttaagttaacgtttaacgtttaccgttacggtacctacggaacgaccggttaacggtaccgggaaccgttacccgggccgttaccgggtacggtttacccgggtttcgggggtttaccgggggttttacgggggaaacccggggttacggggtaaacccggtaccgggttcggtttaacccgggtaccgggtttaaccgttaaccggggttacccggaaacccgggg

SEQ ID NO: 224561 - DNA, 562 bp, Homo sapiens
  misc_feature: GYAE6OF02GV4G8.10.1.A01.1.454.CMB.1.raw
  modified_base (355)..(355): a, c, t, g, unknown or other
  misc_feature (355)..(355): n is a, c, g, or t
  modified_base (386)..(386): a, c, t, g, unknown or other
  misc_feature (386)..(386): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccacctcggtatccaaggcttgagacagaccgccacactcacctgcactggaacaacaacaatcgtgaccagacggagtcgttgctgcagcagcaccgaggccaccctccaagcctcctctccgaacacggaactaacgacgtcccggacctcgacggactcgtacagacgtagtacttctctcgctanaccgagtcgaaggacaccacacgccctccgngtacctattacgacgactcgaagcgtacgacgaacgacgtctagtacttactaacgtgtctacacgcgtaacgtcggaacctaccggtctacgacggttcggtcgggttacggtttcgggaccgggacggaccgtaacggtccgtacggtacccggttcgtacggtccgtacccgg

SEQ ID NO: 224562 - DNA, 807 bp, Homo sapiens
  misc_feature: GYAE6OF02HR87Z.10.1.A01.1.454.CMB.1.raw
tcagcatagtagtgcacgaccggtgctcgatttagacgtctcatcgaggggctccaaacagagcttcagcaagcatagtgggaatctgcaccatgccctgggctctgctcctcctcgaccctcctcactcactctgcagtgtcagtcggtccaggcgagggctgacctcacgcccacccgtcggtactacccgaagggtacgttaggaacgaccgacggacccgaccaccacctcaccgtgacacgtagggaaacaacaactaagttcggttcggaccaacggtacggtacggttcggtttacggctgcgacgcacggccgaaccgtacggaccctaccccgtaccgaacgtccctccctaccgtacccgaacgaacggtaaactaaccgtaccgtaccccggtaccctacggaacgggtactaccggtacgtaacggagtaacgtacgtttccgtcgtacgtaccgtaacgtaccggtacggtacggaacggaacgtaccgaaccgtaccggttccccgtacccgtacgtaacccgttagttaccgtaccgggtaacccttacccggacggttcccgtaacggaacccgtaaaccgggtaaacgccgtttaaacgggttaacttttaaccgttaccgtaccgtaaccgttcgaacggttacgtaaccgggtacggtacccgtacccggtacgtaccgggtaacggttccgggtacggggtttccggggtttaccgggaccgggaaccgggttaccacgggttcccggtaccggttaacccggttcggttaccggccgtaacccggg

SEQ ID NO: 224563 - DNA, 629 bp, Homo sapiens
  misc_feature: GYAE6OF02FW2PC.10.1.A01.1.454.CMB.1.raw
  modified_base (315)..(315): a, c, t, g, unknown or other
  misc_feature (315)..(315): n is a, c, g, or t
tcagcatagtagtgcacgaccggtgctcgatttagacgtctcatcagggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttgccacgacggagtcgttggctgcagcagcaccaggcccacccgtcccaagcctacctctaccgacaacggaaactaacnccgtacccggaccctacgagggactcgtacaggacgagtacttctcgtcgctaacgtcccgaggtaccgaagggaacaccgaaccacgtacccctcccctaggaccctaacgtttaccgtacgggaccctaccgaggtccgtaggaacccgaaccgaacgtccgttagtactttaagttacctgactgctacgagtcggacctaccggcctacgacggtcggtcgggtttccggggtttacggaccggggtaaccgggaaccggtacggccgttaccgggtaccccggttacggttaccgggccgtaacccggg

SEQ ID NO: 224564 - DNA, 880 bp, Homo sapiens
  misc_feature: GYAE6OF02G2ICE.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtcggtccaggcagggctgactcacgcccacccgtcggtactaccgaaggtacttgacgaccacggacccgaccaaccacctccaaccgtcgaccgtacgtacgggaaaaccaaaaccaaactaacgttggttacggacccgaaccggaccgggtaacggttaccggttttcgggccgttacggaccgacggaccgaacggacccgaaccccggaaccgggggtaccccccctaaccccccgttacccccgaaaccggtccccttttaccccgtaccccgttacccccggaaaaccgtaaaacgggtaaaaacccttaaaccgtaacccgggttaccccccgggtacccccgttaacggaacggggtaaccttacccgtacggaaacggtaacgtaacggttactttcgtaccgtcgacctacgttacccgtacgggtacgaacgggaacgccaaccgaccgtccccgtacccgtacgtaacccgttaacgttacccgtacggtaccccgtccggaacggtccgtaacggaaccgtacggtaacgtctaacgttactttagttaccgtacgtaccgtaacgacgtacgtaccggtaccgggaacccgtacccggtaccgttacgggttacggtaccgggtttcccgggggtttcggggtttaccggggaccggggttaaccggaaccggtacggttcggtacccggtacccggttacggttaccggtaccgaacccgg

SEQ ID NO: 224565 - DNA, 569 bp, Homo sapiens
  misc_feature: GYAE6OF02HCSII.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccgacgggccaccctcccaacgcctcctcctccgacaggaactaacactcccggccctcgacgggactcgtcagagagacttctctgcactccaggtacaggacgacacgacgtcctaccgtcgaccctattactcggacctccgaggctacgacgacgaagcgtagactttatacgtcgtctcagtcgtaacgtcggaccgaccggtcctacgacggtcggtcgggttcggggtttaccggacgggtacgggtaccgtacggtacggtccggtaaccggttccgtacgggtacgtaacccgg

SEQ ID NO: 224566 - DNA, 851 bp, Homo sapiens
  misc_feature: GYAE6OF02G0U9L.10.1.A01.1.454.CMB.1.raw
  modified_base (375)..(375): a, c, t, g, unknown or other
  misc_feature (375)..(375): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacacggccgaccacactcactgcactggaacaacaacatgttcggccacgacggagtcgttggctgcagcagcaccagggccacctccaagcctcctctccgacacggaactaacacgtccggaccctcacgggactctacagagagtacttctctgctactaccgaggtacgaagggtaacncgaaccgacggtaccctaccgacgttacggaacctacgttaaccgtacgggtaaccctaccgtaagggtacccgttacgggtaaacccgggaaccggtaaaaccggtaccggtttaaccggttaaacgtttttaaaacccgttttaccggttttaaccgggtaaccccgttttaaccgggtaaaccggttaacccgggttaaaccgggtttaaacccgggggggtaacccccggttaaaccccccgggttaaccccggttttaacccggttaaacccggggggtttaccgggtttaacccgggggggttttttaccggggggggtttttaccccgggggggtaaacccggggggggttaaacccgggggttaaaccccgggttaaacccggggtttaccccggggtttaaccccggggttaaacccccggggttttaaccccggggttaaccccgggggtttaaaaccccccgggg

SEQ ID NO: 224567 - DNA, 622 bp, Homo sapiens
  misc_feature: GYAE6OF02HQPJ0.10.1.A01.1.454.CMB.1.raw
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggaggcgtggtccagccgtgggaggtccctgagactctctgtgcacgcctctgggttccaccttcaattacctatggcatgcacgtcgggtcccnccaggcctccgaggcgaggggctggaggtgggtgctcttatctcatagtgagtaggaaattagtttaaattttagngctaagtaccttcggtaggaacgggtcccgtaacttaccgaacctagttccctacgaaagtacgaactaacgttacccgaaggaaaccctcccgttagtacttccgtagaacaaaagttacggaaactaggtcccgtagaacggacgtacgtacggaaccgacggacggttactttacgggtttaacttaccggttaggcgtaccggacgaaggcgacgtacgtcgttacgtaccgtttaaacg

SEQ ID NO: 224568 - DNA, 705 bp, Homo sapiens
  misc_feature: GYAE6OF02JXL7S.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtactccgaaggtacttgagacgagaccgccacactcacctgcactacgggaacaacgaacaagtgtcggaccacggacggtagtcgttcggcgtcgcagcgagacgaccgacgggtccacccgtcccgaacgaccgtccctaccgtccgaacgaacggaactaaccgtctacccggcccgtacgacggtactcgtacgagacgtacgtactttcactacgcctaactccgaaggtccgaaggtaacgaccgaccgaacgtccctacccgtacgaacccgttagttaccgaggttacccgtaccaggtaccctacggaacccgaaccggtacgcttaacggtaacgtttacttaacgtccgttacgtaccgtacgtacgttaacgggtaccgggaacgtacccggtaccgttacgtaagggttccgggttaccggttttacgggggttccgggttaacgggaccggtaaccggtaccggtaccggtaccggttacccggtaacccggtttacggaacccgttaacccggg

SEQ ID NO: 224569 - DNA, 784 bp, Homo sapiens
  misc_feature: GYAE6OF02JCMYN.10.1.A01.1.454.CMB.1.raw
  modified_base (208)..(208): a, c, t, g, unknown or other
  misc_feature (208)..(208): n is a, c, g, or t
tcagcatagtagtgcacgaccggtgctcgatttagacgtctcatcgaggggctccaaacagagcttcagcaagcatagtgggaatctgcaccatgccctggctctgctcctcctgaccctctcactcactctgcagtgtcagtcggtccaggtcagggctgactcaggccacctcggtataccaaggacttgaggacacgaccgccanaccgtacacctgcacgtgggaaacaacaacaagttgtacggccaacggacggtacgtcgtttacgggactcggactacggacacggtaccaacccaacgggggaccccaacccctccccgaaacgtcccttcccgtacctacccggaaccgtaacgggtaaaccttaaccgaaccgttccccggggacccttacggaacggggacttccggtacacggtaaggtacgtacttaccgttacgttacgacctacctcccggtaacggtaccgaagggaccaccgtaaccgtacggtcccctaccgtaccgtaactacgtttaaccgacggtaaccctaccgtacgggcttaacggaaccggtaacgaaccgggtacttaggtaaacccttttagtaacccgttcggaaccttaccggaacgtcgtaaacgggtttccggaaacccgtcccgggttacctaggtacggttcgggtccggggttttacggggttaccggtacccggggtaaccgggtaaccgtaccgggttccgtaccgggttaacccggtttacccggtacgggtacccgtaaccccgg

SEQ ID NO: 224570 - DNA, 688 bp, Homo sapiens
  misc_feature: GYAE6OF02GT3MC.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctctgaccctcctcactcactctgcagtgtcagtgtccaggcagggctgactcacgccacctcggtatccgaaggacttgagacagaccgccacactcactgacacgaggaacaacaacaatgttcgaccacggacggtgtacgttcggctcgacacgcgacgccgaaccgaacgggccctaaccccgaccgtaacggtccttacccgtccgttaccgaacgtaacggtaaaacgtaaccgacgtccccggtacccttacggacgggaacttccgtacgaacggacgacgtacttcgtactcgactacgtcgacggtacgaacggtacgacaacgtacgtcccgtacccgtacggtacctaaaccgtttaccgtcggaaccgtaccgtacggtaccgtaacgtaccggaaacgaacgtcgtaacgtaactttaacgttacgtcgtaccgtaacgagtaccgtaacgacggtaccgaccgtcgaccgttaggtacggttccggggttcggtttccgggaacgggtaaccggtaacgtacggtcgtaccggtacccggttcggtacggaccgttaacccgg

SEQ ID NO: 224571 - DNA, 545 bp, Homo sapiens
  misc_feature: GYAE6OF02GS6SR.10.1.A01.1.454.CMB.1.raw
  modified_base (301)..(301): a, c, t, g, unknown or other
  misc_feature (301)..(301): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
tcagcatagtagtgcacgaccggtgctcgatttagacgtctcatcagggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggagcgtggtccagccgtgggaggtccctgagactctcctgtgcagcctcgtgggttccaccttcaatacctatggcatgcacgtcgggtccnccaggcctccgagggcaagggggctgggaggtggggtgctcttatctcatatgatagtaaattgttaaatttngnagactcgtagaggcatcacatctcagacacatcagacctactntatcanacaatcgaacncgtaccgtagagacgcgtacgacgacgtacggtactttaggttttaacttacgttcggtacgaccggtaacgaggtacgaccgtacgtcgttacgttaactttaaaccg

SEQ ID NO: 224572 - DNA, 855 bp, Homo sapiens
  misc_feature: GYAE6OF02H79VX.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatgggagtttgggctgagcttgggttttcctcgttgcttctttttaagaggttgtccagtgtcaagtgcagctgggcggagtcgtgggggaggcgtggtccagccgtgggacgtcccgtgacgactctcctgtcgcagccttcgtgggttcctacccgtttacaacttaaccctagtcggcattcgactacggttcggggtccccgacccgagggcctacccggacgggaccggaacggggggtccgttagggggagggttgggggttacgggtccgtttaccgtttattcccgttaccgtaattaacgtttaggtaacggtttagggttaaaaagttttaacgggtttttttaaaaaatttttttacgacgggttaaccgttaaacggttaaccccgggttttacccgggttaagggggtaaacccgggggttaccccgttaaacggtttttacccccgaacccgttaacgtttaccccgtaaccgtaaacgggaaccgttaaaaccgttaaaccggtttaaccccggaaacggggtaaaaccccttaacccggttaccgtttaacttaccgttaacccggacttaaaacggtacgtaaaccgaccggtaccggttagaacggacgtcgttaacggaccgacgtaccggttcgtttacggttttctttacgtacgggtacgtaccgaggtaacggcgttacgacggttcgttacgtacgttttaacccg

SEQ ID NO: 224573 - DNA, 647 bp, Homo sapiens
  misc_feature: GYAE6OF02I25T7.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacggacggagtcgtttggctgcagcagcaccagggcccaccctcccaagcctcctctccgacaggaataaccacgtcccggccctcgagggtactacctcagagagtattcctctcgacacttccgaaggtacgaacggaacgaccgaaccgacgccctcccgtacgaccctaacgttaaccgtacggacctacccggaacggtcctacggtaaccgaaccggaacgctagaactttaacgttaccgttacgaccttacgacgtacgacgtacgggaacccgacccgggtacccgtacgacggttcgggtaccgggtttcgggggttttaccgggaccggggtaaccgggaaccgtaacggtccggttaccggtacccggttacccgttaacggtaccgtaaccccggg

SEQ ID NO: 224574 - DNA, 837 bp, Homo sapiens
  misc_feature: GYAE6OF02GWXGF.10.1.A01.1.454.CMB.1.raw
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagctggcggagtcggtgggggaggcggtcggtccaggccgtggggacggtccctgacgtactcctcctgtcgcacgtcctcgtgggttccaccttctaactacctagtggctagtcgtcgtacggtcgggtcccgccgacggtcctaccggacggacggaacggggtcggtaggggtagggtcggggtcgtccgtttactttaccttcgttacgtagtttaacgttaggtaagtttaaggttaaaagttttaaggtttttaaattttacggtagtaccgtaacggttacccgttacgggtaacgggtaacgggtacccgttaacgttacccgtaacccgttaccgtacccgttaccgaaggtaaaccgtaaaccgtaacccggttaacccgtaaaccggtaaaccccttacccggttaacgttacttaacccgtaacgtaaaccgtaaacggtaacgtaacccgttaacgtaaccgtacggaccggtaaaccggtcgaaaccgggtaccccgggtaaaccgttaccgggttttacgttttaacccggttttaacgtttaacccggttaggttaccccgtaacgggtaacggtaccggtacgacccggttaaaggtacccgtttaacgttaacccgtttttaaccgg

SEQ ID NO: 224575 - DNA, 638 bp, Homo sapiens
  misc_feature: GYAE6OF02HCX3A.10.1.A01.1.454.CMB.1.raw
  modified_base (262)..(262): a, c, t, g, unknown or other
  misc_feature (262)..(262): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggcttgagacagaccgcacactcacctgcactgggaacaacgacaatgttggccgacgacggagtacgttggctgtcgngcgacgcgaccgtacgggcccacccttaccgaacgtcctaccgtcctaccgaacgaacgaataacgacgtccggaccctcgtacggactctcgaagacgtagtacttctcgtacgtctacgtaccaggtcgaaggacgacacgacgtaccccgtcctacgaacctagttaccgtcggaaccgtccgacggacgtcgaaccggagaacgtacttgtaacgttaactacgtacgtccgtacaacgtccgtaaggtaccgggacctaccggtacctagtacggttccgggtcggtttaccgggggtttacggaaccggggtaccggtaacgtaccgggacgttccggttacccggtaccgttacggcccggtaacccgg

SEQ ID NO: 224576 - DNA, 682 bp, Homo sapiens
  misc_feature: GYAE6OF02FYSLG.10.1.A01.1.454.CMB.1.raw
  modified_base (179)..(179): a, c, t, g, unknown or other
  misc_feature (179)..(179): n is a, c, g, or t
  modified_base (261)..(261): a, c, t, g, unknown or other
  misc_feature (261)..(261): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcaccatgggagtttgggctgagcgttgggttttcctcgttgcttcttttaagaggtntccagtgtcaagtgcagctggcggagtcgtgggggaggcgtggtccagccgtgggacgtccctgagtacctctccgtgtcgnacgtcctcgttggttcctacttacaacttacctagtggacagtcgctaccggtcgggtcccgaccgtacggcctccgacgggacggtaagggggcgtgggagggttgggtcggtcttcgttatcgtctattacgtggaacgttaggtaaatttagtttaaatttcgtagtacgtacgttaaccgtcggtacgggtaacgggtccgtacgttaccaaccgttacgtacccgtacctaaggaaccgtaaccgtaacttaacccggaacgtaacccgtacccgttagttacctacgtaacgtaactaaacgtacgaaccgtagtaccgtagaacgcgtacgtaacgaccgtacgtccgttagttacgttaacttcgtaggtacggtacgagacgtacgcggtaagtccgtacttactttacccg

SEQ ID NO: 224577 - DNA, 709 bp, Homo sapiens
  misc_feature: GYAE6OF02GY5BQ.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgacctcctcactcactctgcagtgtcagtggtccgaggcgagggctgactcacgcccacccgtcggtactccgaaggtacttgagacacgaccgaccaccactccacctcgacacgtagggaaccaaacgaaactaagtggttcggaccaacggacggtagttcgtttcggcgtgcgagcagccaccgacggcccaccctccgaacgcctacctccgtaccgacgaacgaactaacacgtaccggccctacggacggtactctacgagagagtacttctctcgacctacgtccgacggtacgaggaacgtccgactacccgtaccctacccgtacgaccttagtttaccgtacgtacctaccgacgggtacgtaccgaacggaacgaccgtagttaacgtatttaacgtaccttcggtacctacggaattccgtaacggtaccggaacccgtaccggacccttacgggtaacggtttccgggttccgggggttttacggggtttacccgggacgggggttaaacggtacccgaaacgggttcccggttaaccggtaaccccggttaccggttaccgggtacccggaaaccccgg

SEQ ID NO: 224578 - DNA, 758 bp, Homo sapiens
  misc_feature: GYAE6OF02JGHIM.10.1.A01.1.454.CMB.1.raw
tcagcatagtagtgcacgaccggtgctcgatttagacgtctcatcaggggctccaaacagagcttcagcaagcatagtgggaatctgcaccatgccctggctctgctcctcctgaccctcctcactcactctgcagtgtcagtggtccaggcagggcctagactcgacgccacctcggtatccgaagggtacttgacgactagaccgcacactcactgcacgtggaacaacaactaatgttcggccacgacggacgttcgtttacggctcgacgacgcgagtcgaccgacgggcccaccctaccgaacgtccgtacctccgtcggacaacggtaactacgacgttcccggcccttacggacggtactaccgtaccgaagtacggaacgttacgttacgttaccgtcgtaccgtaaacgttcccgtaagggttaacccgaacgggtaaccgttacccgaaaccgtaccgggtacccctttccccgggttaaccgtaaaccccggtaacgttttacgggacccggttaaccgtaccgggtacgggtaaccgtttacgggaaccggaaaccggtaacgtacgtaccgttaacgttacggttaacgttaccgacgttacgtaaccgtgtaaaccgtacggtaacccgaccgtttcccgacgtacgtccgggttacccggttggggttaacccggaggttaacggacccgtaacccggttgaaccccggttaccgggtaacccgtaggtacccggtaacccgg

SEQ ID NO: 224579 - DNA, 627 bp, Homo sapiens
  misc_feature: GYAE6OF02F5OI3.10.1.A01.1.454.CMB.1.raw
  modified_base (303)..(303): a, c, t, g, unknown or other
  misc_feature (303)..(303): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagctggcggagtcgtgggggaggcgtggtccagccgtgggacgtccctgagctctcctgtgcacgcctcgtggttcaccttcaatacctagtggcactgcacgtgggtcccncgacggcctccgaggcgaggggctgggagtgggtgctcttactcgtactagtagtgaagtaggtaaattagtttaaattttagcggtatacgtaccgtttaccggtagggaaccgggtccgtatttaccccgacctaacttacccgaccaacggtaacgaacccgtaacgtttacccgaaacggaacccctacccgttgtaaccttacgtacaacgttaaatacggaaacgtacgtcgaagtacagtcgagtaccgacgtcggtcttaggtttataccggttgtcgacgaacgtacgacgtaccgaggtctagttacttaaccg

SEQ ID NO: 224580 - DNA, 741 bp, Homo sapiens
  misc_feature: GYAE6OF02GC4WP.10.1.A01.1.454.CMB.1.raw
  modified_base (191)..(191): a, c, t, g, unknown or other
  misc_feature (191)..(191): n is a, c, g, or t
  modified_base (443)..(443): a, c, t, g, unknown or other
  misc_feature (443)..(443): n is a, c, g, or t
  modified_base (717)..(717): a, c, t, g, unknown or other
  misc_feature (717)..(717): n is a, c, g, or t
tcagcatagtagtgcacgaccggtgctcgatttagacgtctcatcgaggggctgggagaggagcccagcactagaagtcggcggtgtttccattcggtgatcagcactgaacacagaggactcaccatggagtttgggctgagctgggttttcctcgttgctcttttaagaggtgtccagtgtacaagtcncagcctggcggagtcgtgggggagcgtggtccagcctgggacgtccctgacgctctccgtgtcgcagcctacgttgggttaccacccttagaaacttacccgtaattcgggacctaagttcgccacggttcggggtcccgaccgagggcctccggaagggtcgaaacggggggctaggggacggttggggtcggcttacgttagcctacattagtgaagtttaggtaaaacgttttagtttaaaatttttanggtaacccgtaggttaacccttacgggtacggggtaaaccgggtcccggtaactttaacccgtaaccctacttaacccgtccgtaaacggtaacggtaaaccttaaccgtttaacccggaaaccgggtaaaacccctccccggttttaaggtaaacctttccgttaacgaaccgttaaaagtacgaaaccgtaccgtacgtaggaacgtacgcgtaacgaccgtaccgtacggtctttagttttctaacggtgtaccggacgtaaccaggacgngtactcgttaccacttttaaaccg

SEQ ID NO: 224581 - DNA, 707 bp, Homo sapiens
  misc_feature: GYAE6OF02FT261.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttcggccacgacggagtcgtttagctgcaggcagcaccgagggccacccgtccaagctcctctccgacaggaactaacactccggccctacgacgggactctacgagagagattccgtctgcacgttccagggttcaagggtaacgaccgtaccgacgacccttaccctacgtaaccctaacgttaccgtacgggtacctacccgtaaggtccgttacggaaccgaaccggaaacgtaccgttacggtaaacgtttaacgtttaacgtcggtacccttacgtaacgtccgtaacgttacgggtaacccgaacccggggtaccccgtttacggacggtttacgggttccggggtttacgggggtttttacccggggaaccggggttaaccgggggtaaacccgtaaacgggttccccgggttaaccggtacccccggtttacccgggttaaccgggtacccggttaaaccccgggg

SEQ ID NO: 224582 - DNA, 758 bp, Homo sapiens
  misc_feature: GYAE6OF02IMW3S.10.1.A01.1.454.CMB.1.raw
tcagcatagtagtgcacgaccggtgctcgatttagacgtctcatcagggggctccaaacagagcttcagcaagcatagtgggaatctgcaccatgccctgggctctgctcctcctcgaccctcctcactcactctgcagtgtcagtggtccgaggcgagggctgactcacgcccacccgtcggtatccaaggacttgacgacacgaccgaccacactccacctcgcacgtaggaacaaacaacaatgtacggaccgacggacggtagttcggtttggctcgcagacacgccaaccgccggacccaccccgtacccaacgccttcccgtccgtaccgaacgaacggtaaactaacctaccgtccccggtaccgtaccggacggtactaccgtacgtaaggtaacgtacgtactttcgttcgtacgtacctacgtaccggtacggtacgaacgggaacaccggaacgtaaccggtccccttaccgtaccgtaaaccgtacgtttacccggtacggtacccttaccggtacgtaccggtaccgaaccggtaacggttaaccgtcgttaacgttaacgtttaccgttaacgtacgtacctacggtaacgtaccgttaacggggtaccgacccgtacccggttcctacggtaccgggttcggttcggggttttaccggggtaccggggtaccggggaacgttaccgtaaccgggtggttaacccgggttccccgtttacggtaccgggtacccgtaacccggg

SEQ ID NO: 224583 - DNA, 665 bp, Homo sapiens
  misc_feature: GYAE6OF02FKHY5.10.1.A01.1.454.CMB.1.raw
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctctttaagaggtgtccagtgtcaagtgcagctggcggagtcgtgggggagcggtcggtccagccgtgggacggtccctgacgactctccgtgtgcagtcctctggttcctaccttcaacttacctagtcggactatgacctacgtcggggtcccnccgacggcctaccgnggaccgaagggggctagggtaggtcgggtgccgttcttatctacatataggataggtaaaatttagtttaaattttagtacgtacgtaggtacctccgggtaagggaaccgggtacgtactttaccgaacctactcccgtaccgacgtaacgaacctaacgttaccgaacgtaaccctacccgttataactccgtacgtaacgtaaacgttacgaacctacgaccgtagaagactacgacgaaccggtacgtaacggtccgttagttttaacgtcggtcggtaccgtaccgaaggtacgacggtaccgtacgtccgttacgtaaccgtttaaccg

SEQ ID NO: 224584 - DNA, 823 bp, Homo sapiens
  misc_feature: GYAE6OF02IAC1H.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcgagtcggtccaggcgagggctgactcacgcccacccgtcggtactaccgaaggtacttagagacacgaccgaccactacctcacctgacacgtaggaacaacaacattcgtcggaccacggacggtagttcgttggctgacgagcacgaccgacgacggtccacccgtaccagccttcctccgtaccgacgtaacgaaactaccgacgtcccggacctacggacggtactccgtagaacgacgtacgtacgttcgtacgtcgtaacctaccgttaccgtacggtacgtaacggtaacacccgtaaaccgtacccggttaccccccgttaccgtaacggtaaacccttacgggtttaaccccggtaccgggtaaccgttaacccgggaacggtaacccgtttaaccgggaaaaccggttaacccggtaaaaccggtcgttaaaccggttacgttttttaaacccgtaaccgttcgtaaacccgtacggtaacccgttaaggtaccgggtaaaccgggaccccgtacccgggtttaccgtacgttaaaccggggttttggggttacccggggttttaccgggggtttacccggggaacccgggggttaaaccgaaccgggttaacccgttcggtacccgggttaaaccccggtttccggttaaacccggccgttaaccccggg

SEQ ID NO: 224585 - DNA, 630 bp, Homo sapiens
  misc_feature: GYAE6OF02FTIBF.10.1.A01.1.454.CMB.1.raw
  modified_base (211)..(211): a, c, t, g, unknown or other
  misc_feature (211)..(211): n is a, c, g, or t
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
tcagcatagtagtgcacgaccggtgctcgatttagacgtctcatcagggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggnggcgtggtccaggccgtggggacggtccctggagactcctcctgtgcagcctcgtgggttcctaccttcaactacctatcggcatcgcacgtcgggtccnctaggcctcgaggcgagggctggagtgggtgctcttactctacatangataggaaattgtttaaatttngactagtctcggtagacggcctatcactatcgtacagacgacctaattccgaacggtacctaccctagtaactcctaggaactaaacgtcgaaacctacgtaccgtacgaacgacggtaccgtacgggaacccgtacggtacccgggtacgtttaacggttttttaacgttaaccggtttcgggtacgttacccgtaaacggacggtaacgaccggtaacgtccggttaaccggtaaccctttaaaccgg

SEQ ID NO: 224586 - DNA, 773 bp, Homo sapiens
  misc_feature: GYAE6OF02HJ6Z9.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccgaaggtacttgacgacacgaccgtccacactccacctgacacgtacgggaaacaacgaacaagtgttacggccaacggaaccggtagtcggtttagctgacacgacacgcgaccgacgggcccacccgtaccaacgtcctcctaccgtccgacgaaggaaactaaccgacgtcccggcccgtgacgggactcgtaccgaggaacgtagtacttccgttacgtacgtaccgaactacccggtaaggtaccgtaacgggtaacgaccgtaaccgtacccggacccgttacccccgtaggtaacccgttaacgttaaccggttaacggtaacccgtaccggtacggtacccttaacggggaaaccccgttaacgggaacgtaccgggttaacggttaactttaaaccgtttacccgttaggtacccttacggtaacgtaccgtaaggttacgggaacccgacccgggtacccttacggtacgggttacccggttacggggtttccggggtttaaccgggtccggggtaaccgggtaaccggacggttaccggtaccgggtaacccggtacggtttacgggaccctaaacccgggg

SEQ ID NO: 224587 - DNA, 730 bp, Homo sapiens
  misc_feature: GYAE6OF02GATVD.10.1.A01.1.454.CMB.1.raw
  modified_base (153)..(153): a, c, t, g, unknown or other
  misc_feature (153)..(153): n is a, c, g, or t
  modified_base (488)..(488): a, c, t, g, unknown or other
  misc_feature (488)..(488): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcacatggagtttgggctgagcttgggtttccncgttgcttcgttttaagaggttcgtccagtcgtcaagtgcgagctagggcgaggttcgtgggggagcggtcggtccaggccgtgggacggtccctagtacgtacctctccgtggtacgcacgtcctcggttacgggttacctaccgtttacaacttacctacgtcggactaagttcgacgtacggtcgggtacccgtaccgaacgggttcctaccgggacgggtaccgaaggggggtaccgttggggtaacggtttgggggtacggtcctttacgttacgtaccgtactagttaacgtgtaacgttaggtaaattttaacgttaaagtttttaancgtactacggtaccgttacggtaacgggtacgggttaaccgtacgttaccctacgtaaccgttacctaccaaggtaaacgtaactaaccgttacgaaccggtaacctacgttgtaacctcgtacgtactaaacgtacgaacgacgtaccgagtacgaactcgtacgacgtaccgtacgtacgttacgtttacgtacgttgccggtacgaagacggtacacgtgtaccctagtactttaaccg

SEQ ID NO: 224588 - DNA, 569 bp, Homo sapiens
  misc_feature: GYAE6OF02IPGDH.10.1.A01.1.454.CMB.1.raw
  modified_base (287)..(287): a, c, t, g, unknown or other
  misc_feature (287)..(287): n is a, c, g, or t
  modified_base (471)..(471): a, c, t, g, unknown or other
  misc_feature (471)..(471): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagcccaccctcggtatccaaggacttgagacacgaccgccacactcacctgcacgtaggaacaacaacaatcgttcggaccacggacggagttcgttggctgcagcagcacgaggcccacccnccaagctcctctccgacacgaactaacacgtcccggcctacgaggtactcctacagagatacttcgtctagctaatccgaggtacgaggacacgactaccgtcctacccgtgaccctaagttacgtacgacctacgacggtctacgacggaacgtacgactagttaattacttactcgtctacncgacgacgtacggaccgtaccgccgtagacgtcggtcggttcgggttacgggacggacgggtacacggtccacgtccgtacgtaccggacgtaaccgg

SEQ ID NO: 224589 - DNA, 654 bp, Homo sapiens
  misc_feature: GYAE6OF02F10R6.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcacgcccacccgtcggtactaccaaggacttagacgacagacccgaccacactccacctcgacacgtaggaacaacaacaatcgttacggccacgacggagttcgtttaggcgtcgcagcacgcgaccgacgggacccacccaccgaacgcctcccgtccgtaccgacgaacggaactaaccgacgtccccggaccctacgacggtactcgtaccgagacgtaagtacttcgtcgtacgtctacgtccggtaggtacgaaggacgcgaacaccgtccccgtcccgtacgtacctaacgttacgacgacctaccgacggtctaccggaacggaacgtacgtcgttagtaactttactacgttgacctacgacgtactaacggtccggaccgtaccgtacctacggtacggtcggttcgggttcggggtttacggccggggtaacgaccggacggtcgtaccgggtacccgtcggttacggtccggtaaccgg

SEQ ID NO: 224590 - DNA, 583 bp, Homo sapiens
  misc_feature: GYAE6OF02GNM0D.10.1.A01.1.454.CMB.1.raw
  modified_base (353)..(353): a, c, t, g, unknown or other
  misc_feature (353)..(353): n is a, c, g, or t
  modified_base (389)..(389): a, c, t, g, unknown or other
  misc_feature (389)..(389): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
tcagcatagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccacctcggtatccgaaggcttgagacagaccgccacactcaacctgccacgtagggaaacaacaacaagtcgttcggaccaccggacggagtcgtttggcctgctagcagcacccgagggcccacccctccccaacgcctcctacctaccgacaaggaactaacacgtcccggcctcaggggctcncagagatattctctagctactccaggtacaaggacnctacgcgtaccctccgtacgacctagttacncggacctaccgnggtctcgacggaacagctagtagtttaactcgtactctacgacgtacgagttacggacgacccggcctatcggtggttccgggttagggtttccgggacgggtacggacccggaataccggtccgacccgtacggtacggtactaacccgg

SEQ ID NO: 224591 - DNA, 740 bp, Homo sapiens
  misc_feature: GYAE6OF02HSXUG.10.1.A01.1.454.CMB.1.raw
  modified_base (278)..(278): a, c, t, g, unknown or other
  misc_feature (278)..(278): n is a, c, g, or t
tcagcatagtagtgcacgaccggtgctcgatttagacgtctcatcaggggctgggagaggagcccagcactagaagtcggcggtgtttccattcggtgatcagcactgaacacagaggactccacatggtagtttgggctgagcgttgggttttcctcgttgtccttacttttaagaggtcgtccagtgtacaagtgcgagcgtggacggtagtcggtgggggaggcgtaggtccacgaccgtgggacgttccagacgacgttctaccgtgtacgccngtcccttggtacggttaccacccttataacttaccgtatacgccagtcgaccttaacggtccgggtacccgaccgaaggtacccgtaccgaagggtaccggaccgggggtagttacgggaacgggttgggtaccgttactacttttaacgttcctagtaaacgtagttagtaacgtaaacggttaaaattttacggttttaaaatttcgtaccggacgtaaacggttacccgttgtaaccgggaacgggtaccctacgttaaccgtaacaccgtactacgaacggtacacttaacgaccgaaacggtaaccctcccggtataactcgtaacgaacgtaacgtaaacgaccgtactaacgtacgacgaacgtaccgacgtaaccgtacgtacgttacgtttaccggtttaatacggtacgtacgaacgtacgacggtcacgtacgtccgtagttaccttaacg

SEQ ID NO: 224592 - DNA, 872 bp, Homo sapiens
  misc_feature: GYAE6OF02HK352.10.1.A01.1.454.CMB.1.raw
tcagcatagtagtgcacgaccggtgctcgatttagacgtctcatcaggggctccaaacagagcttcagcaagcatagtgggaatctgcaccatgccctggctctgctcctcctcgaccctcctcactctactctgcagttgtcgaggtcggtccgaggcgagggctgactcacgcccacccgtcggttactaccgaaaggtacttggacgaccaacggacccgaccgaacctaccgtaccacccgtcgaccgaaccggtaacgggaaaacctaaaacaaaccgtaaagttacggttaccggaccccggtaacggtaaccggggtaacggtttccgggttttaccggcgttaccggacgacggtacaaccggaccccgaaccgaaccccggggtacccccaacccccgttaaccccgaacgtcccctaccccgttccgtaacccggaaaccgtaacggtaaactaaaccgccggttaccccggccctacggaacggtacttccgaacgaacgaacggtaaccgttactttccgtacgtacggacctaacgtacccgtaaggtacggtaacggaacgtaccgaaccgtcccggtaccccttaacccgtacgtaaacccgtactttaaccgaccggtaaccgtccgacggtaccgaacggtacccggaagtaacgtcgttaacggtttactttaacgttaccgtaggtacctacggaactacggaacggttacccggaaccgtacccggtaccgtacgggtacggtttacggggttccggggtttaccggggttcggggaacccgggtaccggggtaacgtaccgggttcggtaacccggtttaccgggtaacggtacccggtaccggtaccggg

SEQ ID NO: 224593 - DNA, 794 bp, Homo sapiens
  misc_feature: GYAE6OF02HCYG8.10.1.A01.1.454.CMB.1.raw
tcagcatagtagtgcacgaccggtgctcgatttagacgtctcatcaggggctccaaacagagcttcagcaagcatagtgggaatctgcaccatgccctgggctctgctcctcctcgaccctcctcactcactctgcagtgtcaggtggtccaggcgagggtctgactcacgccctaccgtacggtactaccgaaggtccttaggacgacgacgacccgaccaacctacctccacctgacctaacggtacggaaacaaacaacgtagttcggttacggaccgacggaccggtacgttcccgtttggcctacggacacggcaacgtcccgaacccgtaccggggacccctaaccccgtaccgaaccgtcctacccgtaccgtaccgaacgaaaggtaaacctaacgacccgttcccggacctacgaggtactcgacgaggacgtactacttcgtacgtacaccgtacgttccgtaagggaccggtaacggaacggaccctaacggacccgttaccccgtacccgtaccggtaaacccgttaagtttaccccggtacggttaacccccgtacccggacggttaccgttaaacccggggaacgttaccggtaaacgtccgttaaacgttacgttaccgttacgtcgtacctacggtacgacgtcggtaccggacccggtacgttaccgtggtacgggtacgggttccggggtttcgggttacccggggacgggtaacccggtacgtacgggttcgtaaccccggtcggtttaacccgggttaggcccgtaacccgggg

SEQ ID NO: 224594 - DNA, 655 bp, Homo sapiens
  misc_feature: GYAE6OF02F5XOF.10.1.A01.1.454.CMB.1.raw
  modified_base (312)..(312): a, c, t, g, unknown or other
  misc_feature (312)..(312): n is a, c, g, or t
  modified_base (583)..(583): a, c, t, g, unknown or other
  misc_feature (583)..(583): n is a, c, g, or t
tcagcatagtagtgcacgaccggtgctcgatttagacgtctcatcaggggctgggagaggagcccagcactagaagtcggcggtgtttccattcggtgatcagcactgaacacagaggactcaccatggagtttgggctgagcttgggttttcctcgttgcttcttttaagaggtgtccaggtgtcaagtgcagcgtggcggagtcgtgggggagcgtggtccagccgtgggacgtccctgacgtactctcctgtcgcagcctgtgggttcaccgttcaatacctatggctagtcgcctacgtcgggtcccnccgagggcctccgagggccgaagggggctgggtaggtggggtcggcttcgttaatctactaattacgtgaagttaggtaaaattttggtttaaaattttgacgacgtaagtccgttacgtagggaaccgggtctaattccaaccgtattcctaaccgagtaactacctaacgttaccgaaacggaccctacccgttagtacctgtacgaactaaactaggaacctaacggtcgtaggaacgtaccgtcgtaacggaccgacgttaccgttntttacgtttactaaccgttgaccggtacggacgtaacggcgtaaccgtagtaccttacggtacctttaacgg

SEQ ID NO: 224595 - DNA, 732 bp, Homo sapiens
  misc_feature: GYAE6OF02FKJF7.10.1.A01.1.454.CMB.1.raw
  modified_base (172)..(172): a, c, t, g, unknown or other
  misc_feature (172)..(172): n is a, c, g, or t
  modified_base (178)..(178): a, c, t, g, unknown or other
  misc_feature (178)..(178): n is a, c, g, or t
  modified_base (200)..(200): a, c, t, g, unknown or other
  misc_feature (200)..(200): n is a, c, g, or t
tcagcatagtagtgcacgaccggtgctcgatttagacgtctcatcaggggtctgggagaggagcccagcactagaagtcggcggtgtttccattcggtgatcagcactgaacacagaggactcaccatggagtttggctgagcgtggtttcctcgtgtctctttaagaggtntcagtntacagtgcagctggcgagtcgngggggagcgtggtccagccgtagggacgtcccgtgacgacctcgtcctgtcgctacgccgttcgttcgggttacctaaccttacgaaaccttaccgatcggctatcggacctacgtcggggtccccacgtacggcctaccgacgggacgtaaacgggggtctaggggagggttcggggtacgtcctttcgtttaacgtcgtacgtaattacgtaggtacgtaaggttaaagttttaagttttaaacttttacgtacgtaacgaacggttacccttacgggaacgggtaaacgggtaccctaacttacccgaactactacccgtacgaacggtaaccgtaaacctaacgtaccgtaacggtaaccctacccgttagtactaccgtagaaccgttaaacgagaaacctacggacgtacgtacgtaagtaccggtacaacgttaccgtacggttactttcgtttaaaccggttacgtcggtacgaaccgttaagacggtacgtacgaaccgtacgttacttaaacgtttacccgg

SEQ ID NO: 224596 - DNA, 751 bp, Homo sapiens
  misc_feature: GYAE6OF02IIDVO.10.1.A01.1.454.CMB.1.raw
tcagcatagtagtgcacgaccggtgctcgatttagacgtctcatcaggggctccaaacagagcttcagcaagcatagtgggaatctgcaccatgcctgggctctgctcctcctgaccctcctcactcactctgcagtgtcagtcggtccaggcagggctgactcacgcccacctcggcactccgaaggtcttgacgacaggaccgccacactccaccgtgacctacgtacgggaaaccaaacgaactaagttcggttacggaccgaacgggaaccgggtcggtttcggtttaggcctggacgacgctacggaccacccggacgggacccctaacccctcccgaaggtcccttacccgtccgtaccggaacgaacggaaacttaaccgacgttccccggccctacggacggtacctaccgtacgaaggagtacggtacttccgtctacgactcgtaccgtaggacgtaaggacgacgaccgacgtcccctaccgtacgaaccttagttaccgtaccggtaccgtacccgcggtaccgtacgggaacccgtaaaccgtaagacctttaggtaacttttaaccgttaccgtacgacctttaaccggaacgttcccggacgggttaacccgggacccgttacccgggtacctacggttacgggttcgggttaccggggtttcgggggttaaccgggacggtaaccgggtacctacgggttccgtaccgggtaccgttaccgggtacgtaacccgg

SEQ ID NO: 224597 - DNA, 722 bp, Homo sapiens
  misc_feature: GYAE6OF02GID20.10.1.A01.1.454.CMB.1.raw
tcagcatagtagtgcacgaccggtgctcgatttagacgtctcatcaggggctccaaacagagcttcagcaagcatagtgggaatctgcaccatcgcccgtgggctctcgctcctcctcgaccctcctcactcactctgcgtagtgtcaggtcggtccgaggcgacgggtctacgacctcgaccgaccctacccgttacggtactacgaaggtacgtagaacgacgacgaccgaccacaccgtaccacgtcgacgtaacggtaacggaaaccaaacgtaacgtacgttcggtaccggaaccgacggtacgggttacgttcggttacggcgtacgaccgacggtacgaccgaaccgtacccggaccccggtaccccaccccgtacgtaccgtccctacccgtaaccggaaccgtaaacgaacgtaaccctacgtcccgtacccggacgacggtaacgactcggaacacggtagtacttctcgactcgtaccgacgtacggacgacgaacgaccaccgtaccgtccgtaccgtaccgtacgtaaacgttccgacgtaccgaccgacggtaacggacacgaacgtcgtatacgtatactacgtcgagacctagtcgtacggcgtaccgcgtaccgtggtcgttcggggttcggtacgggtcgggtaaccacggtaccgtaccgtcggtacccgttaccggaccggtacgtaccgtaccggtacccg

SEQ ID NO: 224598 - DNA, 730 bp, Homo sapiens
  misc_feature: GYAE6OF02FQJFE.10.1.A01.1.454.CMB.1.raw
  modified_base (241)..(241): a, c, t, g, unknown or other
  misc_feature (241)..(241): n is a, c, g, or t
  modified_base (690)..(690): a, c, t, g, unknown or other
  misc_feature (690)..(690): n is a, c, g, or t
  modified_base (710)..(710): a, c, t, g, unknown or other
  misc_feature (710)..(710): n is a, c, g, or t
tcagcatagtagtgcacgaccggtgctcgatttagacgtctcatcgaggggctgggagaggagcccagcactagaagtcggcagtgtttccattcggtgatcagcactgaacacagaggactcaccatggagtttgggctgagtcgttgggttttcctcgttgcttctttttaagaggtgtccagtgtcaagtgcagctggcggagtcgtgggggagcgtggtccagccgtgggacgtccngacgactctccgtgtgcacgccgttgtcggttaccaccgttacaacgttacctagtcggctacgtgtaccgtaccggttcgggtcccgaccgtacggtcctaccgagggtccgaagggggttcctaggggaagggttcgggggtacgtccgttacgttactccgtactaagttctaggacgttaaggtaaactttaggttttaaaacttttgacgtacaacgtaccgtacgggtaggaaccggtccgtacttacccaacgttactaccgtaccgtaaggaactacttaacgttacccgaacggtaaccttaccgtttagttacttacgtacgttaacgaacgtaccgaaaccgttgtaccgtacggtaatccggtaccgttaacggaccggtaaccgtaccggttacgttttaagtttaaccggtttccgttagggtcgttaacccggngtttaacggacgttaaccgnggttaccgtacgtttaaccg

SEQ ID NO: 224599 - DNA, 982 bp, Homo sapiens
  misc_feature: GYAE6OF02J2PP4.10.1.A01.1.454.CMB.1.raw
  modified_base (188)..(188): a, c, t, g, unknown or other
  misc_feature (188)..(188): n is a, c, g, or t
  modified_base (317)..(317): a, c, t, g, unknown or other
  misc_feature (317)..(317): n is a, c, g, or t
tcagcatagtagtgcacgaccggtgctcgatttagacgtctcatcaggggctgggagaggagcccagcactagaagtcggcggtgtttccattcggtgatcagcactgaacacagaggacctcaccgatcgggtagtttgggctagacgtcgttgggttttaccctcgttgtaccttcgttttaaggnggtcgtccaaggtcgtacgaaggtcgccaggccgttagggcggtagttccggttagggggggacgcggttcggtacccaggtccggtaggggtacggtacccgtagtacgtacttccgtccgttggtcnccgtacggtcccgttacggtccgggtttaacctaccgttaccgtaaacgttaccttacggtcggacttacgtcgtaccgtaaccggtcgggtaccctaccggaacgtccggtaccggaacgggtccggtaaccgggggtgttacgggacgggttgggggtcccgtccttacgtttacgacccgtttacggaagtttacggtacggttaacgtaaacggtttaacttttaaagtttaaaactttcggtacgtaccgttacgggttaacccgtttagggaacgggtaaccggtacccgtaacggttaacctaccgtaccggtttaacgaccggtaaacgtaccggtaaacccgttaaacggtaacccggtaacgggttaaacccccttacggtttaacgttaaccccgtcggttaaacggtaaaccggtaaacgttaaacccgggtaaaccctaccgggtaacgggttaaaccggtaccgggtaacggtttacccggaaacccgggacgttaacccgggttttacggtaccgtttttaaaccgggttaaccgttaccgggtttacggaaacccgggttttaacggaacccggtaaacgggttacccggtaaaccccgttttacgggtaaacccggtttttaccgtaaaccggtttttaaaccccggg

SEQ ID NO: 224600 - DNA, 575 bp, Homo sapiens
  misc_feature: GYAE6OF01BLDR5.17.40.D07.1.454.CMB.1.raw
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaacttatgctgactcagcccctctctgtgtcggggtctccggggaagacaataaccatctcctgcacccgcagcagtggcaacattggcagccaatatgtgcagtggtaccagcagcgcccgggcagttcccctagaactgtgatctatgaagatactgtcacgaccctccgggactccctgactcgggttctcgtcggctccggtcgtactacgtttcctcctaaactctcgccctcccttccaccctatcctctcggtactcgacgacgtggacgggaccggtagggtcaccgtactacctgtccacttacttacgtgtactagtactatttaacgtggacggcgtaattacgttcgggacgggaaggggaaccgtaaagggtcgaaccggttggaccttaaggcctaacggcccgtaaacggg

SEQ ID NO: 224601 - DNA, 585 bp, Homo sapiens
  misc_feature: GYAE6OF01CSU56.17.40.D07.1.454.CMB.1.raw
  modified_base (442)..(442): a, c, t, g, unknown or other
  misc_feature (442)..(442): n is a, c, g, or t
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgccacccgcagcagtggcaacattggcagccaatatgtgcagtggtaccagcagcgcccgggcagttccccctagactgtgatctatgaagtatactgtcagaccccgtccgggacttcccctgacttcgggttctcgtcggtcctccgtcgactacgttccctccaactcctcgccctccctcaccctatcctcgtgaccttggacctacgtggacggacggagggtntactactacgtcgttacacttcttatgtatagtactatttagagtaggacgtagttacggttcggggacgggtaacggggaacgtaaacgggtacggtaccgtacggtaccgttagggaccctaagggccccgtaaaccgggg

SEQ ID NO: 224602 - DNA, 701 bp, Homo sapiens
  misc_feature: GYAE6OF01BSDR7.17.40.D07.1.454.CMB.1.raw
  modified_base (311)..(311): a, c, t, g, unknown or other
  misc_feature (311)..(311): n is a, c, g, or t
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaacttttatgctgactcacgcccctctctgtgtcggggtctccggggaagacaataaccatcctcctgcacccgcagcagtggcaacagttggcagaccaatatgtgcaggtggtaccagcagccggcccgggcacgttccccagaactgtgatctatgaanatactgtacacgacccgtccggactcccgtagacgttcggttcctcgtcggcccgttccgtccgtactaccgttccctaccctacgtcctccgtccccttcccctaccacctacttcctcgtacggaccttacggaccgtacggtagggaacgggtaaccgggtagggttaaccgaaccctttaacgttacccgttcgttaacccgaaccttttcgttaacgttaggtaatttaccggaactttagttttaacggagggttaaccgggtacgttaacgttacgggttaccggggacggggttaacgggtaaacgtaaaacggggttccggaaacccgggttggtaacccgggttaacgggtacccgtaacccgggccccgtaaaccgggg

SEQ ID NO: 224603 - DNA, 565 bp, Homo sapiens
  misc_feature: GYAE6OF01A1S9R.17.40.D07.1.454.CMB.1.raw
  modified_base (221)..(221): a, c, t, g, unknown or other
  misc_feature (221)..(221): n is a, c, g, or t
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
  modified_base (449)..(449): a, c, t, g, unknown or other
  misc_feature (449)..(449): n is a, c, g, or t
  modified_base (473)..(473): a, c, t, g, unknown or other
  misc_feature (473)..(473): n is a, c, g, or t
  modified_base (491)..(491): a, c, t, g, unknown or other
  misc_feature (491)..(491): n is a, c, g, or t
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgnagcagtggcaacattggcagccaatatgtgcagtggtaccagcagccgcccgggcacgttcccctagaactgtgatctatgaagatactgtcacggaccctccgggactccctgacttcggttctcgtggcctccggtcgacctcgttcctaccctaactcctcgtccctccctccaacccnttccctcgtggtacctggaaccncgtaggacggtacggacgggttnaccttactacgtgtcacttcttancgtatacgattatttagngacggtcgtattacggttcggagggaagggacaaagggtcgacggtcgtacgtagggtccaggcccggtaacgg

SEQ ID NO: 224604 - DNA, 602 bp, Homo sapiens
  misc_feature: GYAE6OF01DSK07.17.40.D07.1.454.CMB.1.raw
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgccccgggcagttcccctagaactgtgatctatgaagatactgtcacgaccctcgggatccctgatcggtctctggctccgtcgactacgttccctacctacttccgtccgtccctccctaccacctactcctcgtcgacgtacgaccgtacgtaggaacggacgggtagggtacgtaaccgttacctacgttacgtccgtacttaccttagtacgtagtctaacttagttagtaggtaggtacgtagttacggttccgggacgggaacgggtaacggaaacgggtcgtaacccggtggtaccgttagggtaccgaccggtcccggtaacccggg

SEQ ID NO: 224605 - DNA, 710 bp, Homo sapiens
  misc_feature: GYAE6OF01ELM67.17.40.D07.1.454.CMB.1.raw
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgnagcagtggcaacattggcagccaatangtgcaggtggtaccagcagccgcccgggcacggttcccctagaactgtcgatctagtgaagtactactcggtacacggaccccgtccgggacttcccgtgtacgttccgggttctcgttcgggcccgttcgtaccgtaccgtaaccgtttcccgtacctaaccttaccgtccgtaccccttccccttaccaccctagttcccgttcgtacggaccgtacggaacccggtacgtacgggaacgggacggtaaggggtcctaaacgttacctacgttcgtcctaacgttcctttaagcgttaagttcggtaaaccttacgttttaagtaccgggtaacggtacgttaaaccgttaggttaccggggaacgggtaaccggggtaaacggtaaacgggtccgggtaacccggtagggttaaccccgttaaggggttacccaaccgggtaaccccggtaacccgggg

SEQ ID NO: 224606 - DNA, 716 bp, Homo sapiens
  misc_feature: GYAE6OF01C1QKA.17.40.D07.1.454.CMB.1.raw
  modified_base (238)..(238): a, c, t, g, unknown or other
  misc_feature (238)..(238): n is a, c, g, or t
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaactttatgctgactcacgcccctctctgtggtcggggtcgtccgggaagacaataaccatctcctgccacccgcagcagtggacaacnttggcacgaccaaatatgtgacgtaggtcggtaccagccgaggccggccccgggcctaacgttccccctagaactgtcgatctatagaagtactactgtcaccggtacccgtccgggtactcccgtagtacgttcggttctcgtcggtcctccgtacgacctacgttcccgtacctaactcctccgccctccccctacacctacttctccgttacggtacctacggaccgacgttacggaacgggtacggtacggggttacgtaaccgttaccgttaaccgtttcggtactaccgttttacgtttagtagttaacgtacgttaacctttagttttaacggtaggtaaccgggtacgttaaaccggtttacggggtacccgggtaaggggtaaaccgggggtaaaaccgtaaaacggggttccggaacggtttaccggacggtttaagggacccgtaacccggacccggtaaacccggg

SEQ ID NO: 224607 - DNA, 669 bp, Homo sapiens
  misc_feature: GYAE6OF01BR5BA.17.40.D07.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
tcagcgtagactagcacgaccggtgctcgatttagtgatagagcgtaacaacagaggggagctcaggaagcagagcctggagcatctccactatggcctgggctaccactacttctcaccctcctcgctcactgcacgtaggttcttcgggacctaactttatcgtctgactcgacgccctctctggtcggtcgggtcgtcgggganacaatacctntctctgaccaccgcgancgagtcgacaactagtggcagactaatatgngcgtaggtcgtacagcgacggccggccggactccgttacccgtagtacgtggtacgattacgtagtacggaatactacgtcgtacctaccggtaccccgtaccggaccttcccgtagtaccgttcggttactcggtcggtccttaccggtacgtacttaccgttccctaccgtaccttccgtacccgtccctcccgtacctaccgttacttccgtacgtacggtactacggaccgtagtacgggacggtacggtagggtacctacgtacgtactcgtactacttacgtatagttatacgttattacgttgacggtcgtacgtagttacgggacgggtaagggacgggtaaacggtacggtacggacggttacgtacggtaccggacgcccggtacgtacccggg

SEQ ID NO: 224608 - DNA, 570 bp, Homo sapiens
  misc_feature: GYAE6OF02IKSA0.17.40.D07.1.454.CMB.1.raw
  modified_base (218)..(218): a, c, t, g, unknown or other
  misc_feature (218)..(218): n is a, c, g, or t
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaactttatgctgactcagcccctctctgtgtcgggtctccgggaagacaataccatctcctgcacccgnagcagtgcaacattggcagccaatatgtgcagtggtaccagcagcgccggcacgttcccctagaactgtgactcgtatgaagatactgtcaacgaccctcgggtactccctgtactcggttctcgtcggctccgtcgactacgttcctcctaactctacgcctccctcaccactctctcggactgacgactcgacggacgagggtgactactacttgtcctattcctagtgtacttagactatttagtagacgacgtattaccggtacgggtaccggaacggggtaacgtaaacggtaccggtaccggtacgggtaccggttacggtaaccgtaccggaccccgtaacgggg

SEQ ID NO: 224609 - DNA, 804 bp, Homo sapiens
  misc_feature: GYAE6OF02JAEYP.17.40.D07.1.454.CMB.1.raw
  modified_base (198)..(198): a, c, t, g, unknown or other
  misc_feature (198)..(198): n is a, c, g, or t
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaactttatgctgactcacgcccctctctgtgtcggggtctccggggaanacaataccatctctgcaccgcagcagtggcaacattggcagccaatatgtgctaggtggtaaccagcaggtccgccccggggactacgttccccgtagaaccgttgtaggtacttaccgtaatacggtaaagaacgttaaccttggtaccgaaccggtacccccgttaccggggaacttcccccgttaggtaacgtttccgggtttaccttcggtcgggttcccttcccggtacgtaacccgttaccggttttacccctacccgtaaccttccgttccggtccccttaccccgtacctaaccccgtaacttcccgttacggttacggtacttaccgggtaaccgtaccgttagggaaccgggtaaccgggtaagggttaccgggtaaaccttaacggtttacccgttacggtaccttaaccgtttaccgtttaagtaccggtaattccgggtaactttaagtttaccgtagggtaccgtacgttaacgttacgggttccggggtaacgggtaaccgggtaaacggttaaccggggtacggtaacccgggtttaccggtacgggtttaaccgggtacccggtaacccggtaccccggtaaacccggg

SEQ ID NO: 224610 - DNA, 675 bp, Homo sapiens
  misc_feature: GYAE6OF02FOGC5.17.40.D07.1.454.CMB.1.raw
tcagcgtagactagcacgaccggtgctcgatttagtgatagagcgtaacaacagaggggagctcaggaagcagagcctggagcatctccactatggcctggggctccgactacttctcaccctcctcgctcactgcacaggttcttgggccaactttatgctgactcagccctctctgtgtcgggtctccggggaagacaataaccatctcctgcacccgcagcagtggcaacattggcagccaatatgtgcagtgtaccagcagcgcccgggcacgttcccctagactgtgatctatgaagatactgtcacgaccctccgggactcccgtagacttcgggttctccgtagggccttccggtaccgtactaacgtttcctcccgaacctcctcgtccccgtaccctcctaaccccattccctaccttagggacccttaggaccggtaccgtggaacgggacggtaacggtcgaacttaacgttacttcggttcctacgttacttttacgtactacgttacgaaaccttagtttttaagacgggtacgggtacgtaacgtttaaccggttcgggtaaccgggggtaacgggtaaacccgtaaaggggtttaaccgaacccgggtttacggtaccggtttaacgggtacccgtaaccgggtaccccggtaaaccggg

SEQ ID NO: 224611 - DNA, 934 bp, Homo sapiens
  misc_feature: GYAE6OF02I4RSN.17.40.D07.1.454.CMB.1.raw
  modified_base (133)..(133): a, c, t, g, unknown or other
  misc_feature (133)..(133): n is a, c, g, or t
  modified_base (160)..(160): a, c, t, g, unknown or other
  misc_feature (160)..(160): n is a, c, g, or t
  modified_base (178)..(178): a, c, t, g, unknown or other
  misc_feature (178)..(178): n is a, c, g, or t
tcagcgtagactagcacgaccggtgctcgatttagtgatagagcgtaacaacagaggggagctcaggaagcagagcctggagcatctccactatggcctgggctccactacttctcaccctcctcgctcactncacaggttcttcgggacctaactttangctgtactacacgccctntcgtgtggtcgggtcgtaccgggaagtacaactaaccatcctccgtcgaccacccgcagacgacggtcggaactaacgtagttcggcaaccgacctaatagtacggtgaacgtacggttacgtacgacgccgaggcccggacccggactaccggttaacccaacggtacgtcggtagtactacgttaagaacggaacttaacgtaacgttcgtaccggtaacccggtacccccggtttaccggacgtttacccgtaggttaaccggtttccgggttctacccgggtttaccgggtaccctttacccggtaaccggtaaccgtttaaccccgtttccccgtaaaccctttaacccgggtccccttccccgtttacccccgtaacccccgttaacccgaacgtttaccctttacccgggtaaacgttaaccggggtaacccggttaacggttaacccggaaaccgggttaacggggttaaaccgggtaacgggggtaaccgggtttaaaccttaacccgttttaaacccggttacggtttaaccgttaacgtttaaaccgttttacgtaaacggttacgtttaacgttaaacccggtttaagttttacggtttaaacggtccggttaacggttaccgggtttaaggtaccgggggtaaaccggggaaccgggtaaaacggggttaaccgtacgggggtttaaccgtacggttaaccggtaacggtaaccccgggtacgacccggtaacggtaccccgg

SEQ ID NO: 224612 - DNA, 693 bp, Homo sapiens
  misc_feature: GYAE6OF02JFU4G.17.40.D07.1.454.CMB.1.raw
  modified_base (533)..(533): a, c, t, g, unknown or other
  misc_feature (533)..(533): n is a, c, g, or t
  modified_base (545)..(545): a, c, t, g, unknown or other
  misc_feature (545)..(545): n is a, c, g, or t
tcagcgtagactagcacgaccggtgctcgatttagtgatagagcgtaacaacagaggggagctcaggaagcagagcctggagcatctccactatggcctgggctccactacttctcaccctcctcgctcactgcacaggttcttgggccaactttatgctgactcacgcccctctctgtgtcgggtctccgggaagacaactaaccgatccgtctgccaccgcacgcgagtcggacaactgttcggcagaccaatagtgtcgctaagtcgtaccagcacggccgccggctaccgttacccagtactgtagactctagagaagtctagtcgacctacgtacccgtacggtactcccgtagtacgttcgggttcctcgtcggtccttaccggtctaaccgtacgtttcccgtacctaaccttcgtcccgcccttacccctagaaaccccttgttcccgtacgttacggaccgttacggacccgacgtcgggtaacggaccgggttacgggtaactacccgttactacgttaccgngttaaccctttnttaacggacttaacgtacttaagttactttacggaacgtcgggttattaccggttacgggtaccgggggaaggttaaccgggtaaacgtaacgggttacgtacccgggttgtaacccgggttacgtacggacccgtacccgggtaacg

SEQ ID NO: 224613 - DNA, 801 bp, Homo sapiens
  misc_feature: GYAE6OF02JB8H8.17.40.D07.1.454.CMB.1.raw
tcagcgtagactagcacgaccggtgctcgatttagtgatagagcgtaacaacagaggggagctcaggaagcagagcctggagcatctccactatggcctgggctccactacttctcaccctcctcgctcactgcacgaggttcgttcgggccaactttatgctgactcacgccctctctgtgtcggggtcgtcgggaagacaataaccatcctcctgccacccgcacgcgaggtcggaccaacgtagttcggactacgacctaatagtgtcgacgtaacggttacggtaaccgacgacgacggcccgggcccgggtacctaaccggtttaccccgtaacggtaaccttggtacggtaacttaccgtagtaaggtaagaacttacgtcgttaccgaacggtaccccggtaccgggaccttccgttacggtaccgttttccgggttacctaccggtcggtcccgttaccggtacgtaacccgttaccggttaccccttaacccgtaccgttccgtacccgtccccttacccccgtaaccgtaccctaacgttcccgttacgtcgggtaaccgtacgaacccggttacgggtaggaaccggggtaacggtacgggttaactacctttaaccggtactacccgttaatacccgtttacgtagttaacgtacgttaagtaaacttacgtttaagggacggttaaccgtagttacggttaacggggtccggggtaacggtaacggttaaacgggtaacggtacgtacggtaggttaaccgtccgggtaacgaccgtacccggtaccg

SEQ ID NO: 224614 - DNA, 127 bp, Homo sapiens
  misc_feature: GYAE6OF01DCSYT.41.62.F07.1.454.CMB.1.raw
  modified_base (127)..(127): a, c, t, g, unknown or other
  misc_feature (127)..(127): n is a, c, g, or t
tcagtctatactatcacgaccggtgctcgatttagtagtcgcataaagggaaaggggctggccctgacgtgtttctgttcccaccctcctcatagtatagactgagcgggctggcaaggcgcatagn

SEQ ID NO: 224615 - DNA, 121 bp, Homo sapiens
  misc_feature: GYAE6OF02HFIVW.41.62.F07.1.454.CMB.1.raw
  modified_base (121)..(121): a, c, t, g, unknown or other
  misc_feature (121)..(121): n is a, c, g, or t
tcagtctatactatcacgaccggtgctcgatttagtagtcgcataaggaagggctggccctgacgtgtttctgttccgcctcctcatagtatagactgagcgggctggcaaggcgcatagn

SEQ ID NO: 224616 - DNA, 190 bp, Homo sapiens
  misc_feature: GYAE6OF01D7YZQ.38.14.B03.1.454.CMB.1.raw
  modified_base (190)..(190): a, c, t, g, unknown or other
  misc_feature (190)..(190): n is a, c, g, or t
tcagtcgatcacgtcacgaccggtgctcgatttagtgtgagtagttccgcgggtcagcctccaccaagggcccatcggtcttcccctggcaccctcctccaagagcacctctggggcacagcggccctgggctgcctggtcaaggactacttccacgtgatcgactgagcgggctggcaaggcgcatagn

SEQ ID NO: 224617 - DNA, 216 bp, Homo sapiens
  misc_feature: GYAE6OF01B1RNT.38.14.B03.1.454.CMB.1.raw
  modified_base (193)..(196): a, c, t, g, unknown or other
  misc_feature (193)..(196): n is a, c, g, or t
  modified_base (198)..(216): a, c, t, g, unknown or other
  misc_feature (198)..(216): n is a, c, g, or t
tcagtcgatcacgtcacgaccggtgctcgatttagtgtgagtagttccgcgggtcagcctccaccaagggcccatcggtcttccccctggcaccctccgtccaagagcacctctgggggcacagcggccctgggctgcctggtcaaggctacttccacgtgatcgacttgagcgggctggcaaggcgcatagnnnngnnnnnnnnnnnnnnnnnnn

SEQ ID NO: 224618 - DNA, 532 bp, Homo sapiens
  misc_feature: GYAE6OF01BV6UX.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggaggcttggtacagcctggggggtccctgagactctcctgtgcagcctctggattcacctttagtaactatttaatgagctgggtccgccagcctccgagggaggggctggagtgggtggccagcattaaccaagatggacgtagaaaaatctatgtggactctgtgaagggccattcgccatctccagacgacaacgaccaagaactcactgtggctgcacatgaacggcctaggacgaggcgacgacacggctgtcgtacttctggtgcgagaccgcccccagcggacgggcctacgaggtcgggagcgtaacg

SEQ ID NO: 224619 - DNA, 631 bp, Homo sapiens
  misc_feature: GYAE6OF01CVQL2.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatgggagtttgggctgaactggtctttttctcgtggctattttaaaaggtgtccagtgtgaggtgcagctgttggagtcgtgggggaggcttggtacagccgtggggggtccctgacgactctcctgtgcagcctctggattcaacctttaagaattatgccatgaactgggtccgccaggcctccgagggaaggggcgtggagtgggtctcatctatgagcgctagtgggtggtagggcagactactcgagacctccggtaggaacggggtcccggttactaccctactttacccagacgaactaaacttaccaaacgacacgctacgtctctagttaactgaacagtcctaggaaggtacggtcggaagggaccgaacgggcctaattaacgttaattacgtggtaggtaacggaaagaggttgggtacggggggttcggtaccggttcgggtaccccgtttaggacccgttcccgggtacggggggtaaccccgg

SEQ ID NO: 224620 - DNA, 759 bp, Homo sapiens
  misc_feature: GYAE6OF01DEQQF.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggtctttttctcgtggctatttaaaggtgtccagtgtgaggtgcagctgttggagtcgtggggagcttggtacagccgtggggggtccctgagtacctctcctgtgcacgcctctggtacttctaacctttaagaattatcgaccatgaacgttcgggtcccgccgacggcctccggaggggaaggggtcgtagggaggtcgggtctacgatcgtagtgacgcgtcgtaggtgggtaggtagggacaggtactacgtcgagtaccgtccggtaggaacggggtcccgttacaaccctacgtttaccgaaggaacgtaacctaaacgttaacccgaaaacgtaaacccgaccggtcctttacggttacccttacgttaacgtttaaactacggtaaaccgtacggtcccgttaagggaaacggtacgggtaccggaacgggaacccgtaccgggtacctaagttaacgtttaacgtttaaccgttgggtacggtaaacggtaaaaggttaggttaggggggttacggggggttcggtacccggttaccggggttacccccgtttagggtaaccccgggtttcccgggtccggggggtaaacccccggg

SEQ ID NO: 224621 - DNA, 692 bp, Homo sapiens
  misc_feature: GYAE6OF01D8GFD.38.14.B03.1.454.CMB.1.raw
  modified_base (266)..(266): a, c, t, g, unknown or other
  misc_feature (266)..(266): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggtctttttctcgtggctattttaaaaggtgtccagtgtgaggtgcagctgttggagtcgtgggggaggtcgttggtacaggccgtggggggtccctgacgactctcctgtgcngcctctggattcacctttaagaattatcgccagtcgaacgtcgggtccgccgaggcctaccggagggggaacgggcgtgggacgttgggtctcgatctagtgacgcgtcgtaggtggtgggtaggcagtactactcgagtacgtccggtaggaacgggtccggttaccaccgtactttaccgaagtacgaactaacttacccgaaagtaacccgacgtcttcggttccttacttagttaaacgtacgtaaacacggaccgtaggaacggacgtaacgggaaccggaaccgaacgggtaccctaagttaacttaacgtttaccgtaggtacggtaacggaaaaggtaggttaggggtcggggggtcgtaccggttccgggtaccccggtttaggaccccggttccgggtccggggggtaaccccggg

SEQ ID NO: 224622 - DNA, 627 bp, Homo sapiens
  misc_feature: GYAE6OF01CDT76.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggaggcttggtacaggccgtggggggtccctgagactctcctgtgcagcctctggatttcacctttaagaattatgaccatgaacgtgggtccgccaggctccgaggggacgggcgtgggagtgggtctctatctagtgagcgctaggtgggtggtagggcagactactcagtcctccggtggaacgggtccggttacaccgtactttaccgaaggtacgaactaaacttaccaaagaacacgtcttgtacctcttagttaactacgaacgtagaccgtaggacggtagtacggagacgaccggaccaattaactacgtttaccgtggttacgaccgtaaaggtacgttggggtacggggtggtaccgttcgggacccctttaggacccggttccggtcgggggaaccccgg

SEQ ID NO: 224623 - DNA, 709 bp, Homo sapiens
  misc_feature: GYAE6OF01DGVEK.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggtctttttctcgtggcttaatttaaaaggtgtccagtgtgaggtgcagctgttggagtcgtggggaggcttggtacaggccgttggggggtccctggagacgttcctcctgtgccagcctctggtacttacctaacctttaaagaacttatcgccatgaacgtgggtcccgcgaggctaccgaggggaagggctggagtcgggtctcgatctaatgacgcgtcgtaggtgggtaggtaaggggctaaggaacttaccgtcaacggaccgttaccggtacgggaaaccgggtcccggttaaccaacccgttacttttaccccggaaagtacggtaaaccctaaactttaccccgaaaaagggtaaaccctaaccggtcttacggttaccctttacgttaagtttaaagtacggaaacctacggtccctaagggaggtacgtacggaaccggaacgacccggtactaaattacgttaattactcggtaacggaacgtaaaggtacgttggggtggggtacgcgttcggcccttaggacccttcggcggggtaaccccg

SEQ ID NO: 224624 - DNA, 566 bp, Homo sapiens
  misc_feature: GYAE6OF01BJKC1.38.14.B03.1.454.CMB.1.raw
  modified_base (377)..(377): a, c, t, g, unknown or other
  misc_feature (377)..(377): n is a, c, g, or t
  modified_base (525)..(525): a, c, t, g, unknown or other
  misc_feature (525)..(525): n is a, c, g, or t
  modified_base (556)..(556): a, c, t, g, unknown or other
  misc_feature (556)..(556): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggaggcttggtacagccgtggggggtccctgagactctcctgtgcagcctctggattcaacctttaagaattatgccatgaactgggtccgccaggctccgaggggaagggctgggagtgggtctcatctatgagcgcgtagtggtggtagggcagactacncacgactccgtggaacgggtcccggttcacctactttaccgagacgacgtaaacttccgaaagaaccacgactgtaccttcttagttaactcgaacagtccaggagagtcgaaggacgacggacatattatacgtgtagacgtaaagngtgggtggggtgcgtcggtccttgccgtcgnggggtacccg

SEQ ID NO: 224625 - DNA, 176 bp, Homo sapiens
  misc_feature: GYAE6OF01A57V8.38.14.B03.1.454.CMB.1.raw
  modified_base (171)..(176): a, c, t, g, unknown or other
  misc_feature (171)..(176): n is a, c, g, or t
tcagtcgatcacgtcacgaccggtgctcgatttagtgtgagtagttcgcgggggggtgttcggcggagggaccaaactgaccgtcctaggtcagcccaaggctgccccctcggtcactctgttcccgccctcctcacgtgatcgactgagcgggctggcaaggcgcatagnnnnnn

SEQ ID NO: 224626 - DNA, 795 bp, Homo sapiens
  misc_feature: GYAE6OF01DLPXO.38.14.B03.1.454.CMB.1.raw
  modified_base (552)..(552): a, c, t, g, unknown or other
  misc_feature (552)..(552): n is a, c, g, or t
tcagtcgatcacgtcacgaccggtgctcgatttagtgtgagtagttccgcggggagctctgagagaggagcccagccctgagattttcagtgtttcatttggtgatcaggactgaacagagagaactcaccatggagtttgggctgaactggtctttttctcgtggcttattttaaagtgtccagtgtgaggtgcagctggttggagtcggtggggggaggtcgttagggtaccgacggtcccggttcgggggggttcccccttggacggtaccttccttcccgtggtcgccgacgtccctcgtggtactttcttaaacccgttttaagtaatttatcgacctagtacgtaacgttcgggtcccgccgaggcccacggaggggaacgggcgttacgggaggttcgggtctcgtactactaagtggacgcggtagttaggtgggtggtagggcgtaagtaccgtactcgacgtaccgtccggagggtaacgggtcccgttaccaccgttacgttaccgagtaacaactaacttaacccgaaagaacctacgtnttaccgttcttacgttaagtttaacgacgtaaccgtacggtaccgtagggaacgtacgggtaccggaagacccggtaccggtacctaagtttaacgttaacgtttacggttacggtacggtaaaccggtaaagggttacgggttaggggttacgggggggttcccgtaccgggtttacccgggtaccccgtttccgggtaaacccccgggttcccggggttacggggggaaacccccccgggg

SEQ ID NO: 224627 - DNA, 701 bp, Homo sapiens
  misc_feature: GYAE6OF01EY41U.38.14.B03.1.454.CMB.1.raw
  modified_base (442)..(442): a, c, t, g, unknown or other
  misc_feature (442)..(442): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggtctttttctcgtggtctattttaaaaggtgtccagtgtgaggtgcagctgttggagtcgtgggggaggtcgttggtacacggtccggtggggggtcccctggacgactctccgtgtcgcagcctcgtggtacttcctaaccgtttaaagaactttatcgacctaatcgtaacgtcgggtccgccgaggtccgtaccggaggggaacgggcgtagggtacggtgggttctcgagttctaagtggacgtcgtacgttagggtgggtagggtagggcgaacgtacttaacncgacggtaccgtccggtagggtaacgggtccgttaccaccgttaacttccgaagtaacgaaccttaacgttaaccgaaagaaccgtaccgtcgttaggtcctacgttacgttaatacgaaccgtacgtcctaggacgacggtaccggaacggaccgccgggtaacaacgttaatacgttacgtggtacgtacgaaaggtgtggggtacggggtcgtaccgtccgggttaccctaggtcccgtacggtccggggaaccgg

SEQ ID NO: 224628 - DNA, 719 bp, Homo sapiens
  misc_feature: GYAE6OF01BBD3U.38.14.B03.1.454.CMB.1.raw
  modified_base (312)..(312): a, c, t, g, unknown or other
  misc_feature (312)..(312): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggagcttggtacaggccgtggggggtccctgagactctcctgtgcagcctctggattcacctttaagaattatgccatgaactcgggtccgcaggcnccgaggggaagggctggagtgggtctnatctatgngcgcgtaggtgggtggtagggcaacgtacctacgtcgaagtacctccggtaggaaccggggtcccgtttacaacccgttacgttttcccgaaggtaacgtaaccgtaaacttcccgaaaagtaacccgacgtctttacggtccttcgtttaagtttaaacgtagaaaccgtacgtacccgtaggaacggacggttaccgggaacgggaccgtaacccgggacctaaagttacttaaacgttttacgtacgggttacgggtaaaacggtaaacgggttagttggggggtttacggggggttccgtaccgggttcgggttaccccccgttaagggttaccccggtcccggggttccggggggtaaacccccggg

SEQ ID NO: 224629 - DNA, 908 bp, Homo sapiens
  misc_feature: GYAE6OF01CWM57.38.14.B03.1.454.CMB.1.raw
tcagtcgatcacgtcacgaccggtgctcgatttagtgtgagtagttccgcggggagctctgagagaggagcccagccctgagatttttcaggttgttttcattttggtgatcaggactgaacagagagaactcaccatggagtttggctgaactggtctttttctcgtgacttaattttaaaaggtgtccagtgtgaggtgcagctggttggagtcggtgggggagtcgttggtacacggtccggtcggggggtccctaggacgtaccttccgtccgtggtcgaccgacgtcccttcgtaggtaactttaccttaaaccgtttttaaaagtaatttacgtcgtaccctaagttacggtaaaccggttcggggttacccccggacccggtacggtacccgttacccggggaagggggtaacggggtccggttagggtacgggttcgggttcctacgtactacgttagtcggacggtcgtacggttagggttgggtacggggtacgggaccgtaacggtaaccgttaccgacgtaacggtacccggttccggggtaacgggtaaccggggttccccgggtttacctaaacccgttacgtttacccgaaaggtaacgtaaaccgttaaccgttaacccgaaaacgtaacccgtaccgtcgttaccgttaccttacgttaaggtttaacgtacgaaaccgtacggtaaccgtaagggtaacggtacggtaaccgggaacggaaacccgtaaccgggaccttaagttaaacgtttacgttaccggttaggtaacgggtaaacggtaaaggttagggttcgggggttacgggggttcccgttacgggttacccggttacccgtttaccgggttaacccgggttcccggggtaacccggggggtaaacccccggg

SEQ ID NO: 224630 - DNA, 734 bp, Homo sapiens
  misc_feature: GYAE6OF01DBKU4.38.14.B03.1.454.CMB.1.raw
  modified_base (279)..(279): a, c, t, g, unknown or other
  misc_feature (279)..(279): n is a, c, g, or t
  modified_base (679)..(679): a, c, t, g, unknown or other
  misc_feature (679)..(679): n is a, c, g, or t
tcagtcgatcacgtcacgaccggtgctcgatttagtgtgagtagttccgcggggagctctgagagaggagcccagccctgagattttcaggtgttttcatttggtgatctaggacctgaacagagagaactcaccatggagtttggctgaactggtcttttctcgtggcttatttaaaggtgtccagtgtgaggtgcagctgttggagtcgtgggggagtcgttggtacgacgcccggttggggggtcccctggacgtacctccgttccgtggtcgacncgtcccttcgtaggtactttaccgtaaccgttttaaagtaactttaagtcggacctagtacgtaaccggttcggggtccccgtaccgaacgggtcccgtaccggaagggggaacgggtccgttaggggtacgggttcgggtttcctacgtacgttctaagttcggacggtcgtcgttaggttgggtacgggtaggcgagtacgtactacgaacgacgttccggtacgggaacgggtccgttaaccgaccttagtttacccgaagaacctacgtaacgttaccgaaaagacctccgtacgtttctccgttattaaggttacgtagaaccgagtctaggaagtacgacggtacgacgacgactaatacttaagtcgtgtacggtaaacgaagtggttcgggnggggttcgcccgttcggtacccgtttaggacccgttccgggtggggtaaccccgg

SEQ ID NO: 224631 - DNA, 771 bp, Homo sapiens
  misc_feature: GYAE6OF01B6NQF.38.14.B03.1.454.CMB.1.raw
  modified_base (297)..(297): a, c, t, g, unknown or other
  misc_feature (297)..(297): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggcttttctcgtggctattttaaaaggtgtccagtgtgaggtgcagctgttggagtcgtggggagcttggtacagccgtgggggtccctgacgtactcgtccgtgtcgcagcctcgtggtacttcctaacctttaaagaatttancgaccagtcgaacgtcgggtcccgaccgacggcctaccggaaggggaacggggcgtagggaggtcgggtctcgattcgtagtcggacgcgtacgttagggtgggtacgggtacgggactaacgtaacctacgtaccgaacggtacccgttccgggtaagggaaaccgggttcccgggttaccgtaacccgtaaccgttttaccgaacgtaaacgtaaacccgtaaacgttaacccgaaaacgtaaacccgaccgtaccgttaccggttaccttaccgttaaggtttaaacgtacgtaaaccgtacgtaacccgttaggaacggtaaccgtacgggaaacggtaccggaaccggtacctaaagtaactttagttacgtagggttacgaacgggtaaaggtaggttgggtcggggtacggtcgttacccgggtacccgttaccggtaccggttcccgggtacggggtaaccccggg

SEQ ID NO: 224632 - DNA, 731 bp, Homo sapiens
  misc_feature: GYAE6OF01D8T9I.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctatttaaaggtgtccagtgtgaggtgcagctgttggagtcgtgggggagcttggtacaggccgtgggggtccctgacgactctcctgtcgcagcctcgtggacttcctaacctttaaagaattacgtgacctaatggaaccgttcggggtcccgaccgaagggccgtaccggaagggggaacggggccgtggggaggttcggggtctcgtattacctagtcggaggcgtacgtagggtgggttgggtagggcaaggtcctaactacgagtaccgtccggtaggaacgggtcccgttacaaccctacgtttaccgagtaacgaacctaaacttacccgaaagtaaccaccgtctacgtcttacgttagtttaacgtacgaacgacgtaccgtggaacgtacgggtacggacggtacgaccggacctaattaacgttacgttacgtggtacggtaaacggtaaaaggttcggttggggttacgggggtcggtaacccgggttccgggttacccccggtttaggtaacccccggtttcccggggtccggggggtaaaacccccggg

SEQ ID NO: 224633 - DNA, 939 bp, Homo sapiens
  misc_feature: GYAE6OF01B235A.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatggtagtttgggctgaacttggttctttttctcgtggtacttaagttttaaaaggtgtccagtgtggtaggtgcagtcttggttggagtcggtgggggaggtcgttggtacgacggtccggttcggggggtccctaggacgtacttccgtccgtgtcgccgacgtccttcgtacggtaactttaccttaaaccgttttaaagtaactttaacgtcgtacctaagttaacggtaaccggttccggggttaccccgaccggtacgggtaccgtaaccgggtaaagggggaacggggtcggttaggggacgggtttcgggttacctacgtaacgtacgttagtacggaacggtccgttaggtaggggttggggtacggggtacggacgtaacgtaaccgttacgtcgtaaccggtaccggtaccgggtaacgggtaacccggggttacccgttaccgtaaccgttaaccggtttaccgaaggtaaaaccgtaaacccttaaaaccgttaaccgaaaaaccggtaaaccctcggtacccgtttacgttacccgtttagttttaaacggttaacgtaacgtaaaaccgtcggttacccgtaagggaaacgggttaccgggaacgggtaaaccgggacccgtaaccgggtacccttaaagtttaaccgtttaaccgttacgggttagggttaaacggaaacgggttaaaagggtgggtttaaccgggggttggggttaaccccggtcgggtttacccgttacccggtttaccggtacccgggttcccggggacgggggtaaaccccccggg

SEQ ID NO: 224634 - DNA, 764 bp, Homo sapiens
  misc_feature: GYAE6OF01CEDMU.38.14.B03.1.454.CMB.1.raw
  modified_base (274)..(274): a, c, t, g, unknown or other
  misc_feature (274)..(274): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggtcttttctcgtggcttaattttaaaaggtgtccagtgtgaggtgcagtctggttggaggtcggtgggggaggtcttagggtacaggccggtggggggtccctggacgactctcctgtgcngcctctgctattcctaacctttaagtaacttaatttaatgacgtcgtcgggcccgcctacgcccgtacggaaggggaacggggtcgtgggacggtcggggtcggaccgagactaacgttaaaccgaaaggtagtacgggtaaacgtaaagaaaaaacttactaagtacggtaggtaacttacgttagggtaagggtaaaccgggccttaacgttccgacccgttactaccctaccgaaggaacgaaacccgaaaccgaaccaaacgtaaaccctctaacgttcggtaccggtccgtagaccaacgtaacgttacgggaaacccggtaccggaggaacgggacgggaaccgtaacccggaacggcccgttaggttcgggtaattccgttaacggttgggtaccggacccggtaaacggacccccgacccccgtaaagggtaccgggtacggggacccttagggtacggggtacggggaccgttaaaccggg

SEQ ID NO: 224635 - DNA, 868 bp, Homo sapiens
  misc_feature: GYAE6OF01BUDXX.38.14.B03.1.454.CMB.1.raw
  modified_base (835)..(835): a, c, t, g, unknown or other
  misc_feature (835)..(835): n is a, c, g, or t
tcagtcgatcacgtcacgaccggtgctcgatttagtgtgagtagttccgcggggagctctgagagaggagcccagccctgagtattttcaggttgttttcagtttggtgatcaggactgaacagagagaactcacagtgtagtttggctagaactggttcttttcgtcgtggtacttaagttttaaaggtgtacgagtgtgaggtgcagcgttggttggagttcggtagggggtacgtcgttaggtacgtggtcccgggttggggggtccctaggtaacggtacccgttccgttcccgttaggtcggacccgtaacggtcccccgtttggttaccgggtttaactttacccgttaaaaccgtttttaaaggtaaaactttcgtaccggtacccttaaggttaccgggtaaccggttcccggggttaccccggaccgtaccggtacccggtaaccggtaaggggggagggttccgtaggggtacggttcgggttaccctacgtaacgttccgtttaaggcggaccggtccggtaaggtttgggtacgggtaggggtacgggactacgggtaacttaccgtacggaaccgtaccggttaccgggtaacggggtaccgggttacccgttaccgtaaccgttaacgtttaccggaaacgggtaacctaaacggtaaacctttaaacggaaaccgtaacaccggtttaccgtaacgtttccgttaacttaacggttaacgtacgaaaacccgtgtaccgtaacgggagttaaccgggaacgacggtaccgacgtactaagtacttacgtacgtgaacgtaggtagtcggtagggttcggngtcgtcgtccgtcaccgggttcgcggggtaccg

SEQ ID NO: 224636 - DNA, 753 bp, Homo sapiens
  misc_feature: GYAE6OF01B1UY7.38.14.B03.1.454.CMB.1.raw
  modified_base (686)..(686): a, c, t, g, unknown or other
  misc_feature (686)..(686): n is a, c, g, or t
tcagtcgatcacgtcacgaccggtgctcgatttagtgtgagtagttccgcggggagctctgagagaggagcccagccctgagattttcaggtgttttcatttggtgatcaggtactgaacagagagaactcaccagtggagtttggctgaactggtctttttcgtcgtgtacttaagtttaaaggtgtacctagtgtgaggtgtagcgttgttggacgtcggtgggggagtcgttggtacgacggtccggtcggggggtcctaggtacgtaccttctccgttgtcgactacgccttacgtggtacttacctaacgtttaagtaactttagcgacctagtcggtaaccggtcgggtcccgacgtacggccgtacggaggggacggcgtaggtaggtcggtactacgagttcgtagtacggacgtaccggtaggtagggttgggtaggggtacggacgtaacggtaacttccgtaacgtaccgtaaccggttccggtacgggaaaccgggttccccggtaaccttaacccgttcgttacccaaagggtacaaaaccgtttaactaaccgggaaaactaccgacgttccgtttaactcgtttaacggttagtaacgtacggaactaccggtccggttaaggaacgtaccgggtacgaaggaccccgtagaaccttaagttatacgtcgnggtaacggaaagaggtgtcggggttggaccttcgggactcctaaggccccgtggtagggcgtaacgg

SEQ ID NO: 224637 - DNA, 838 bp, Homo sapiens
  misc_feature: GYAE6OF01ES6V7.38.14.B03.1.454.CMB.1.raw
  modified_base (777)..(777): a, c, t, g, unknown or other
  misc_feature (777)..(777): n is a, c, g, or t
  modified_base (789)..(789): a, c, t, g, unknown or other
  misc_feature (789)..(789): n is a, c, g, or t
tcagtcgatcacgtcacgaccggtgctcgattttagtgtgagtagttccgcggggagctctgagagaggagcccagccctgagattttcaggtgttttcatttggtgatcaggactgaacagagagaactcaccatggtagtttggctgaactggtctttttcgtcgtggtacttaattttaaaaggtgtcctagtgtgaggtgcagcgttggttggacgtcggtagggggaggtcgttaggtaccgacggtcccggttcggggggtccctggacgtacctccgttccgtggtcgccgacgtccctcgtggtactttaccttaaacgtttaagtaattacgtacgcctaagttacggtaaccgtttcggggtaccccgaccggtaccgggtcccgttacccggggaaggggggtaacgggggtccggttaggggtaacgggtttcgggttaccgttaaccttacgttaccgttaaggtacggtacggtcccggtaccggttaagggggtttggggttacggggtacgggaaccgtaacgtaacccgttaaccgtacggtaacggtacccggttacccggttaacggggaaccggggttaccccggtttaccgtaaccccgtttaccggtttaaccgaaccggtaaactaaacccgttaaaccgttaacccaaaacggtaaccccgaccgttacgttcgttaccgtttaccttaaggtaaactacgaaccgtacgacgtacggagtcggtaacgagaccgacgacattagtattacgngagtacgtaagnggttcggtgggtcgcgtcgtaccgttaggccgtcggggtcggaacccgg

SEQ ID NO: 224638 - DNA, 712 bp, Homo sapiens
  misc_feature: GYAE6OF01EIK4X.38.14.B03.1.454.CMB.1.raw
  modified_base (591)..(591): a, c, t, g, unknown or other
  misc_feature (591)..(591): n is a, c, g, or t
  modified_base (598)..(598): a, c, t, g, unknown or other
  misc_feature (598)..(598): n is a, c, g, or t
  modified_base (646)..(646): a, c, t, g, unknown or other
  misc_feature (646)..(646): n is a, c, g, or t
  modified_base (686)..(686): a, c, t, g, unknown or other
  misc_feature (686)..(686): n is a, c, g, or t
tcagtcgatcacgtcacgaccggtgctcgatttagtgtgagtagttccgcggggagctctgagagaggagcccagccctgagtattttcaggtgttttcatttggtgatcaggactgaacagagagaactcaccatggtaggtttggctagaacgttggttctttttcgtcgtggtcttaagttttaaaaggtgtaccagtgtgaggtgcagtctggtggaggtcggtggggaggtcgttggtacgacggtccggtcgggggtccctagacgtacctccgtcgtggtcgccacgtccgttcgtggtactttacctaaccgtttaaagtattatacgactacgtaggaaccgttcggtccgccgacggtaccgtaccgggaacggggtaacgggtacggtagggtacggttcgggtactcgtacgttacgtagtaggaccggcggtacgttaggggtcggggtacgggtacggcgtaaacgtaccgtaacgtacgacgtaccggttacggacggtaaccgggtccgtacctaacgttactacgaagactacaacgtacgaaagtacctgtcttactcgttacgtagttaacncgtaacngttccaaggtagcggtacgagacccgtcgaactcgttatagttacggngtacgaagtaaggtgtcggggtcgcgtcgtacccggtacnccggtacggtaccggcgggtaaccgg

SEQ ID NO: 224639 - DNA, 900 bp, Homo sapiens
  misc_feature: GYAE6OF01CHO20.38.14.B03.1.454.CMB.1.raw
  modified_base (170)..(170): a, c, t, g, unknown or other
  misc_feature (170)..(170): n is a, c, g, or t
tcagtcgatcacgtcacgaccggtgctcgatttagtgtgagtagttccgcgggagctctgagagaggagcccagccctgagtatttttcgaggttgtttttcatttggtgatcgaggactagaacagagagaactcaccagtggagtttggctgaacttggtctttttcncgtggtacttaagttttaaacggtgtcgagtgtagtaggtcgcagtcgtggttgggagtcggtagggggaggtcgtttagggtaaccgacggtccgggttcgggggtcctaggacgtaccttccgtccgtggtcgaccgtacgtccgttacgttaggttaacctttaccttaaaaccgttttaaagtaaactttacgtacgaccgttaacggtacgttaaccccggttcgggtaccccggtaacccgacgggtcccggttaaccggggaacgggggtaaccgggtcgtagggtacggttagggtaccttagttacgtcgtaagtcggacgtcgttacggtagggttaggggtacggaaggtaccgtaacggtaaccttacgtaccgtacggtaccgtttacccgggaacggggtacccgggttaccgttacccgtaaccgttaacgttcccgaaaaggtaacctaaaccgtaaaaccgttaaccgaaaacgtaccctacggtacccttacggttaaccttacgtttaagtaaacgtacgtaaccgacgtccggtaagtacggaacgtcccgggaagacccgttaccgaacgttaaacttagttaaaccggttcgtaacggtaacggtaaggtaaaccgggttacggtgggggttacccggggttagtaccccggttcgggtaaaccctttacccggacccggtttacccggggtacgggtaccccccggg

SEQ ID NO: 224640 - DNA, 754 bp, Homo sapiens
  misc_feature: GYAE6OF01CUQLD.38.14.B03.1.454.CMB.1.raw
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
tcagtcgatcacgtcacgaccggtgctcgatttagtgtgagtagttccgcgggagctctgagagaggagcccagccctgagtattttcgaggttgttttcagtttggtgatcaggactgaacagagagaactcaccagtggtagtttggctagaacgttggttctttttcgtcggtggtactttaaagtttttaaaaggtcgtccgtaggttggtaggaggtgcagtcgttggttggagtcggtggggagtcgttggtacgcggtccgggttcgggggtaccctgacgtccgttcctccgtggtcgacncgtcctagtgtacttcgtaacttaagtaatgtcacagtcgacgtcggtccgcgacgcgtacggnggacggngtggngtggtcngtactgtagtagacggtcgtacggtagggttggtaggggtaacggctaacggtaccgttacgacgtaaccggtaccggtccgggtacgggaacccgggtttccgttacccgtaacgttacgttaccgaacgtaacgaaaccgttaacctaaccgaaacggtaaccgcgttcttacgttccgtataacgtttaacgaacgtaacgaccggtccgtaaggacggtaacggtaaccggaaaccgccgtaacgttaccgaagttacttaacgtacgttaggacgaacggtaaaggttggtggggtccgggttacgccggtaccgttcccggtaaccggttcgggtccccggtagggtacccccggg

SEQ ID NO: 224641 - DNA, 707 bp, Homo sapiens
  misc_feature: GYAE6OF01AJM6R.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcgggactgaacagagagaactcaccatggagtttgggctgaactggtctttttctcgtggcttaattttaaaaggtgtccagtgtgaggtgcagctgttggagtcgtgggggaggcttggtacagccgtgggggtccctggagactcctcctgtcgcagcctctggattcctacctttaaagaattatgcccatagaacgtggtccgccaggcctccgagggagggcgtggagtgggtctcatctagtgagccgtacgtaggtgggtagggtagggcaaggacctacgtccaagtaccgtccggtagggaacgggtcccggttaccacccgtaacgtttcccgagaacgaacctaattaacccgaaagaaaccacggtccttaggttacctcgttaagttaacgtacgaactacggaccttaggaacgtacggtacggaacgggtaacccacgggaaccctaagtaacttaacgttacgtagttaccggaaacgtaaaacggttaggtttaggggtcgggggttacgggccgttacggggtcccccgtttagggtaaccccgttcccgggtcgggggtaacccccggtaaaccccgggg

SEQ ID NO: 224642 - DNA, 752 bp, Homo sapiens
  misc_feature: GYAE6OF01ASYIJ.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtggggagcttggtacagccgtggggggtccctgacgactctcctgtcgcagcctcgtggtattcctaaccgtttaagtaattatgaccagtacgaacgtcgggtacccgccgaacggtccgtaccggagggggtaacggggcgtaggggtacggttcggggtccttacgtacgttaccgttaagtcggaacggtccgtaccgttaagggttggggttacgggtaacggggacgtaacggtaacccttaaccgtaccgaaaccggtaaccccggttaccgggtaaacgggtacccggggttaccccgttaccgtaaccgttttaaccgttaccgaaaggttaaccgtaaaccgttaaaccgtaaaccgaaaacgtaaacccgccgttacgttacgttccttacggtttaagttaaacgtacgaaaccgtcgtaacgtaggaacgtacggtacggaacgtacccgagtacgtaattactagtacgtagacgaaagtacgtaggtgggtacgcgtacgtccgtacgtgaccgtgggcggaaccg

SEQ ID NO: 224643 - DNA, 870 bp, Homo sapiens
  misc_feature: GYAE6OF01ESOIH.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccagtggtaggtttgggctagaacgtggttctttttcgtcggtggtacttaagttttaaaaggtgtccgtagttgtaggaggtgcgagtcgttggttcggaggttcgggtgggggaagtcgtttagggtaacacggtccgggttcgggggttccctaggaacgtcctcgtccgtagtacgacgtcggtccttggtacggttacttaaccgtaaaccgttttaaaggtaaactttcgtacgacccgtaagtacggtaaaccggttccggggtccctaccggtacggtacccggtaccgggaaggggggtaacggggtcttacgggggtaacggttcggtacctcgaacgtttcgtaagtggtaacgcggtaacggtttagggtggggttacggagggactaacggtacctagtacgaacgtaccgtacgggtacggaccggggttacctaccgtaaccgttacgtacgtaagtaaccgtaactaaaccggttacaaaaccgggtaacttacccgggtacttacggttaccgttaccgtttaagtaacgtttaaccggaaccgtaacggtccgtaagggtaaacgacgggttaacgaacgggaaccgtaaccgggtacttaaacgtacgtttaacgttaccggtaggtaacgggtaagtaaacggtagggttcggggtacgggtacggttacggtcccggttaccgttaacggtcccggttacgggccggggtaaacccgg

SEQ ID NO: 224644 - DNA, 168 bp, Homo sapiens
  misc_feature: GYAE6OF02I6SK7.38.14.B03.1.454.CMB.1.raw
  modified_base (168)..(168): a, c, t, g, unknown or other
  misc_feature (168)..(168): n is a, c, g, or t
tcagtcgatcacgtcacgaccggtgctcgatttagtgtgagtagttcgcgggggtgttcggcggagggaccaaactgaccgtcctaggtcagcccaaggctgcccctcggtcactctgttcccaccctcctcacgtgatcgactgagcgggctggcaaggcgcatagn

SEQ ID NO: 224645 - DNA, 532 bp, Homo sapiens
  misc_feature: GYAE6OF02IQIJG.38.14.B03.1.454.CMB.1.raw
  modified_base (494)..(494): a, c, t, g, unknown or other
  misc_feature (494)..(494): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtctgggggaggcttggtacagcctggggggtccctgagactctcctgtgcagcctctggattcacctttaagaattatgccatgaactgggtcccgccaggctccgaggggaaggggctgggagtgggtctcatctatgagcgctagtggtggtagggcagactactcagactccgtggaacgggccggttcacctatttccagacgacaattccaagaacacgctgtctctgttaatgaacagcctagagagtcgagacacggccatatattactgtgcgaaagntggtggggtgcgtggcccttggacttccgtgggacccg

SEQ ID NO: 224646 - DNA, 193 bp, Homo sapiens
  misc_feature: GYAE6OF02G96P3.38.14.B03.1.454.CMB.1.raw
  modified_base (192)..(193): a, c, t, g, unknown or other
  misc_feature (192)..(193): n is a, c, g, or t
tcagtcgatcacgtcacgaccggtgctcgatttagtgtgagtagttccgcgggtcagcctccaccaagggcccatcggtcttccccctggcaccctcctccaagagcacctctgggggcacagcggccctgggctgcctggtcaaggactacttccacgtgatcgactgagcgggctggcaaggcgcatagnn

SEQ ID NO: 224647 - DNA, 534 bp, Homo sapiens
  misc_feature: GYAE6OF02GPNE1.38.14.B03.1.454.CMB.1.raw
  modified_base (497)..(497): a, c, t, g, unknown or other
  misc_feature (497)..(497): n is a, c, g, or t
  modified_base (526)..(526): a, c, t, g, unknown or other
  misc_feature (526)..(526): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtctgggggaggcttggtacagcctggggggtccctgagactctcctgtgcagcctctggattcacctttaagaattatgccatgaactgggtccgccaggctccgagggaaggggctgggagtgggtctcatctatgagcgctagtggtggtagggcagactactcagacctccgtgaagggtccggttcaccgtatttccagacgacaaattccaaagacacgcttgtcctctgttaatcgaacagcctgagagtcgagacacggccaatatattctgtagcgaaagntggtgggtgcgtggtcccttgacttccgngggacccg

SEQ ID NO: 224648 - DNA, 528 bp, Homo sapiens
  misc_feature: GYAE6OF02F1D9I.38.14.B03.1.454.CMB.1.raw
  modified_base (485)..(485): a, c, t, g, unknown or other
  misc_feature (485)..(485): n is a, c, g, or t
tcagtcgatcacgtcacgaccggtgctcgatttagtgtgagtagttccgcggggagctctgagagaggagcccagccctgagattttcaggtgtttcatttggtgatcaggactgaacagagagaactcaccatggagtttgggctgaactggctttttctcgtggctatttaaaaggtgtccagtgtgaggtgcagctgttggagtctgggggaggcttgggtacagcctggggggtccctgagactctcctgtgcagcctctggattcacctttaagaattatgccatgaactgggtccgccaggctccgagggaagggctggagtgggtctcatctatgagcgctagtggtggtagggcagactactcagactcgtgaagggccgtcaccatttccagagacaattccaagaacacgctgtctctgttaatgaacagcctgagagtcgaggacacggccaatatattactgtacgcgaaagntaggtggggtagcgtcggcccttggacctccgtgggtacccgg

SEQ ID NO: 224649 - DNA, 193 bp, Homo sapiens; identical to SEQ ID NO: 224646
  misc_feature: GYAE6OF02FW4G1.38.14.B03.1.454.CMB.1.raw
  modified_base (192)..(193): a, c, t, g, unknown or other
  misc_feature (192)..(193): n is a, c, g, or t

SEQ ID NO: 224650 - DNA, 664 bp, Homo sapiens
  misc_feature: GYAE6OF02GHG5D.38.14.B03.1.454.CMB.1.raw
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggtctttttctcgtggcttaattttaaaaggtgtccagtgtgaggtgcagctgttgggagtcggtggggggaggtcgttgggtacaggccggtcggggggtccctgagactctcctgtgcagcctctggattcctacctttagtgactatgccatgatcgtcggggtcccgccgacggcctccggaagggggaacggggcgtgggaggtcgggtcctacgagactaagttaagtggggtaggggtntattcactatatacgnacgtacgtccgggtcgggggtccgttacacctacgtccaaccgtaggaacgaaccaaccgtaccgaagggacgaccaacgtaactattactactaaacaaatcgacctaacgacgtccgtagaacgtacgtacggaacggtaccgaaccgggtccgttagttattacggtttggtacggacgaaggtaacgtaccgtacccggtaacgggtccaacccgttaccggtttcgggttccgttagttttacgg

SEQ ID NO: 224651 - DNA, 535 bp, Homo sapiens
  misc_feature: GYAE6OF02FP3LJ.38.14.B03.1.454.CMB.1.raw
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtctgggggaggcttggtacagcctggggggtccctgagactctcctgtgcagcctctggattcacctttaagaattatgccatgaactgggtccgccaggctccgagggaaggggctggagtgggtctcatctatgagcgctagtggtggtagggcagactactcagactccgtgaacgggccggttcaccatttccagagacaattccaagaacacgcttgtctctgttaatgaacagcctgagagtcgaggacacggccaatatattacngtgcgaaagngtggtggggtggcgtcgggcccttggaccttccgtggggacccgg

SEQ ID NO: 224652 - DNA, 530 bp, Homo sapiens
  misc_feature: GYAE6OF02F3AR0.38.14.B03.1.454.CMB.1.raw
  modified_base (491)..(491): a, c, t, g, unknown or other
  misc_feature (491)..(491): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtctgggggaggcttggtacagcctggggggtccctgagactctcctgtgcagcctctggattcacctttaagaattatgccatgaactgggtcccgccaggctccgagggaaggggctggagtgggtctcatctatgagcgctagtggtggtagggcagactactcagactccgtgaagggccggttcaccatttccagagacaattccaagaacacgctgtctctgttaatgaacagcctgagagtcgaggacacggccaatatattactgtagacgaaagntggtggggtggctcggcccttgacctccgtggggacccg

SEQ ID NO: 224653 - DNA, 587 bp, Homo sapiens
  misc_feature: GYAE6OF02IMGVK.38.14.B03.1.454.CMB.1.raw
  modified_base (447)..(447): a, c, t, g, unknown or other
  misc_feature (447)..(447): n is a, c, g, or t
tcagtcgatcacgtcacgaccggtgctcgatttagtgtgagtagttccgcgggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggaggcttggtacagccgtggggggtccctgagactctcctgtgcagcctctggtattcacctttaaagaattatcgaccatgaacgtcgggtcccgccagggcctccggaagggggaacggggcgtgggaggtgggtctcatcgtatggagcgcgtaggtgggtggtagggcagactactcagactccgaggacgggtccgtacacctattccagacacaactcgagganacacactatactactaacaatgacacacgcctagacgagtacgacgggaccacgggtccgttagtatttagttcggaggccgaaggacgtacctaccccggaacggtacgacccgtaccgtttgggtccttcgttttacg

SEQ ID NO: 224654 - DNA, 575 bp, Homo sapiens
  misc_feature: GYAE6OF02J033R.38.14.B03.1.454.CMB.1.raw
  modified_base (332)..(332): a, c, t, g, unknown or other
  misc_feature (332)..(332): n is a, c, g, or t
  modified_base (435)..(435): a, c, t, g, unknown or other
  misc_feature (435)..(435): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggagcttggtacagcctggggggtccctgagactctcctgtgcagcctctggattcacctttaagattatgccatgaactgggtccgcagctccgagggagggctggagtgggtctnatctatgagcgctaggtggtggtagggcagactactcgagacctccgtagaacgggtccgtcacgtatttccgagacgactaatacaaagacacgctcgtctntacgttaatcgaacagcctagacgtagcggaaggaccacggacccaagttactaagtttacgtggtacgacggaaagtagttgggtagggggtcggtacggtcgggtacccttggacccgttccggtcggggtaccccgg

SEQ ID NO: 224655 - DNA, 561 bp, Homo sapiens
  misc_feature: GYAE6OF02GH7I4.38.14.B03.1.454.CMB.1.raw
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (459)..(459): a, c, t, g, unknown or other
  misc_feature (459)..(459): n is a, c, g, or t
  modified_base (550)..(550): a, c, t, g, unknown or other
  misc_feature (550)..(550): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtctgggggaggcttggtacagcctggggggtccctgagactctcctgtgcagcctctggattcacctttaagaattatgccatgaactgggtccnccaggctccgagggaagggctgggagtgggtctnatctatgagcgctaggtgggtggtagggcagactactcagactccgtaggaacggggtcccggttcaaccctatttccagacgactaattaccaagaacacgcttgtctctgttaatgaacngcctgagagtcgaggacacggcaagtatattactgtagacgaaagtgtggtggggtcggcgttcgggtcccgtttaggacccgtttccggnggggtacccgg

SEQ ID NO: 224656 - DNA, 746 bp, Homo sapiens
  misc_feature: GYAE6OF02IKIMT.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggagcttggtacagccgtgggggtcctgagactctcgtgtgcagcctgtggacttcacctttaagaattatgccatagaacgtgggtcccgcaggctccgaagggaagggctagggaggttcgggtctacgagttcgtaagtcggagccggtacgttaagggtcgggttaggggtaacggggcctaagggtaaccgttaccgtacgaaacggtaccgttcccgggtaacgggaacgggggttaccccgggtttaccaaacccgttacgttttaccccgaacggaaacgtaaacgtaaactttacccgaaagtaaaccacgtacgtcggttaccttcgttaagttaaagtagaaaccgtaacgtccgtagtacgaacggttacggaacgggaccgaaaccggacctaaagttaacgttaagttaccttggtacggaaaccggtaaaggtacggttaagggtcgggggtacgtccgggttaccgggtacccgttagggtaacccggtttcccgggaacgggggtaaccccggg

SEQ ID NO: 224657 - DNA, 699 bp, Homo sapiens
  misc_feature: GYAE6OF02IZ0FA.38.14.B03.1.454.CMB.1.raw
  modified_base (640)..(640): a, c, t, g, unknown or other
  misc_feature (640)..(640): n is a, c, g, or t
tcagtcgatcacgtcacgaccggtgctcgatttagtgtgagtagttccgcggggagctctgagagaggagcccagccctgagattttcaggttgttttcatttggtgatcaggactgaacagagagaactcaccatggagtttggctgaactggtctttttctcgtgcttaatttaaaggtgtccagtgtgaggtgcagctgtggagtcgtgggggagtcttggtacaggtccggtcgggggtccctgacgctccgtcctgtgcacgcctgtggacttcctaacctttaaagaattactcgaccagtacggtaacgttcggggtacccgccgagggccgtaccgggaagggggaacggggtcgtggggtacggttcgggtacctacgtacgtacgttagtacggacgcgtacgtagggttgggttagggtagggactaaggtaaccttacgaccgtaagtcccgtacggtacgggaaccggggtccgttaccgtaaccctaacgtttaccgaaggtaacgtaacttaaaccgtaccgaaaacgtaaacccgccggttaccttgttaccttacgttacgttaaagtacaacgtacggccttagacggagtacggacgaccgacgtctaatagttattacgngtacgaacgtaagtgtagggtggtcgacgtcggtaccctggtaccgtcggtcggaccgg

SEQ ID NO: 224658 - DNA, 540 bp, Homo sapiens
  misc_feature: GYAE6OF02FQP1Z.38.14.B03.1.454.CMB.1.raw
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (435)..(435): a, c, t, g, unknown or other
  misc_feature (435)..(435): n is a, c, g, or t
tcagtcgatcacgtcacgaccggtgctcgatttagtgtgagtagttccgcgggggagctctgagagaggagcccagccctgagattttcaggtgttttcatttggtgatcagcactgaacacagaggactcaccatggagttgggactgagctggattttcctttggctattttaaaaggtgtccagtgtgaagtgcagctgggtggagtcgtggggggagacttgggtagagcctggcaggtccctgagactctcctgtgcagcctctggattcaaatttangataatgccatgcacgtgggtccanaagctccgaaggggaacggcctgggagtgggtctacgagtgttagtggaacaggtggtaccagtagcctatcggcggactcgtgtggaagggccgattcaccatcctaccagacgacaacgcaagcncctcctgtactctagacaatgaacagtctgacgactagacggacacggtccttctactttcctacgtacgaaccgtaacggtcccgttagcggactagtagtacg

SEQ ID NO: 224659 - DNA, 960 bp, Homo sapiens
  misc_feature: GYAE6OF02JWE0R.38.14.B03.1.454.CMB.1.raw
tcagtcgatcacgtcacgaccggtgctcgatttagtgtgagtagttccgcgggagctctgagagaggagcccagccctgagattttcaggtgttttcatttggtgatcaggactgaacagagagaactcaccatggagtttgggctgaactggcttttctcgtggtctattttaaaaggtgtcctagtgtgaggtgcagctgttggagtcgtgggggaggtcgttggtacgtaggtcccgtggggggttcccctggacggtaccgttccttcccgttgggtcgtaccgacggccccgttcgtacgggtacttccgtaacccgttttaaagtaaattagttcggtacccctaagttacggaaacgtttcggggtaccccggtccgaacggtccgttacccggaacggggggtaaaggggtcccggttaggggaacggggttcgggtccgtaccgtagttacgttaacggtaggtaccgggtcccggtagtaacggggtttcggggtacgggttacggggaacgttaacggaccgtttaaccggactaaccggggtaccctacccgggtaaggggtaaccggggttcccggtttaacccgaacccgttaacgtttaccccgaaaggtaaccgtaaaccttaaacgttaacccgaaaaggtaaaccccgtaccggtaccggttcggttaccctttacggttaaccggtttaaactaaccggtaacgtaaaccggtcccgttaacgggtaacgggtaacgttaccggggtaaacgggacccgtaaacccgggtacccgtaaagtttaacggttaaccctttacgttaacgggttagggaaacccggttaaaaacgggttggtaaccgggggttaacggggtttcggtaacccgggttccgggttaaccccccgggttaggtaacccccgggtttacccgggttaccggggggtaaccccccggg

SEQ ID NO: 224660 - DNA, 541 bp, Homo sapiens
  misc_feature: GYAE6OF02FGY7T.38.14.B03.1.454.CMB.1.raw
  modified_base (484)..(484): a, c, t, g, unknown or other
  misc_feature (484)..(484): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtctggggggaggcttgggtacagcctgggggggtccctgagactctcctgtgcagcctctggattcacctttaagaattatgccatgaactgggtccgcaggctccagggaaggggctgggagtgggtctcatctatgagcgctagtggtggtagggcagactactcagactccggtgaacgggcccggttcaccatttccagagacaattaccaagaacacgctgtctcgtgttaatgaacagcctagagagtcgagacacggccatatattacngtgacgaagagtggtggggtggcgtcgggtcccgttgaccttccgtggggaccccgg

SEQ ID NO: 224661 - DNA, 801 bp, Homo sapiens
  misc_feature: GYAE6OF02I87J8.38.14.B03.1.454.CMB.1.raw
  modified_base (414)..(414): a, c, t, g, unknown or other
  misc_feature (414)..(414): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggcttttctcgtggctattttaaaaggtgtccagtgtgaggtgcagctgttggagtcgtgggggaggcttggtacagccgtgggggtccctgagactctcctgtgcacgcctcgtcggtattcctaacctttaagaatttagtcgacctatagaacgttcgggtcccgccgagggtcctaccggaagggggaaggggcgtagggtaggtggggtctcgatactagtcgaggtcgacgttaaggtcgggttagggtacggganaacggacttaacgtcaacggtacccgttccggtacgggtaacgggggtcccggttacaacccgttacgttttacccgaaggtaacggtaaacctaaacgtttaacccgaaaacgggtaaacccaccggtcctttacggttaccctttcgttaacggtttaaaacgttcggaaaaccgtaccggtaccgttaagggaaacggtaacgggtaccgtaaacggggaacccgtaaccgggtacccgtaaagttaacgtttaaccgttacggttaggtacgggtaaaccgggtaaaaggtcgggttaggggttacgggggttacggtaccggttccgggtacccgttttacgggaccccggtttacccggggtacgggggtaacccccgggg

SEQ ID NO: 224662 - DNA, 573 bp, Homo sapiens
  misc_feature: GYAE6OF02H0GVA.38.14.B03.1.454.CMB.1.raw
  modified_base (529)..(529): a, c, t, g, unknown or other
  misc_feature (529)..(529): n is a, c, g, or t
tcagtcgatcacgtcacgaccggtgctcgatttagtgtgagtagttccgcgggggagctctgagagaggagcccagcccccgagattttcaggtgttttcatttggtgatcaggactgaacagagagaactcaccatggagtttgggctgaactggctttttctcgtggctattttaaaaggtgtccagtgtgaggtgcagctgttggagtcgtgggggaggcttggtacagccgtggggggtccctgagacctctcctgtgcagcctctggattcacctttaagaattatgccatgaactgggtccgccaggctccgaggggaaggggctggagtgggtctcatctatgagcgcgtaggtggtggtaggcagactactcagactccgtaggaacggggtcccggttacacctacgttttccaaggtagaactaacttaccaaacgaacacgtctcgttcttcttagttaatcgaacagccgtagagagtacgaggacgacggccatactattacgtgtagacgaagtntggtggggtgcgtcggccttgacctccggtcgggcctaaccggg

SEQ ID NO: 224663 - DNA, 729 bp, Homo sapiens
  misc_feature: GYAE6OF02JTB4F.38.14.B03.1.454.CMB.1.raw
  modified_base (448)..(448): a, c, t, g, unknown or other
  misc_feature (448)..(448): n is a, c, g, or t
  modified_base (554)..(554): a, c, t, g, unknown or other
  misc_feature (554)..(554): n is a, c, g, or t
tcagtcgatcacgtcacgaccggtgctcgatttagtgtgagtagttccgcgggagctctgagagaggagcccagccctgagatttcagtgtttcatttggtgatcaggactgaacagagagaactcaccatggagtttgggctgaactggctttttctcgtggctattttaaaggtgtccagtgtgaggtgcagctgttggagtcgtgggggagcttggtacagccgtgggggtccctgagcgtctctgtagcagtcctgtcggtattcaaccgttttaagaactttagtacgtaccctagttaggtaaacccgttcggggttccccgaccgtaacgggtcccgttaaccccggaaggggggtaaacggggtcccgttacggggaaggtttcgggggtaccttcgtaacgttcgttaagttccggtaagccgtacgttaaggttgggnggttaacgggcgaagtaccgtactcgaacggtaaccgtccggttagggaacgggtcccgttacaccgtacgtttcccgaagtaacgtacctaaagttacccgaaanaaaccgacgtctacgttcgtacttaagtagtaacgacacgtaccgtagacggtacgtcggaacggactaccgggacctagttaacgtattacggtagtacgtaaccggaaatggttacggtacgggttcggcgttaccgggtaccttggaacccgttccggtacggggaaccccg

SEQ ID NO: 224664 - DNA, 828 bp, Homo sapiens
  misc_feature: GYAE6OF02G48WD.38.14.B03.1.454.CMB.1.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (281)..(281): a, c, t, g, unknown or other
  misc_feature (281)..(281): n is a, c, g, or t
tcagtcgatcacgtcacgaccggtgctcgatttagtgtgagtagttccgcggggagctctgagagaggagcccagccctgagattttcaggtgtttcatttggtgatcaggactgaacagagagaactcaccatggagtttggctgaactggcttttctcgtggctatttaaaggtgtccagtgtgaggtgcagctgtggagtcgnggggagcttggtacagccgtgggggtccnggagctctcgtgtgcagcctacgtggacttctactttaagaattancgacctatagaacgttcgggtacccgccgtaacggtccgtacccgtaagggggaacggggccttagggacgggttacggggtccttacgtacgttaccgttaagtggaacggtcgacggttaaggttcggggttacgggtaacggggtacgaacggttaacctaccgttacgaacggtacccgttaccgggtagggaaaccgggggttacccggttaccgaaacccggtttcgttttaacccgaacggtaacccgaaaagttaaccgtaaacccgtaaaacgggaaaacgtcccggtaacgttacgttaccgttaacctttaacgggttaaactttaaccgaaacgtaccgtaaccgttacgggaaccgtaacggttacggtaaccgggaaaccggtccggtaaactaaacgttaactttaaggtttaccgtagggttacgaaaccgggtaaacggttagttaccggggggttaggggtaacccggtcgggtacccgggttacccgtttacggtaaccccggttccggggtaccgggtaaccccggg

SEQ ID NO: 224665 - DNA, 819 bp, Homo sapiens
  misc_feature: GYAE6OF02JF4YI.38.14.B03.1.454.CMB.1.raw
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggtctttttctcgtggctattttaaaggtgtccagtgtgaggtgcagctggttggagtcgtgggggaggcgttggtacgaggcccgttggggggtcccctggaacgacgttccgtcctggtagcaggtcctcgtgattctaaccgtttaagtaattagtgcctatagtaacgtcgggtacccgccgacggtccgtaccggaagggggaacggggtccgtacggggtagggttcggggtccttcgtacgttctaaggtgtaacggccgtacggttaacggggttggggttacggggtaacggggactaacggtaccgttaaccgtaccggtaacgtaacccggttccgggtaacgggtaaccgggggttaccccggtttaccaaacccgtttaccggtttaccgaacggtaaccggaacttaacggtaaccaaacgggtaaccaccggttcgttagttacccttacggttaagttaaacggtcaaaccggtgtaccctagggtaagacggggttacccggaagggttaaacccgcgggtacctaaagtttaaccgttaagtttccggtagaccgggtaaagtaaaggttggtttacgggggcgggtttaacggccgtttaccggggtccctttaaggacccccgggtttggtcccggggtaacccggg

SEQ ID NO: 224666 - DNA, 781 bp, Homo sapiens
  misc_feature: GYAE6OF02H3XF5.38.14.B03.1.454.CMB.1.raw
  modified_base (214)..(214): a, c, t, g, unknown or other
  misc_feature (214)..(214): n is a, c, g, or t
tcagtcgatcacgtcacgaccggtgctcgatttagtgtgagtagttccgcgggagctctgagagaggagcccagccctgagattttcaggtgttttcatttggtgatcaggactgaacagagagaactcaccatggagtttggctgaactggtctttttctcgtggcttaattttaaaaggtcgtccagtgtgaggtgcagctgtggagtcggngggggagtcttgggtacacggtccggttggggggtccctggacgtaccgttcctccgtggtcgctacgccttcgtacggtactttacaaccttttaaggatttaacgtcgacctagtacggtaaacggttcgggtacccgaccgtaacggtccgtaaccggaagggggtaacgggtcgtacggggtagggtttcgggtacctcgtaacgttaccgtaaggtcggaacggtccgtaggtagggttcggggtacgggtacggggctaaacggtaccgttacgtaccgaacgtaccgttaccggtaggggaacgggttcccggttacgaccgttaacgtttaccgaagaacggtaactaacgttaccgaaacgtaacacgtctacgttctagttagtaacgactaacgacgtcccgtagaacgtacggtaccggaacggtaaaccgtccgggactaaacgtttaacttacgtaccgttcggtaacggaacgtaaaggtgttacgggggttacgggtacggtcgttaccggtcccgtttacggacccggttccgggtacgggtaccccggg

SEQ ID NO: 224667 - DNA, 828 bp, Homo sapiens
  misc_feature: GYAE6OF02I7OEH.38.14.B03.1.454.CMB.1.raw
  modified_base (291)..(291): a, c, t, g, unknown or other
  misc_feature (291)..(291): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggagcttggtacaggccgtgggggtcccctggacgactctcctgtgcagcctctggattcaccttttaagaattangccatgaacgtgggtcccgccaggcgtaccgaggggaacgggcgtgggacggttcgggtctcgattcgtacgttggaacggcgtacgttagggttggggtacgggtagggcccgaaggtaccctaactccgaaacggtacccgttacccgggtagggtaaccggggtccccgggttttaccaaccccgtaacgttttccccgaaggtaacgaacccgtaaacgtttaacccgaaaacggtaaacccgaccggtacccttaggttaccccttcggttaacgtttaaactacgaaaccgttacgccccttagggaacgtacggttaaccggagggaaccccaaccggggtaccctaaagttaactttaaaccgtttacgttacgggttacgggtaaaccggggtaaaaaccgtgggtttaacgggggtttacggggggggttaccgggtaccccggttttaccccgggggtccccccgttttaacggggtaaccccccgggttttaccccggggttacccgggggggtaaacccccggg

SEQ ID NO: 224668 - DNA, 555 bp, Homo sapiens
  misc_feature: GYAE6OF02GV9XR.38.14.B03.1.454.CMB.1.raw
  modified_base (426)..(426): a, c, t, g, unknown or other
  misc_feature (426)..(426): n is a, c, g, or t
  modified_base (482)..(482): a, c, t, g, unknown or other
  misc_feature (482)..(482): n is a, c, g, or t
  modified_base (539)..(539): a, c, t, g, unknown or other
  misc_feature (539)..(539): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggaggcttgggtacagccgtgggggggtccctggacgactctcctgtgcagcctctgcattcaccttttagtaacttatttaatgagctgggtccgccagcctccgaggggaagggctgggagtggggtggccagcattaaaccaagatgggaacgtagaaaaattactatgtggactcgtggtgaagggccgagttcgccatctccaganacaacgccaaagactcaactgtggctgcacatgaaccgcctggagaggcgacgacncggctgtgttacttctggtgacggtagaccgacccccagtcggacgggcctaacggnggtacggggagtaccg

SEQ ID NO: 224669 - DNA, 824 bp, Homo sapiens
  misc_feature: GYAE6OF02IACP2.38.14.B03.1.454.CMB.1.raw
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggtctttttctcgtggctattttaaaaggtgtccagtgtgaggtncagctgttggagtcgngggggagcgttggtacagccggtgggggtccctgacgactctccgtgtgcacgcctcgtggtacttactaaccttttaagaatttagtacgacctatagtaaccgtggggtccccgaccacgggtccgtaccggaagggggtaacggggcgttacggggagggttacggggtctacgtaagttaccgttaaggtcggaagggaccgtacccggtttaggggttgggggttacgggggttaacggggcgtaacggtaacccttaccgtacgtaacggtacccgttcccgggtagggaaccggggttcccggtttacctaacccgttacttttacccgaaggtaacgaaaccttaaacgtttaaccgaaaacgtaaccgacgtaccgtcgttacccgttaactttaggtttaatacggtaaacgtccgtaccgttaagggtacgacgggttaccgggaacggaacccggtaaccggtacctaaacgttaacgttaactttacggttacgggtacgtaaacggtaaacggtgggtacggggtttggggacgggttccgtacgggtccccggttttacggtacccggtttccggggacccggggtaaccccgggg

SEQ ID NO: 224670 - DNA, 732 bp, Homo sapiens
  misc_feature: GYAE6OF02F999X.38.14.B03.1.454.CMB.1.raw
  modified_base (266)..(266): a, c, t, g, unknown or other
  misc_feature (266)..(266): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagttgggctgaactggtctttttctcgtgactaattttaaaaggtgtccagtgtgaggtgcagctgttggagtcgtgggggagtcttggtacagccgtgggggtccctgagactctctgtcgcagcctntggattctaacctttaagtaattatgccagtacgaacgtcggtccgccgaggtcctaccggaaggggacgggcgtgggtaggtcgggtctacgtatcgtagtcggagtcgacgttaaggtgggtagggttaacgggacgtaaggtaacctacgtcgaacggtaccttaccgggtagggtaaaccggggtcccggttacctaacccgttacgttttaaccgaagtaacggaaacctaaacgttaaccgaaacgaaaccgtaacgtccgttacgtaccttacgttaagttaactacgtaaacgtacgtaccgtacggaacggtacggtacggaacggaaccgtaaccggtacctaacgttaacttaacgtttactaggtacggtaacgtaaaggtaggtacgggttaggggtcggtaccggttccggtaccgttaccggtaccgttccgggtacggggtaaccccggg

SEQ ID NO: 224671 - DNA, 704 bp, Homo sapiens
  misc_feature: GYAE6OF02JO52L.38.14.B03.1.454.CMB.1.raw
  modified_base (131)..(131): a, c, t, g, unknown or other
  misc_feature (131)..(131): n is a, c, g, or t
  modified_base (165)..(165): a, c, t, g, unknown or other
  misc_feature (165)..(165): n is a, c, g, or t
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
  modified_base (693)..(693): a, c, t, g, unknown or other
  misc_feature (693)..(693): n is a, c, g, or t
tcagtcgatcacgtcacgaccggtgctcgatttagtgtgagtagttccgcggggagctctgagagaggagcccagccctgagattttcaggtgttttcatttggtgatcaggactggacagagagaacctnaccatggagtttgggctggaactggtctttttcncgtggctattttaaaagtgtccagtgtgagtgcagctgtggagtcgtgggggagtcttggacngccgtgggggtccctgagactctcctgtcgcagcctntggattaccgtacctttaagaacttntgccatagaactgggtccncgagcctaccgaagggaggcgtaggtagtggtccagatcgttaangacgcgtctaggtggtagggtacggngtagtaactcgttacgaagtccttacggtacggaaacgggtcccggttacgtaacccgttacgtttaccgaacgtaacgtaaacgttaacttaaccgaaacggtaaaccgtaccggtacgtttacgttccgttaacgttacgtttaaacgtaacggtaaccgtaacgggtcctaagggttacgtaacgggtttaacccggaacggttaaaccgtaaccgggtaacctagttaaacgttcgtaccgttgaaggtaaccgaaagtcgttaggttcgggacggttccgttcggtaccgttggaacccggttccgnggggtaacccg

SEQ ID NO: 224672 - DNA, 874 bp, Homo sapiens
  misc_feature: GYAE6OF02IFXWC.38.14.B03.1.454.CMB.1.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
tcagtcgatcacgtcacgaccggtgctcgatttagtgtgagtagttccgcggggagctctgagagaggagcccagccctgagattttcaggtgttttcattttggtgatcaggactgaacagagagaactcaccatggagtttgggctgaactggtcttttctcgttggcttaattttaaaaggtgtccagtgtgaggtgnaggcttggttggagtcgtggggggagtcgttaggtactaggcccgtaggggggtccctggagtacctccgtcctgtnccgtacgctacgtggatttccgaaccttttaaagaactttatcgtacctaagtacggtaaaccgttcggggtaccccgtacccgaagggtccgtacccggtaagggggaaacgggggtccgtagggttaaggtcgggttcctagtacttacgtagtacggaacgtcggtaacgttagggtttagggtgggttaacggggacgtaacgtaacgtaaccgttaccgaacggtacccgttaccggtaggggtaaacccggggttccccgggttaaccgtaaccccgttaaacgttttacccggaaacggtaacccgtaaaacttaaaacccgtttaacccgaaaaacgtaaaccccgtaccgttaacttccggtttaaccgtttaccggttaaaccgttttaaacgtaacgaaaccgttaggaacccgtttagggtaaaggtaccggttaacgggaaacgaaaccgggtaccggtaacccgaaatttaacgtttaacttaccgttaggtaacggtaacggtaaaacggtgttaacggggtgggtacgtacggtttaccggtacccgttggtacccgttaccggggtcggtaaccccggg

SEQ ID NO: 224673 - DNA, 804 bp, Homo sapiens
  misc_feature: GYAE6OF02HL7DI.38.14.B03.1.454.CMB.1.raw
  modified_base (232)..(232): a, c, t, g, unknown or other
  misc_feature (232)..(232): n is a, c, g, or t
tcagtcgatcacgtcacgaccggtgctcgatttagtgtgagtagttccgcgggagctctgagagaggagcccagccctgagattttcaggtgttttcatttggtgatcaggactgaacagagagaactcaccagtggtagtttggctagaactggtctttttctcggtaggtacttaagtttttaaaaggtcgtccgtagtgtgaggtgacgagcgttgttggaggttcggngggggagtcgttggtacgacgtcccggtgggggtccctaggacgtacgtcctccgtgtcgcgacgtccttacgtggtacttacctaacgtttaagtaattacgtcgtaaccgtagtacgtaaccggttcgggtcccgacgtacggtaccgttaccgggaagggggtacgggtccgtagggtaacgggttcggtacgttacgtagtacgtagtcggaggtccgtacgggttacgttaggggtacggtacgggcgaacgttaactacgtacgaacggtctacgggtaaggtaccgggtccgtaccgtactacgtttacgaagtacgtaaccaacgttaaccgaacgtaaccgtacgtacttcgtacgttacgtttaagtaagttacgaaccgtacggtaccgtaaggtagtaaacgggtccgaaccgggttaccaaccggtataacgttaacgtacgtttaccgtaggtaacggtaaaccgttaaagggttaccggtggggttacggggtacccgttaccgggtcggtaccccggttaccggtacggtttccccgggacggggtaaacccccgg

SEQ ID NO: 224674 - DNA, 851 bp, Homo sapiens
  misc_feature: GYAE6OF02FJH23.38.14.B03.1.454.CMB.1.raw
  modified_base (198)..(198): a, c, t, g, unknown or other
  misc_feature (198)..(198): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactgtctttttctcgtggctaattttaaaaggtgtccagtgtgaggtgnagctgttggagtcggtgggggaggtcgttgggtacacggtcccggtagggggggtcccctaggacgtaccttccgttccgtggtacgtcgacgtccctcgttcggtattaccgtaaccgtttaaagtaattaactcgaccctatacgtaaacgttcgggtcccggtacccggacggtccgttaccggtcgggggaaaaaaaaacgggggccggttagggacggggttcggggttccgtaccgtacgttacgttaaccgttaggacgaccggtaccggttagggtggggttacggggtacggggtacgaacggtaacctacgtaccgaacggtaccgtaccggttacgggtaaacgggggtacccggttaaccgtaaccctaccgtttaccgaacggtaacgaaactaaccgtttaacccaaacggtaaaccgaaccgtacgttaccgttccgttacgtttaacgtttaaacgtacgtaaaccgtaccgtaccgtaagtacggaaggtaccgggtaacggtaaccgacggaccgtaattaagttaaccgtttacgttacggtaggtaaccggtaaaggtaggttaagggttcggggtagggtcggtccggttacccgttacggtaccggttacccggtagggtaacccccgggg

SEQ ID NO: 224675 - DNA, 973 bp, Homo sapiens
  misc_feature: GYAE6OF02HLLEQ.38.14.B03.1.454.CMB.1.raw
tcagtcgatcacgtcacgaccggtgctcgatttagtgtgagtagttccgcggggagctctgagagaggagcccagccctgagattttcaggttgttttcatttggtgatcaggactgaacagagagaactcaccatggagtttgggctgaactggtctttttctcgtggcttattttaaaaggtgtccagtgtgaggtgcagcttggttggagtcgtgggggaggtcgttggtacaggtcccggttcggggggtacccgtgacggtactccgttccgtggttgcgacggtcccttcgtagggttactttaccttaacccgttttaaaagtaatttaactacggtacccttaagttaacggtaaccggttccggggttacccgacccggtaacgggtccggttaccgggaaaggggggtaaacgggggtccgttaacgggggtacgggtttccgggggtacttaccttaacggttaccttaaggttacgggtaaccggtcccgggttaaccggttttaaggggttcggggggtttacggggtaacggggtaacgtaaaccggggttaaacctttaacccggtacgtaaaacccggggtacccgttttacccgggggtaaacgggggtaacccgggggtttaccccggttaaccctaaacccccggtttttaacgttttaacccggaacgggtaaaccggtaaaccgttaaaaccgttttaaaacccgaaaccgttaaaccgaacccgttaccgttcggtttaccttacgtttaaacggtttaaactcgtaaaaccggtccgtaccgtaagggtacggtaacgggaccgggaaccggtaccgtaacccggtaactaacgttaacttacgttacgtcggtaacggtaaccggaagtttacgggtacgggttcgggggaggttccgttacccgggtccggtttacggtacccgtccgggtacccgggtaacccgggg

SEQ ID NO: 224676 - DNA, 699 bp, Homo sapiens
  misc_feature: GYAE6OF02JIASE.38.14.B03.1.454.CMB.1.raw
  modified_base (356)..(356): a, c, t, g, unknown or other
  misc_feature (356)..(356): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtggggggaggcttgggtacaggcccgtgggggggtcccctggacgactctcctgtgccagcctctggattcacctttaagaattatgccatgaactgggtcccgccaggtctccgaggggaacggggcgtcgggaggtcgggtcnctatctatcggaggccgcgttaacgggttgggtgggttaggggacacggactactcgaaggcctccggtggaacggggtcccggttacaaccgtacgttttaccgaacgtaaggtacctaaaacgttcccgaaaacggaaccgtacggcttacggttccttccggtttattaaacgttacgtaaaccgcgttaacccggttagaaccggtagttaccgggaacggaccgtaacgggtccctaagtacttaagtttacccgtaggtacgaacggtaaacgtaggttcgggttagggggcgtaccgtcggtcccgttaggtaccgtccggttacggggaacccgg

SEQ ID NO: 224677 - DNA, 203 bp, Homo sapiens
  misc_feature: GYAE6OF02G0LH7.38.14.B03.1.454.CMB.1.raw
  modified_base (192)..(203): a, c, t, g, unknown or other
  misc_feature (192)..(203): n is a, c, g, or t
tcagtcgatcacgtcacgaccggtgctcgatttagtgtgagtagttccgcgggtcagcctccaccaagggcccatcggtcttccccctggcaccctcctccaagagcacctctgggggcacagcggccctgggctgcctggtcaaggactacttccacgtgatcgactgagcgggctggcaaggcgcatagnnnnnnnnnnnn

SEQ ID NO: 224678 - DNA, 758 bp, Homo sapiens
  misc_feature: GYAE6OF02HJOOU.38.14.B03.1.454.CMB.1.raw
  modified_base (440)..(440): a, c, t, g, unknown or other
  misc_feature (440)..(440): n is a, c, g, or t
  modified_base (671)..(671): a, c, t, g, unknown or other
  misc_feature (671)..(671): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaccatggagtttggctgaactggctttttctcgtggctattttaaaggtgtccagtgtgaggtgcagctgttggagtcgtgggggaggcttagggtacagccggtgggggtccctgagactctccgtggtcgcacgcctcgtggacttcctaaccgttttaagaatttatacgcctagttacggaacgttcgggtaccccgccgtacggcctaccggaggggaacgggggtccgtgggaggttcgggtctacgacgttactagtggacgccgtagtacggttgggtggtacgggacaaggtaccttaccncgtaagacccggttaccgtagggaaccgggtcccgttacacccttacgtttccccgaaggtaacgtaacctaaacgttacccgaaacgtaaccgaccgtcgttacgtcccgttacgttaacgttaaatacggtaaccacgttaccgtagtaggtacggtacggaacgaccgtaacccggaactaacgttaactttacttttacccggtagttacggtaacgggtaaacggngggtttcgggtaggggggttccggttaccggtccgggttaccccgtttacggtacccggtttcccggggaccggggtaaccccgggg

SEQ ID NO: 224679 - DNA, 672 bp, Homo sapiens
  misc_feature: GYAE6OF02FLHYL.38.14.B03.1.454.CMB.1.raw
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
tcagtcgatcacgtcacgaccggtgctcgatttagtgtgagtagttccgcggggagctctgagagaggagcccagccctgagattttcaggtgttttcatttggtgatcaggactgaacagagagaactcaaccatggagtttgggctgtaactggtctttttctcgtggcttaattttaaaagggtcgtccagtgtgaggtgcagctggttggagtcgtagggggacgtcgttggtaacgngtccggttcggggggtccctaggacgccttacgttccgtggtcnccgacgtccgtctcgctacttcctaacttttaaggaacttaatttaagtgacggtcgttcgggtcccgaccacgtcccgtcggtaagggacgggtcgtgggaggtaggggtcgaccaggtacagttaaaccaaaggtcgtaggaacgttaaagaaaaacttactaaggtgtacggacttacgtaggtaacggaggtcccgtaatccgactatcgcagtacacaaccgacgaagacncgtntcggtcgcgcgtacacacgtagaaccggactgaaacgggcgtaacggaccgaaacgtacgtcgtagtaccgtacctgacggtgaccgtaccgtaccgccccgaacggtccggacggtaccaggtacgggttacgggacgtaaccgg

SEQ ID NO: 224680 - DNA, 172 bp, Homo sapiens
  misc_feature: GYAE6OF01D6GJR.49.33.C11.1.454.CMB.1.raw
  modified_base (172)..(172): a, c, t, g, unknown or other
  misc_feature (172)..(172): n is a, c, g, or t
tcagagtcgagagacacgaccggtgctcgatttagagtgagctcgttgggtttgggggaagaggaagactgacggtccccaggagttcaggtgctgggcacagcggccctgggctgcctggtcaaggactacttcctctctcgactctgagcgggctggcaaggcgcatagn

SEQ ID NO: 224681 - DNA, 189 bp, Homo sapiens
  misc_feature: GYAE6OF01DFGE5.49.33.C11.1.454.CMB.1.raw
  modified_base (172)..(189): a, c, t, g, unknown or other
  misc_feature (172)..(189): n is a, c, g, or t
tcagagtcgagagacacgaccggtgctcgatttagagtgagctcgttgggtttggggaagaggaagactgacggtccccaggagttcaggtgctgggcacagcggccctgggctgcctggtcaaggactacttcctcgtagcactctgagcgggctggcaaggcgtcatagnnnnnnnnnnnnnnnnnn

SEQ ID NO: 224682 - DNA, 173 bp, Homo sapiens
  misc_feature: GYAE6OF01BWSBS.49.33.C11.1.454.CMB.1.raw
  modified_base (171)..(173): a, c, t, g, unknown or other
  misc_feature (171)..(173): n is a, c, g, or t
tcagagtcgagagacacgaccggtgctcgatttagagtgagctcgttgggtttggggaagaggaagactgacggtccccaggagttcaggtgctgggcacagcggccctgggctgcctggtcaaggactacttcctctctcgactctgagcgggctggcaaggcgcatagnnn

SEQ ID NO: 224683 - DNA, 171 bp, Homo sapiens
  misc_feature: GYAE6OF01CO5CW.49.33.C11.1.454.CMB.1.raw
  modified_base (171)..(171): a, c, t, g, unknown or other
  misc_feature (171)..(171): n is a, c, g, or t
tcagagtcgagagacacgaccggtgctcgatttagagtgagctcgttgggtttggggaagaggaagactgacggtccccaggagttcaggtgctgggcacagcggccctgggctgcctggtcaaggactacttcctctctcgactctgagcgggctggcaaggcgcatagn

SEQ ID NO: 224684 - DNA, 173 bp, Homo sapiens
  misc_feature: GYAE6OF01EEGGQ.49.33.C11.1.454.CMB.1.raw
  modified_base (173)..(173): a, c, t, g, unknown or other
  misc_feature (173)..(173): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 224685 - DNA, 189 bp, Homo sapiens
  misc_feature: GYAE6OF01C5SNU.49.33.C11.1.454.CMB.1.raw
  modified_base (174)..(189): a, c, t, g, unknown or other
  misc_feature (174)..(189): n is a, c, g, or t
tcagagtcgagagacacgaccggtgctcgatttagagtgagctcgttgggtttggggaacgaggaagactgacggtccccaggagttcaggtgctgggcacagcggccctgggctgcctggtcaaaggactacttcctctctcgactctgagcgggctggcaaggcgcaatagnnnnnnnnnnnnnnnn

SEQ ID NO: 224686 - DNA, 174 bp, Homo sapiens
  misc_feature: GYAE6OF01A60EP.49.33.C11.1.454.CMB.1.raw
  modified_base (174)..(174): a, c, t, g, unknown or other
  misc_feature (174)..(174): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactcctgagcgggctggcaaggcgcatagn

SEQ ID NO: 224687 - DNA, 187 bp, Homo sapiens
  misc_feature: GYAE6OF01CKKBM.49.33.C11.1.454.CMB.1.raw
  modified_base (175)..(187): a, c, t, g, unknown or other
  misc_feature (175)..(187): n is a, c, g, or t
tcagagtcgagagacacgaccggtgctcgatttagagtgagctcggttgggtttgggggaagaggaagactgacggtccccaggagttcaggtgctgggcacagccggccctgggctcgcctggtcaaggactacttcctctctcgactctgagcgggctggcaaggcgcatagnnnnnnnnnnnnn

SEQ ID NO: 224688 - DNA, 171 bp, Homo sapiens
  misc_feature: GYAE6OF01BR5Q2.49.33.C11.1.454.CMB.1.raw
  modified_base (171)..(171): a, c, t, g, unknown or other
  misc_feature (171)..(171): n is a, c, g, or t
tcagagtcgagagacacgaccggtgctcgatttagagtgagctcgttgggtttggggaagaggaagactgacggtccccaggagttcaggtgctgggcacagcggccctgggctgcctggtcaaggactacttcctcgtagcactctgagcgggctggcaaggcgcatagn

SEQ ID NO: 224689 - DNA, 215 bp, Homo sapiens
  misc_feature: GYAE6OF01EJVPJ.49.33.C11.1.454.CMB.1.raw
  modified_base (172)..(215): a, c, t, g, unknown or other
  misc_feature (172)..(215): n is a, c, g, or t
tcagagtcgagagacacgaccggtgctcgatttagagtgagctcgttgggtttggggaagaggaagactgacggtccccaggagttcgaggtgctgggcacagcggcctggctgcctggtcaaggactacttcctctctacgactctgacgcgggctggcaaggcgcatagnnnnnnnnnnnnnnnnnnnnnnnnnnnnnnnnnnnnnnnnnnnn

SEQ ID NO: 224690 - DNA, 171 bp, Homo sapiens; identical to SEQ ID NO: 224683
  misc_feature: GYAE6OF01EAB9S.49.33.C11.1.454.CMB.1.raw
  modified_base (171)..(171): a, c, t, g, unknown or other
  misc_feature (171)..(171): n is a, c, g, or t

SEQ ID NO: 224691 - DNA, 173 bp, Homo sapiens
  misc_feature: GYAE6OF01D9ACW.49.33.C11.1.454.CMB.1.raw
  modified_base (173)..(173): a, c, t, g, unknown or other
  misc_feature (173)..(173): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctcgtagcactctgagcgggctggcaaggcgcatagn

SEQ ID NO: 224692 - DNA, 173 bp, Homo sapiens; identical to SEQ ID NO: 224684
  misc_feature: GYAE6OF01B46OD.49.33.C11.1.454.CMB.1.raw
  modified_base (173)..(173): a, c, t, g, unknown or other
  misc_feature (173)..(173): n is a, c, g, or t

SEQ ID NO: 224693 - DNA, 173 bp, Homo sapiens; identical to SEQ ID NO: 224684
  misc_feature: GYAE6OF01B47JR.49.33.C11.1.454.CMB.1.raw
  modified_base (173)..(173): a, c, t, g, unknown or other
  misc_feature (173)..(173): n is a, c, g, or t

SEQ ID NO: 224694 - DNA, 171 bp, Homo sapiens; identical to SEQ ID NO: 224683
  misc_feature: GYAE6OF01CJSM4.49.33.C11.1.454.CMB.1.raw
  modified_base (171)..(171): a, c, t, g, unknown or other
  misc_feature (171)..(171): n is a, c, g, or t

SEQ ID NO: 224695 - DNA, 173 bp, Homo sapiens; identical to SEQ ID NO: 224691
  misc_feature: GYAE6OF01EUEVH.49.33.C11.1.454.CMB.1.raw
  modified_base (173)..(173): a, c, t, g, unknown or other
  misc_feature (173)..(173): n is a, c, g, or t

SEQ ID NO: 224696 - DNA, 171 bp, Homo sapiens; identical to SEQ ID NO: 224683
  misc_feature: GYAE6OF01AIOLX.49.33.C11.1.454.CMB.1.raw
  modified_base (171)..(171): a, c, t, g, unknown or other
  misc_feature (171)..(171): n is a, c, g, or t

SEQ ID NO: 224697 - DNA, 215 bp, Homo sapiens
  misc_feature: GYAE6OF01DQGWH.49.33.C11.1.454.CMB.1.raw
  modified_base (147)..(147): a, c, t, g, unknown or other
  misc_feature (147)..(147): n is a, c, g, or t
  modified_base (176)..(176): a, c, t, g, unknown or other
  misc_feature (176)..(176): n is a, c, g, or t
  modified_base (182)..(215): a, c, t, g, unknown or other
  misc_feature (182)..(215): n is a, c, g, or t
tcagagtcgagagacacgaccggtgctcgatttagagtgagctcgttggggtttggggggaagaggaagactgacggtccccccaggagttccgaggtgcctcgggcacagcggcccttgggctgcctggtcaaggctacttcctcncgtcgactctgagcgggcttggcaaggcncatagnnnnnnnnnnnnnnnnnnnnnnnnnnnnnnnnnn

SEQ ID NO: 224698 - DNA, 171 bp, Homo sapiens; identical to SEQ ID NO: 224683
  misc_feature: GYAE6OF01ETQCK.49.33.C11.1.454.CMB.1.raw
  modified_base (171)..(171): a, c, t, g, unknown or other
  misc_feature (171)..(171): n is a, c, g, or t

SEQ ID NO: 224699 - DNA, 173 bp, Homo sapiens; identical to SEQ ID NO: 224684
  misc_feature: GYAE6OF01EZX34.49.33.C11.1.454.CMB.1.raw
  modified_base (173)..(173): a, c, t, g, unknown or other
  misc_feature (173)..(173): n is a, c, g, or t

SEQ ID NO: 224700 - DNA, 173 bp, Homo sapiens; identical to SEQ ID NO: 224684
  misc_feature: GYAE6OF01CYQA5.49.33.C11.1.454.CMB.1.raw
  modified_base (173)..(173): a, c, t, g, unknown or other
  misc_feature (173)..(173): n is a, c, g, or t

SEQ ID NO: 224701 - DNA, 173 bp, Homo sapiens; identical to SEQ ID NO: 224684
  misc_feature: GYAE6OF01BTW6E.49.33.C11.1.454.CMB.1.raw
  modified_base (173)..(173): a, c, t, g, unknown or other
  misc_feature (173)..(173): n is a, c, g, or t

SEQ ID NO: 224702 - DNA, 173 bp, Homo sapiens; identical to SEQ ID NO: 224684
  misc_feature: GYAE6OF01A7MDV.49.33.C11.1.454.CMB.1.raw
  modified_base (173)..(173): a, c, t, g, unknown or other
  misc_feature (173)..(173): n is a, c, g, or t

SEQ ID NO: 224703 - DNA, 172 bp, Homo sapiens
  misc_feature: GYAE6OF01A630T.49.33.C11.1.454.CMB.1.raw
  modified_base (171)..(172): a, c, t, g, unknown or other
  misc_feature (171)..(172): n is a, c, g, or t
tcagagtcgagagacacgaccggtgctcgatttagagtgagctcgttgggtttggggaagaggaagactgacggtccccaggagttcaggtgctgggcacagcggccctgggctgcctggtcaaggactacttcctctctcgactctgagcgggctggcaaggcgcatagnn

SEQ ID NO: 224704 - DNA, 171 bp, Homo sapiens; identical to SEQ ID NO: 224683
  misc_feature: GYAE6OF01D0J8G.49.33.C11.1.454.CMB.1.raw
  modified_base (171)..(171): a, c, t, g, unknown or other
  misc_feature (171)..(171): n is a, c, g, or t

SEQ ID NO: 224705 - DNA, 173 bp, Homo sapiens; identical to SEQ ID NO: 224684
  misc_feature: GYAE6OF01A1F3W.49.33.C11.1.454.CMB.1.raw
  modified_base (173)..(173): a, c, t, g, unknown or other
  misc_feature (173)..(173): n is a, c, g, or t

SEQ ID NO: 224706 - DNA, 173 bp, Homo sapiens; identical to SEQ ID NO: 224684
  misc_feature: GYAE6OF01CM7U0.49.33.C11.1.454.CMB.1.raw
  modified_base (173)..(173): a, c, t, g, unknown or other
  misc_feature (173)..(173): n is a, c, g, or t

SEQ ID NO: 224707 - DNA, 175 bp, Homo sapiens
  misc_feature: GYAE6OF01DARN5.49.33.C11.1.454.CMB.1.raw
  modified_base (173)..(175): a, c, t, g, unknown or other
  misc_feature (173)..(175): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 224708 - DNA, 173 bp, Homo sapiens; identical to SEQ ID NO: 224684
  misc_feature: GYAE6OF01DOY1L.49.33.C11.1.454.CMB.1.raw
  modified_base (173)..(173): a, c, t, g, unknown or other
  misc_feature (173)..(173): n is a, c, g, or t

SEQ ID NO: 224709 - DNA, 173 bp, Homo sapiens; identical to SEQ ID NO: 224684
  misc_feature: GYAE6OF01DYYRF.49.33.C11.1.454.CMB.1.raw
  modified_base (173)..(173): a, c, t, g, unknown or other
  misc_feature (173)..(173): n is a, c, g, or t

SEQ ID NO: 224710 - DNA, 192 bp, Homo sapiens
  misc_feature: GYAE6OF01EQO18.49.33.C11.1.454.CMB.1.raw
  modified_base (174)..(192): a, c, t, g, unknown or other
  misc_feature (174)..(192): n is a, c, g, or t
tcagagtcgagagacacgaccggtgctcgatttagagtgagctcggttgggtttggggggaagaggaagactgacggtcccccaggagttcaggtgctgggcacagcggccctgggctgcctggtcaaggctacttcctctctcgactctgagcgggctggcaaggcgcatagnnnnnnnnnnnnnnnnnnn

SEQ ID NO: 224711 - DNA, 173 bp, Homo sapiens; identical to SEQ ID NO: 224684
  misc_feature: GYAE6OF01AURJ4.49.33.C11.1.454.CMB.1.raw
  modified_base (173)..(173): a, c, t, g, unknown or other
  misc_feature (173)..(173): n is a, c, g, or t

SEQ ID NO: 224712 - DNA, 174 bp, Homo sapiens
  misc_feature: GYAE6OF01B0NDC.49.33.C11.1.454.CMB.1.raw
  modified_base (173)..(174): a, c, t, g, unknown or other
  misc_feature (173)..(174): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 224713 - DNA, 186 bp, Homo sapiens
  misc_feature: GYAE6OF01A1NEN.49.33.C11.1.454.CMB.1.raw
  modified_base (142)..(142): a, c, t, g, unknown or other
  misc_feature (142)..(142): n is a, c, g, or t
  modified_base (168)..(168): a, c, t, g, unknown or other
  misc_feature (168)..(168): n is a, c, g, or t
  modified_base (174)..(186): a, c, t, g, unknown or other
  misc_feature (174)..(186): n is a, c, g, or t
tcagagtcgagagacacgaccggtgctcgatttagagtgagctcgttgggtttgggggaagaggaagactgacggtcccccaggagttcgaggtgctgggccacagcggccctgggctgcctggtcaaggctacttcctctntcgactctgagcgggctggcaaggcncatagnnnnnnnnnnnnn

SEQ ID NO: 224714 - DNA, 174 bp, Homo sapiens; identical to SEQ ID NO: 224712
  misc_feature: GYAE6OF01B9DGB.49.33.C11.1.454.CMB.1.raw
  modified_base (173)..(174): a, c, t, g, unknown or other
  misc_feature (173)..(174): n is a, c, g, or t

SEQ ID NO: 224715 - DNA, 252 bp, Homo sapiens
  misc_feature: GYAE6OF01EV2BT.49.33.C11.1.454.CMB.1.raw
  modified_base (190)..(252): a, c, t, g, unknown or other
  misc_feature (190)..(252): n is a, c, g, or t
tcagagtcgagagacacgaccggtgctcgatttagagtgagctcgttggggtttgggggggaagaggaagactggaccggtcccccaggaggttcaggtgactgggcacagccggccctcgggctgcctggttccaaggacttacttcctctcgtcgactctggagccgggcgtggcaaggcgcatacgnnnnnnnnnnnnnnnnnnnnnnnnnnnnnnnnnnnnnnnnnnnnnnnnnnnnnnnnnnnnnnn

SEQ ID NO: 224716 - DNA, 527 bp, Homo sapiens
  misc_feature: GYAE6OF01DCOCQ.49.33.C11.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (521)..(521): a, c, t, g, unknown or other
  misc_feature (521)..(521): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangtcaccctctcctgcagggccagtcagagtgttaggagcaacttgcctggtatcagcaagaaacctggccaggcctccaggcctcctcatctatggtncatccaccagggccacgtggtactcccagccaggttcaggtggcaggtgggtctgggacagagttcacttctcaccatcagcacgcctgcagtctagaagtatttgactagtttattactgtcagtctaagtataagtcggtccggtctccggtactacgttcggcggacgggtaccgaagggtcggagagtacgaaacgtacgtgtggctagcactntcgtcg

SEQ ID NO: 224717 - DNA, 188 bp, Homo sapiens
  misc_feature: GYAE6OF01DQ1Y2.49.33.C11.1.454.CMB.1.raw
  modified_base (174)..(188): a, c, t, g, unknown or other
  misc_feature (174)..(188): n is a, c, g, or t
tcagagtcgagagacacgaccggtgctcgatttagagtgagctcgttggggtttgggggaagaggaagactgaccggtcccccaggagttcaggtgctgggcacagcggcctgggctgcctggtcaaggactacttcctctctcgactctgagcgggctggcaaggcgcatagnnnnnnnnnnnnnnn

SEQ ID NO: 224718 - DNA, 173 bp, Homo sapiens; identical to SEQ ID NO: 224684
  misc_feature: GYAE6OF01ARP3D.49.33.C11.1.454.CMB.1.raw
  modified_base (173)..(173): a, c, t, g, unknown or other
  misc_feature (173)..(173): n is a, c, g, or t

SEQ ID NO: 224719 - DNA, 174 bp, Homo sapiens; identical to SEQ ID NO: 224712
  misc_feature: GYAE6OF01DPGSB.49.33.C11.1.454.CMB.1.raw
  modified_base (173)..(174): a, c, t, g, unknown or other
  misc_feature (173)..(174): n is a, c, g, or t

SEQ ID NO: 224720 - DNA, 173 bp, Homo sapiens; identical to SEQ ID NO: 224691
  misc_feature: GYAE6OF01COU6G.49.33.C11.1.454.CMB.1.raw
  modified_base (173)..(173): a, c, t, g, unknown or other
  misc_feature (173)..(173): n is a, c, g, or t

SEQ ID NO: 224721 - DNA, 174 bp, Homo sapiens; identical to SEQ ID NO: 224712
  misc_feature: GYAE6OF01D8B7D.49.33.C11.1.454.CMB.1.raw
  modified_base (173)..(174): a, c, t, g, unknown or other
  misc_feature (173)..(174): n is a, c, g, or t

SEQ ID NO: 224722 - DNA, 184 bp, Homo sapiens
  misc_feature: GYAE6OF01DWIUP.49.33.C11.1.454.CMB.1.raw
  modified_base (172)..(184): a, c, t, g, unknown or other
  misc_feature (172)..(184): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggctacttcctctctcgactctgagcgggctggcaaggcgcatagnnnnnnnnnnnnn

SEQ ID NO: 224723 - DNA, 173 bp, Homo sapiens; identical to SEQ ID NO: 224684
  misc_feature: GYAE6OF01DU1QZ.49.33.C11.1.454.CMB.1.raw
  modified_base (173)..(173): a, c, t, g, unknown or other
  misc_feature (173)..(173): n is a, c, g, or t

SEQ ID NO: 224724 - DNA, 173 bp, Homo sapiens; identical to SEQ ID NO: 224684
  misc_feature: GYAE6OF01DOCB8.49.33.C11.1.454.CMB.1.raw
  modified_base (173)..(173): a, c, t, g, unknown or other
  misc_feature (173)..(173): n is a, c, g, or t

SEQ ID NO: 224725 - DNA, 173 bp, Homo sapiens; identical to SEQ ID NO: 224684
  misc_feature: GYAE6OF01EZKUE.49.33.C11.1.454.CMB.1.raw
  modified_base (173)..(173): a, c, t, g, unknown or other
  misc_feature (173)..(173): n is a, c, g, or t

SEQ ID NO: 224726 - DNA, 172 bp, Homo sapiens; identical to SEQ ID NO: 224703
  misc_feature: GYAE6OF01CFB6G.49.33.C11.1.454.CMB.1.raw
  modified_base (171)..(172): a, c, t, g, unknown or other
  misc_feature (171)..(172): n is a, c, g, or t

SEQ ID NO: 224727 - DNA, 515 bp, Homo sapiens
  misc_feature: GYAE6OF01BGHI5.49.33.C11.1.454.CMB.1.raw
  modified_base (509)..(509): a, c, t, g, unknown or other
  misc_feature (509)..(509): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtactcccagcccaggttcagtggcaggtgggtctgggacagagttcactctcaccatcagcagcctgcagtctagtaagtattttgctagtttattactgtcagctagtataagtgtccgggtctccggactacgttcgggcggagggaccgaagggtggagatacgaaacgacgtggtggctgacacntcgtcg

SEQ ID NO: 224728 - DNA, 173 bp, Homo sapiens; identical to SEQ ID NO: 224684
  misc_feature: GYAE6OF01EZUGH.49.33.C11.1.454.CMB.1.raw
  modified_base (173)..(173): a, c, t, g, unknown or other
  misc_feature (173)..(173): n is a, c, g, or t

SEQ ID NO: 224729 - DNA, 522 bp, Homo sapiens
  misc_feature: GYAE6OF01A35IE.49.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (301)..(301): a, c, t, g, unknown or other
  misc_feature (301)..(301): n is a, c, g, or t
  modified_base (368)..(368): a, c, t, g, unknown or other
  misc_feature (368)..(368): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagagtgttaggagcaacttagcctggtatcagcaagaaacctggccaggcctccaggctcctcatctatggtncatccacagggccactggtactccagccaggttcagtgcaggtgggtctgggacagtagttcactcncaccatcagcacgctgcagtctagaagtattttgctagtttacttactgtcagtctagtatagtcgtccggctccggactcgttcggacggtaggaccgaagggtggacgtagtacgaaaggtactggtcggactcgaccactagttcgttacg

SEQ ID NO: 224730 - DNA, 514 bp, Homo sapiens
  misc_feature: GYAE6OF01AE6H7.49.33.C11.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (508)..(508): a, c, t, g, unknown or other
  misc_feature (508)..(508): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaacctggccaggctccaggctcctcatctatggtncatccaccagggccactggtactcccagcccaggttcaggtggcaggtgggtctgggacagagttcactctcaccatcagcagcctgcagtctagtaagtatttgctagtttattactgtcagctagtataagtgtccggctccggactacgttcggcggtaggaccgagggtaggagagtacgaaacgacgtggtcgtctagacactntcgtcg

SEQ ID NO: 224731 - DNA, 175 bp, Homo sapiens; identical to SEQ ID NO: 224707
  misc_feature: GYAE6OF01BU974.49.33.C11.1.454.CMB.1.raw
  modified_base (173)..(175): a, c, t, g, unknown or other
  misc_feature (173)..(175): n is a, c, g, or t

SEQ ID NO: 224732 - DNA, 173 bp, Homo sapiens; identical to SEQ ID NO: 224691
  misc_feature: GYAE6OF01BKJE1.49.33.C11.1.454.CMB.1.raw
  modified_base (173)..(173): a, c, t, g, unknown or other
  misc_feature (173)..(173): n is a, c, g, or t

SEQ ID NO: 224733 - DNA, 175 bp, Homo sapiens
  misc_feature: GYAE6OF01AWBHK.49.33.C11.1.454.CMB.1.raw
  modified_base (175)..(175): a, c, t, g, unknown or other
  misc_feature (175)..(175): n is a, c, g, or t
tcagagtcgagagacacgaccggtgctcgatttagagtgagctcggttgggtttgggggaagaggaagactgaccggtcccccaggagttcaggtgctgggcacagcggccctgggctgcctggtcaaggactacttcctctctcgactctgagcgggctggcaaggcgcatagn

SEQ ID NO: 224734 - DNA, 175 bp, Homo sapiens
  misc_feature: GYAE6OF01DOOHY.49.33.C11.1.454.CMB.1.raw
  modified_base (174)..(175): a, c, t, g, unknown or other
  misc_feature (174)..(175): n is a, c, g, or t
tcagagtcgagagacacgaccggtgctcgatttagagtgagctcgttgggtttgggggaagaggaagactgaccggtcccccaggagttcaggtgctgggcacagcggccctgggctgcctggtcaaggactacttcctctctcgactctgagcgggctggcaaggcgcatagnn

SEQ ID NO: 224735 - DNA, 184 bp, Homo sapiens
  misc_feature: GYAE6OF01CSP93.49.33.C11.1.454.CMB.1.raw
  modified_base (174)..(184): a, c, t, g, unknown or other
  misc_feature (174)..(184): n is a, c, g, or t
tcagagtcgagagacacgaccggtgctcgatttagagtgagctcgttgggtttgggggaagaggaagactgacggtcccccaggagttcaggtgctggcacagcggccctgggctgcctggtcaaggactacttcctctctcgacttctgagcgggctggtcaaggcgcatagnnnnnnnnnnn

SEQ ID NO: 224736 - DNA, 506 bp, Homo sapiens
  misc_feature: GYAE6OF01B9Y1Z.49.33.C11.1.454.CMB.1.raw
  modified_base (489)..(489): a, c, t, g, unknown or other
  misc_feature (489)..(489): n is a, c, g, or t
  modified_base (500)..(500): a, c, t, g, unknown or other
  misc_feature (500)..(500): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccgagggccactggtactcccagccaggttcagtggcagtgggtctgggacagagttcactctcaccatcagcagcctgcagtctgaagtattttgctagtttattactgtcagcagttataagtgtccgggctccggactacgttcggcggagggaccaagggtgagatacaaacgactgnggctgacaccntcgtcg

SEQ ID NO: 224737 - DNA, 173 bp, Homo sapiens; identical to SEQ ID NO: 224684
  misc_feature: GYAE6OF01CZH71.49.33.C11.1.454.CMB.1.raw
  modified_base (173)..(173): a, c, t, g, unknown or other
  misc_feature (173)..(173): n is a, c, g, or t

SEQ ID NO: 224738 - DNA, 519 bp, Homo sapiens
  misc_feature: GYAE6OF01E372F.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaaacctggccaggctcccaggctcctcatctatggtgcatcccaccagggccactggtactcccagccaggttcaggtggcagtgggtctgggacagagttcactctcaccatcagcagcctgcagtctgaagtatttgctagtttattactgtcagctagtataatcgtccggctccggactacgttcggcggtacgggaccgaaggtggagaagtacgaaacggtactggtcggtctgacacccgtatcgttcg

SEQ ID NO: 224739 - DNA, 520 bp, Homo sapiens
  misc_feature: GYAE6OF01DZ764.49.33.C11.1.454.CMB.1.raw
  modified_base (203)..(203): a, c, t, g, unknown or other
  misc_feature (203)..(203): n is a, c, g, or t
  modified_base (514)..(514): a, c, t, g, unknown or other
  misc_feature (514)..(514): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctcccaggctcctcatctatggtgcatccacagggccactggtactcccagccaggttcagtggcagtgggtctgggacaggagttcactctcaccatcagcagcctgcagtctagaagtattttgctagttttatacttgtcagcaagttataagtgtaccgggcttaccggactacgtttcgggcggtaagggaccaagggtggaagatacgaaacggactgtcggctagcaccntcgtcg

SEQ ID NO: 224740 - DNA, 173 bp, Homo sapiens; identical to SEQ ID NO: 224684
  misc_feature: GYAE6OF01CUFM4.49.33.C11.1.454.CMB.1.raw
  modified_base (173)..(173): a, c, t, g, unknown or other
  misc_feature (173)..(173): n is a, c, g, or t

SEQ ID NO: 224741 - DNA, 174 bp, Homo sapiens; identical to SEQ ID NO: 224712
  misc_feature: GYAE6OF01BHKIU.49.33.C11.1.454.CMB.1.raw
  modified_base (173)..(174): a, c, t, g, unknown or other
  misc_feature (173)..(174): n is a, c, g, or t

SEQ ID NO: 224742 - DNA, 183 bp, Homo sapiens
  misc_feature: GYAE6OF01BBKU1.49.33.C11.1.454.CMB.1.raw
  modified_base (173)..(183): a, c, t, g, unknown or other
  misc_feature (173)..(183): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnn

SEQ ID NO: 224743 - DNA, 176 bp, Homo sapiens
  misc_feature: GYAE6OF01DNE9U.49.33.C11.1.454.CMB.1.raw
  modified_base (173)..(176): a, c, t, g, unknown or other
  misc_feature (173)..(176): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctttcgactctgagcgggctggcaaggcgcatagnnnn

SEQ ID NO: 224744 - DNA, 175 bp, Homo sapiens; identical to SEQ ID NO: 224707
  misc_feature: GYAE6OF01D4CF8.49.33.C11.1.454.CMB.1.raw
  modified_base (173)..(175): a, c, t, g, unknown or other
  misc_feature (173)..(175): n is a, c, g, or t

SEQ ID NO: 224745 - DNA, 216 bp, Homo sapiens
  misc_feature: GYAE6OF01DMMJO.49.33.C11.1.454.CMB.1.raw
  modified_base (178)..(216): a, c, t, g, unknown or other
  misc_feature (178)..(216): n is a, c, g, or t
tcagagtcgagagacacgaccggtgctcgatttagagtgagctcggttgggtttggggggaagagggaagactgacggtcccccaggagttcaggtgctgggcacagcggccctgggctgcctggtcaaggactacttcctctctcgactctgaggtcgggctggcaaggcgcatagnnnnnnnnnnnnnnnnnnnnnnnnnnnnnnnnnnnnnnn

SEQ ID NO: 224746 - DNA, 504 bp, Homo sapiens
  misc_feature: GYAE6OF01B5Q04.49.33.C11.1.454.CMB.1.raw
  modified_base (203)..(203): a, c, t, g, unknown or other
  misc_feature (203)..(203): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaaacctggccaggctccaggctcatcatctatggtgcatccaccagggcccactggtactcccagccaggttcaggtggcaggtgggtctgggacagagttcactctcaccatcagcagcctgcagtctgaagtattttgctagtttattactgtcagctagtataagtgtccgggctccggactacgtttcggcggagggaccgaagggtcggagatcgaaacgactgtggctgcncntc

SEQ ID NO: 224747 - DNA, 211 bp, Homo sapiens
  misc_feature: GYAE6OF01DKMF3.49.33.C11.1.454.CMB.1.raw
  modified_base (137)..(137): a, c, t, g, unknown or other
  misc_feature (137)..(137): n is a, c, g, or t
  modified_base (170)..(211): a, c, t, g, unknown or other
  misc_feature (170)..(211): n is a, c, g, or t
tcagagtcgagagacacgaccggtgctcgatttagagtgagctcggttgggtttggggggaagagggaagactgacggtcccccaggagttcaggtgctgggcacagcggcctgggctgcctggtcaaggctactcnctctcgatctgagcggctggcaaggcgcatagnnnnnnnnnnnnnnnnnnnnnnnnnnnnnnnnnnnnnnnnnn

SEQ ID NO: 224748 - DNA, 538 bp, Homo sapiens
  misc_feature: GYAE6OF01ACGF5.49.33.C11.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (298)..(298): a, c, t, g, unknown or other
  misc_feature (298)..(298): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgtaggancaacttgcctggtatcagcagaaacctggccaggctccaggctcctcatctatggtncatccacagggccacgtggtactcccgagcctaggttcagtggcaggtcggggtctggggactaggtacgttcacgtctacaccatcagcacgcctgcagtctagtaagtatttgactagtttactactgtcagtactagtatagtcggtccggtctaccggactacggttcgggcggacgggtaccgtaagggtggagacgtacgaaacgtacgtggtacgtctagaccactgtctacg

SEQ ID NO: 224749 - DNA, 172 bp, Homo sapiens
  misc_feature: GYAE6OF01D53CX.49.33.C11.1.454.CMB.1.raw
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatag

SEQ ID NO: 224750 - DNA, 525 bp, Homo sapiens
  misc_feature: GYAE6OF01E0NMG.49.33.C11.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagagtcgagagacacgaccggtgctcgatttagagtgagctcgttgggtttgggggaggaactgctcagttaggacccagacggaaccatggaagccccagcgcagcttctctcctcctgctactctggctcccagataccactggagaaatagtgatgacgcagtctccagccaccctgtctgtgtcctccgaggggaaanagtcaccctctcctgcagggccagtcagagtgttaggancaacttgcctggtatcagcagaaacctggccaggctcccaggctcctcatctatggtgcatccaccagggccacgtggtactcccagccaggttcagtggcagtgggtctgggacagagttcactctcaccatcagcacgcctcgctagtctagaacgtacttctgtctagtttattacttgtcagcagcgtagctaacgtggcctctcacgtttcggcggtagggacccgtaagggtggaagtactaccgaaacgtacgtaggtacggatcgcaccgtacg

SEQ ID NO: 224751 - DNA, 193 bp, Homo sapiens
  misc_feature: GYAE6OF01BJAL9.49.33.C11.1.454.CMB.1.raw
  modified_base (173)..(193): a, c, t, g, unknown or other
  misc_feature (173)..(193): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnn

SEQ ID NO: 224752 - DNA, 175 bp, Homo sapiens; identical to SEQ ID NO: 224707
  misc_feature: GYAE6OF01AP2K2.49.33.C11.1.454.CMB.1.raw
  modified_base (173)..(175): a, c, t, g, unknown or other
  misc_feature (173)..(175): n is a, c, g, or t

SEQ ID NO: 224753 - DNA, 181 bp, Homo sapiens
  misc_feature: GYAE6OF01BZWR0.49.33.C11.1.454.CMB.1.raw
  modified_base (173)..(181): a, c, t, g, unknown or other
  misc_feature (173)..(181): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnnnnnn

SEQ ID NO: 224754 - DNA, 173 bp, Homo sapiens; identical to SEQ ID NO: 224691
  misc_feature: GYAE6OF01A5L5Z.49.33.C11.1.454.CMB.1.raw
  modified_base (173)..(173): a, c, t, g, unknown or other
  misc_feature (173)..(173): n is a, c, g, or t

SEQ ID NO: 224755 - DNA, 523 bp, Homo sapiens
  misc_feature: GYAE6OF01CN6CS.49.33.C11.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (518)..(518): a, c, t, g, unknown or other
  misc_feature (518)..(518): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactgggagaaatagtgatgacgcagtctccagccaccctgtctgtgtctccaggggaaangtcaccctntcctgcagggccagtcagagtgttaggagcaacttgcctggtatcagcagaaacctggccaggctcccaggctcctcatctatggtgcactccaccacgggccacgtggtactccagccaggttcagtggcaggtgggtctgggacagacgttcactctcaccatcagcacgctgctagtctagaagtatttgctagtttattactgtcagctaagtataagtcggtccgggctccggactacgttcgggaccgggtagggaccaagggtggagtatacgaaaacgacgtgaggtctagacaccntctcg

SEQ ID NO: 224756 - DNA, 176 bp, Homo sapiens
  misc_feature: GYAE6OF01EIFLO.49.33.C11.1.454.CMB.1.raw
  modified_base (173)..(176): a, c, t, g, unknown or other
  misc_feature (173)..(176): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 224757 - DNA, 572 bp, Homo sapiens
  misc_feature: GYAE6OF01B3JC3.49.33.C11.1.454.CMB.1.raw
  modified_base (204)..(204): a, c, t, g, unknown or other
  misc_feature (204)..(204): n is a, c, g, or t
  modified_base (406)..(406): a, c, t, g, unknown or other
  misc_feature (406)..(406): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttaggagcaaacttagcctggtatcagcagaaacctggccaggctcccaggcctcctcatctatggtgcatccaaccgagggccacgtggtactccccagccaggttcagtggcaggtgggtctgggacagagttcactctcaccatcagcagcctgcagtctagaagtntttagcttagtttattactgtacagtactaagttattaagtcggttccgggccttcccgggactacggtttcgggacgggtaacgggaccgtaaaggggtggaacgtaagtaacgaaaacggtaacgttaggtacggtcctaggacctaacctagttccgttacgg

SEQ ID NO: 224758 - DNA, 531 bp, Homo sapiens
  misc_feature: GYAE6OF01EKYHG.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngtcaccctctcctgcagggccagtcagagtgttaggagcaacttagcctggtatcgagcagaaacctggccaggctccaggctcctcatctatggtgcatccaccgagggccactggtactcccagccaggttcagtggcaggtgggtctgggacagtagtcactctcacatcagcagcctgctagtctagaagtattttgctagtttattactgtcagtctagtataagtcggtccggtctaccggactacgttcggcggacgggaccgaaggtggagtagtaccgaaacggtaacgtggtacggtctacggacaacctgtcgtcg

SEQ ID NO: 224759 - DNA, 555 bp, Homo sapiens
  misc_feature: GYAE6OF01A47RF.49.33.C11.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (417)..(417): a, c, t, g, unknown or other
  misc_feature (417)..(417): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactgganaaatagtgatgacgcagtctccagccaccctgtctgtgtctccgaggggaaanagtcaccctctcctgcagggccagtcagagtgttaggagcaacttgcctggtatcagcagaacctggccaggctccaggctcctcatctatggtcncactccaaccgagggccacgtcggtactccccgagcccgtaggttcagtggctaggtgggtctgggactagtacgttcacgtctcaccatcagcacgtcctgctagtctagtaagtntttgcttagtttattactgtacagtctaagtatagtcggtccggcttccgactcgttcgggacggacgggaccgtaagggtcggagtacgtaacgaaacgtacgttggacggtccgtagacccaacgtagttcgtacg

SEQ ID NO: 224760 - DNA, 525 bp, Homo sapiens
  misc_feature: GYAE6OF01CQYT1.49.33.C11.1.454.CMB.1.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacttagcctggtatcagcagaacctggccaggctccaggctcctcatcatggtncatccacagggccactggtatcccagccaggttcaggtggcagtgggtctgggactaggagttcactctcaccatcagcagcctgctagtctgaagtattttgctaagtttattactgtcagctaagtatagtcgtccgggctccggactcgttcgggcggtacggaccgtaagggtggaagtagtacgaaacgacgtaggtacggtactagacacctgtcgttacg

SEQ ID NO: 224761 - DNA, 509 bp, Homo sapiens
  misc_feature: GYAE6OF01B60BB.49.33.C11.1.454.CMB.1.raw
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctccaggctcctcatctatggtgcatccaccagggccactggtactcccagccaggttcagtggcagtgggtctgggacagagttcactctcaccatcagcagcctgcagtctagaagtattttgctagtttattactgtcagtcagtataagtggtccggctccggactacgttcggcggagggaccgaagggtggagatacgaaacgacgtgtggtcngacacngtctcg

SEQ ID NO: 224762 - DNA, 221 bp, Homo sapiens
  misc_feature: GYAE6OF01A57AQ.49.33.C11.1.454.CMB.1.raw
  modified_base (175)..(221): a, c, t, g, unknown or other
  misc_feature (175)..(221): n is a, c, g, or t
tcagagtcgagagacacgaccggtgctcgatttagagtgagctcggttgggtttgggggaagaggaagactgacggtcccccaggagttcaggtgctgggcacgacgcgccctgggctgacgtggtcaaggctacttcctctctcgactctgagcgggctggcaaggcgcatagnnnnnnnnnnnnnnnnnnnnnnnnnnnnnnnnnnnnnnnnnnnnnnn

SEQ ID NO: 224763 - DNA, 500 bp, Homo sapiens
  misc_feature: GYAE6OF01AZ6D1.49.33.C11.1.454.CMB.1.raw
  modified_base (203)..(203): a, c, t, g, unknown or other
  misc_feature (203)..(203): n is a, c, g, or t
  modified_base (494)..(494): a, c, t, g, unknown or other
  misc_feature (494)..(494): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctcccaggctcctcatctatggtgcatccaccagggcccactggtatcccagccaggttcagtggcagtgggtctgggacagagttcactctcaccatcagcagcctgcagtctgaagtattttgctagtttattactgtcagcagtataatgtccggctcggacacgttcggcggaggaccgaaggtggagatacgaaacgactgtggctgacacntcgtcg

SEQ ID NO: 224764 - DNA, 174 bp, Homo sapiens; identical to SEQ ID NO: 224712
  misc_feature: GYAE6OF01B8L01.49.33.C11.1.454.CMB.1.raw
  modified_base (173)..(174): a, c, t, g, unknown or other
  misc_feature (173)..(174): n is a, c, g, or t

SEQ ID NO: 224765 - DNA, 644 bp, Homo sapiens
  misc_feature: GYAE6OF01CXJTT.49.33.C11.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (636)..(636): a, c, t, g, unknown or other
  misc_feature (636)..(636): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgtaggagcaacgttgcctggtatcagcaagaaacctggccaggcctccgaggcctcctcatctatggtcncactccaccgagggccctacgtcggtaactcccgagcccgtaggttcaggtggcgaggtcgggtctaggggactaggtacgttccacgttctaccgaacctatcgaacgcaacgtcccttgacctaggttcctaaggtaaagttcgttttagacgttaagttttaactttacgtcgttactaagtacgtaagttaactaacggttcgggtaccccgggacttacccgggtaacttaccgggtttccggggaaccgggtaacggggaacccgtaaaggggtcggaaacgtaacgtaaccgaaaacggtaccgtggtacggctacgacaccgtntccgttcg

SEQ ID NO: 224766 - DNA, 173 bp, Homo sapiens; identical to SEQ ID NO: 224684
  misc_feature: GYAE6OF01BZM7G.49.33.C11.1.454.CMB.1.raw
  modified_base (173)..(173): a, c, t, g, unknown or other
  misc_feature (173)..(173): n is a, c, g, or t

SEQ ID NO: 224767 - DNA, 179 bp, Homo sapiens
  misc_feature: GYAE6OF01AXFCW.49.33.C11.1.454.CMB.1.raw
  modified_base (173)..(179): a, c, t, g, unknown or other
  misc_feature (173)..(179): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctcgtagcactctgagcgggctggcaaggcgcatagnnnnnnn

SEQ ID NO: 224768 - DNA, 511 bp, Homo sapiens
  misc_feature: GYAE6OF01CIU96.49.33.C11.1.454.CMB.1.raw
  modified_base (204)..(204): a, c, t, g, unknown or other
  misc_feature (204)..(204): n is a, c, g, or t
  modified_base (505)..(505): a, c, t, g, unknown or other
  misc_feature (505)..(505): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngtcaccctctcctgcagggccagtcagagtgttaggagcaacttgcctggtatcagcagaaacctggccaggctcccaggctcctcatctatggtgcatcccaccgagggccactggtactcccagccaggttcagtggcaggtgggtctgggacaggagttcactctcaccatcagcagcctgcagtctagaagtatttgctagtttattactgtcagtcagtatagtcgtccggtcgtccggactacgttcggcggagggaccgaggtggagatacgaacgacgtgtcggctgacaccntcgtcg

SEQ ID NO: 224769 - DNA, 505 bp, Homo sapiens
  misc_feature: GYAE6OF01A9484.49.33.C11.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctcccaggctcctcatctatggtncatccacagggccactggtactcccagccaggttcagtggcagtggtctgggacagagttcactctcacatcagcagcctgctagtctagaagtattttgctagtttattactgtcagctagtataagtgtccggctccggactacgttcggcggaggaccgaaggtggagatacgaaacgactgnggtctgacacgntcgtcg

SEQ ID NO: 224770 - DNA, 534 bp, Homo sapiens
  misc_feature: GYAE6OF01CV4RT.49.33.C11.1.454.CMB.1.raw
  modified_base (203)..(203): a, c, t, g, unknown or other
  misc_feature (203)..(203): n is a, c, g, or t
  modified_base (527)..(527): a, c, t, g, unknown or other
  misc_feature (527)..(527): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaaacctggccaggctcccaggcctcctcatctatggtgcatccaccagggccacgtggtactccccagcccaggtttcaggtcggcaggttcggggtctggggacaggatttcactctccaccatcagcagcctgctagtctagaagtattttgctagtttattacttgtcagtcagttaatagtcgtccgggctccggactcgttcggcggacgggaccgagggtggagataacgaaacgacgttggcggtctcgaccaccgngttctcg

SEQ ID NO: 224771 - DNA, 176 bp, Homo sapiens; identical to SEQ ID NO: 224756
  misc_feature: GYAE6OF01CSZIN.49.33.C11.1.454.CMB.1.raw
  modified_base (173)..(176): a, c, t, g, unknown or other
  misc_feature (173)..(176): n is a, c, g, or t

SEQ ID NO: 224772 - DNA, 194 bp, Homo sapiens
  misc_feature: GYAE6OF01DSXCS.49.33.C11.1.454.CMB.1.raw
  modified_base (173)..(194): a, c, t, g, unknown or other
  misc_feature (173)..(194): n is a, c, g, or t
tcagagtcgagagacacgaccggtgctcgatttagagtgagctcgttgggtttggggggaagaggaagactgacggtcccccaggagttcaggtgctgggcacagcggccctgggctgcctggtcaaggctacttcctctctcgactctgagcgggctggcaaggcgcatagnnnnnnnnnnnnnnnnnnnnnn

SEQ ID NO: 224773 - DNA, 726 bp, Homo sapiens
  misc_feature: GYAE6OF01ALZ49.49.33.C11.1.454.CMB.1.raw
  modified_base (211)..(211): a, c, t, g, unknown or other
  misc_feature (211)..(211): n is a, c, g, or t
  modified_base (331)..(331): a, c, t, g, unknown or other
  misc_feature (331)..(331): n is a, c, g, or t
tcagagtcgagagacacgaccggtgctcgatttagagtgagctcgttgggtttgggggaggaactgctcgagttaggacccagacggaaccatcggaagccccgagcgcgacgcgttctcttccgtcctgctactctggcctcccagactaccactggagaatggtgatgacgcagtcctccagccacctgtctgtgtctccgagggaaancgtcaccctctccgtgcacgggccagtccagagtgttaggacgctaacgttagcctggtactacgagtcaagaacctggaccctaggcctacccgaggtcctccgtcatcctagtcggtnaccaatacccgacgagggccctagtcggtactccccgagccctaggttcaggtcggactagggttgggtacgtcgggaactacggtacgtttccacgtttccgtacctaaccgtatccgacgtccgtaacggtcccgtacggaccgtacggttccgtaaggtaaccgttagttttaccgaccgtttaacgttttacttaccgttcgttctacggtactaacggttaacgttacgttccgggttacccggtaccggttacccggtaaccgttaccggttccggggaccgggtacgggtaacccgtaaggggttaccggtaacgtaacgttaaccggaaacggttaaccgtcgggttaccggtacgttaccgaccgtacccgtacgttccgttaccg

SEQ ID NO: 224774 - DNA, 540 bp, Homo sapiens
  misc_feature: GYAE6OF01A6TY9.49.33.C11.1.454.CMB.1.raw
  modified_base (204)..(204): a, c, t, g, unknown or other
  misc_feature (204)..(204): n is a, c, g, or t
  modified_base (398)..(398): a, c, t, g, unknown or other
  misc_feature (398)..(398): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacttgcctggtatcagcagaacctggccaggctccaggctcctcatctatggtgcatccaccagggcccatggtactcccagccaggttcagtggcaggtgggtctggggacaggagttcactctcaccatcagcagcctgcagtctagaagtntttgctagtttatactgtcagtcagtataagtcggtccgggcttccggactaccgtttcgggacggtacgggtaccgtaaggggtcggacgtagtaccgaaacggtactggtacgggtcctaggaccacctagtccgttacg

SEQ ID NO: 224775 - DNA, 173 bp, Homo sapiens; identical to SEQ ID NO: 224684
  misc_feature: GYAE6OF01BC53D.49.33.C11.1.454.CMB.1.raw
  modified_base (173)..(173): a, c, t, g, unknown or other
  misc_feature (173)..(173): n is a, c, g, or t

SEQ ID NO: 224776 - DNA, 505 bp, Homo sapiens
  misc_feature: GYAE6OF01BX7PF.49.33.C11.1.454.CMB.1.raw
  modified_base (202)..(202): a, c, t, g, unknown or other
  misc_feature (202)..(202): n is a, c, g, or t
  modified_base (499)..(499): a, c, t, g, unknown or other
  misc_feature (499)..(499): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagtcaccctctcctgcagggccagtcagagtgttaggagcaacttagcctggtatcagcagaacctggccaggctcccaggctcctcatctatggtgcatccaccagggccactggtactcccagccaggttcagtggcaggtgggtctgggacagagttcactctcaccatcagcagcctgcagtctgaagtatttgctagtttattactgtcagcagtataagtgtccgggtctccggactacgttcggcggagggaccgaagggtggagatacgaaacgacgtgtggctgcacngtctcg

SEQ ID NO: 224777 - DNA, 175 bp, Homo sapiens; identical to SEQ ID NO: 224734
  misc_feature: GYAE6OF01AHM9Z.49.33.C11.1.454.CMB.1.raw
  modified_base (174)..(175): a, c, t, g, unknown or other
  misc_feature (174)..(175): n is a, c, g, or t

SEQ ID NO: 224778 - DNA, 176 bp, Homo sapiens; identical to SEQ ID NO: 224756
  misc_feature: GYAE6OF01AZTNV.49.33.C11.1.454.CMB.1.raw
  modified_base (173)..(176): a, c, t, g, unknown or other
  misc_feature (173)..(176): n is a, c, g, or t

SEQ ID NO: 224779 - DNA, 174 bp, Homo sapiens; identical to SEQ ID NO: 224712
  misc_feature: GYAE6OF01CGGTI.49.33.C11.1.454.CMB.1.raw
  modified_base (173)..(174): a, c, t, g, unknown or other
  misc_feature (173)..(174): n is a, c, g, or t

SEQ ID NO: 224780 - DNA, 562 bp, Homo sapiens
  misc_feature: GYAE6OF01B8FLC.49.33.C11.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
  modified_base (418)..(418): a, c, t, g, unknown or other
  misc_feature (418)..(418): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgacgcagtctccagccaccctgtctgtgtctccgaagggggaaanagtcaccctctcctgcagggccagtcagagtgttaggancaacttagcctggtatcagcagaaacctggccaggctcccaggctcctcatctatggtncactccaccgagggccacgtggtactcccgagcctaggttcaggtggctaggtggggtctgggacaggtagttcacttctacaccatccagcagcctgctagtctagaagttnttttgacttagtttaacttacgtgtcaagtctaagtataagtcggtccgggcctaccggtactacgttcgggacgggtaacgggaccgaagggtggacgtatacgaaacggtacgtggtacggctacgacacctagttcgttcg

SEQ ID NO: 224781 - DNA, 539 bp, Homo sapiens
  misc_feature: GYAE6OF01CNGKZ.49.33.C11.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagaaatagtgatgacgcagtctccagccacctgtctgtgtctcgaggggaaangtcaccctntcctgcagggccagtcagngtgtagancaacttgcctggtatcagcagaacctggccaggcctccaggctcctcatctatggtgcatccacagggccacgtggtactcccagccaggttcagtggcagtgggtctgggactaggtacgttcactctcacctatcagcagcctgctagtctagagtatttgctagtttacttactgtacagtcaagttataagtcgtcccgggtctccgggtactaccggtttcgggacgggtaggaccgagggttaggacgtagtacgtaaacgagtcggtaggtaccgttagccgtaactgtcgttcg

SEQ ID NO: 224782 - DNA, 520 bp, Homo sapiens
  misc_feature: GYAE6OF01E03J5.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctccaggctcctcatctatggtgcatccacagggccacgtggtactcccagccaggttcagtggcaggtggtctgggacaggagttcactctcaccatcagcagctgcagtctgaagtatttgctagtttattactgtcagctaagtaacaatcgtacctcggaccccacgtcgtactacgtttacggccgtagggaccgaacggtcgtaggacagtacacgtaccgaacgtgtcggctgacc

SEQ ID NO: 224783 - DNA, 516 bp, Homo sapiens
  misc_feature: GYAE6OF01DIOIF.49.33.C11.1.454.CMB.1.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaaacctggccaggctccaggctcctcatctatggtgcatccacgagggcccactggtactcccagccaggttcagtggcaggtgggtctgggacagngttcacgtctcaccatcagcacgcctgcagtctagagtatttgcttagtttacttactgtcagtcagttataagtcggtccggctccggactcgttcggcggagggaccagggtggaacgatacgaaacgacgtgtcggctagaccactgtcgtcg

SEQ ID NO: 224784 - DNA, 532 bp, Homo sapiens
  misc_feature: GYAE6OF01ASRKY.49.33.C11.1.454.CMB.1.raw
  modified_base (205)..(205): a, c, t, g, unknown or other
  misc_feature (205)..(205): n is a, c, g, or t
  modified_base (414)..(414): a, c, t, g, unknown or other
  misc_feature (414)..(414): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangtcaccctctcctgcagggccagtcagagtgttaggagcaacttagcctggtatcagcagaaacctggccaggctcccaggcctcctcatctatggtcgcatcccaccgacgggcccacgtggtactccccgagccgaggttcaggtggcaggtgggtctgggacaggtagttcactctcaccatcagcacgcctgcagtcagtaagtntttgctagtttatactgtcagtctaagtatagtcggtccggctaccggactcgttcgggcggtaggaccgtaagggtggagatacgaaacgtacgtggtcggctgaccactgtctacg

SEQ ID NO: 224785 - DNA, 515 bp, Homo sapiens
  misc_feature: GYAE6OF01AZLG9.49.33.C11.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (397)..(397): a, c, t, g, unknown or other
  misc_feature (397)..(397): n is a, c, g, or t
  modified_base (507)..(507): a, c, t, g, unknown or other
  misc_feature (507)..(507): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctcccaggctcctcatctatggtncatccacagggccactggtactcccagccaggttcagtggcagtgggtctgggacagagttcactctcaccatcagcagcctgcagtctagaagtnttttgctagtttattacgtgtcagtcagtataagtcgtccgggctccggactacgttcggcggacgggaccaagggtggagagtacgaaacgacgtgtacggctgacacngtcgtacg

SEQ ID NO: 224786 - DNA, 807 bp, Homo sapiens
  misc_feature: GYAE6OF01DKXHA.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttaggagcaactagcctggtatcagcagaacctggccaggctccgaggcctcctcatctagtggtcacactcccacgacgggccaacgtgggtaacctcccgagcccgtaggtttaccaggttcgggacctagggtttcggggtaccgttacgggggaactacgggtacgttttacccgaaccgtttacccgtacccgaaccttaacgttccaacggtacccgaacggttccccgttacggacccgttaacggtttaccgttaagggttaaacgttacgttttttacggtaacccgtttaaagtttttaacgtttaacccggtttaggtttaacccgtaacggttaccggttaaagttttaacgttaaacgggtttccgggttaaccccggggtaccttacccggggtaaccgtttacccgggtttaccggggaaccgggggtaacggggtaaaccccggtaaagggggttaccgggaaacggttaaccggttaaccggtaaaaccggtaaaccggtttcgggtacggtaccttacgggaaccccttaaccgtaacgtttcccgttaccgg

SEQ ID NO: 224787 - DNA, 694 bp, Homo sapiens
  misc_feature: GYAE6OF01BLMOP.49.33.C11.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccacctgtctgtgtctcgaagggaancgtccaccctctcctgcgaggccagtcagagtgtagganactaacgttgccgttaggtactcgagacgaacgaaaccgtcgggaccacggtccctacccgacggtccctacctactaacttcgttagttcgggtacacctaacgtacccgaaccggtaccgggtacccctaacggttcgggtaacccttccccgaacggtcccgttaacgggttctaagggtcgggaccgtagggttcggggtcgtagggaacctaggtacgttaccaccttcctaccaccagtccaaggctacgtcctaggcctaacgttcgtaaggtaagtttcgtttacgacgtttaagttttaacttcgtagtacaacgtacgtaagttacgtaacgttccgggtacccggtacgtaccgtacgtaccggttcgggacgggtacggacgtaaggtcggaacgtactaacggaacgtacgttggacgtcgtacgacactagttcgtacg

SEQ ID NO: 224788 - DNA, 190 bp, Homo sapiens
  misc_feature: GYAE6OF01DBUS9.49.33.C11.1.454.CMB.1.raw
  modified_base (175)..(190): a, c, t, g, unknown or other
  misc_feature (175)..(190): n is a, c, g, or t
tcagagtcgagagacacgaccggtgctcgatttagagtgagctcggttggggttgggggaagaggaagactgacggtcccccaggagttcaggtgctgggcacagcggccctgggctgcctggtcaaggactacttcctctctcgactcgtgagcgggctggcaaggcgcatagnnnnnnnnnnnnnnnn

SEQ ID NO: 224789 - DNA, 511 bp, Homo sapiens
  misc_feature: GYAE6OF01CHZBC.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttaggagcaacttgcctggtatcagcagaaacctggccaggcctccaggctcctcatctatggtgcatccacagggccacgtggtactcccagccaggttcagtgcaggtgggtctgggactagacgttccactctcaccatcagcagctgcagtcagatatttgctagtttatctgtcagtctagtatagtcggtccggctccggactcgttcggcggacggacgaggtggagtatacgaaacgtacgtgtacgtctagaccactgtcgttacg

SEQ ID NO: 224790 - DNA, 592 bp, Homo sapiens
  misc_feature: GYAE6OF01AWWNV.49.33.C11.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctccaggctcctcatctatggtncatccaccagggccactggtactcccagccaggttcagtgcaggtgggtctgggacagagttcactctcaccatcagcagcctgcagtctagtaagtatttgctagtttattactgtcagtactagtaattaagtcggtacccgggtccgttacccggtacgtaccggttttaccgggaccggggtacggggtaacccgtaaaggggtacgggtaacggtaacgtaaccggaaaaccggtaacggtacggtacgggtaccgtacggaccctaacccgtacgttccgttacgg

SEQ ID NO: 224791 - DNA, 675 bp, Homo sapiens
  misc_feature: GYAE6OF01ELLYD.49.33.C11.1.454.CMB.1.raw
  modified_base (205)..(205): a, c, t, g, unknown or other
  misc_feature (205)..(205): n is a, c, g, or t
  modified_base (330)..(330): a, c, t, g, unknown or other
  misc_feature (330)..(330): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagtcaccctgtctatgtctccgaaggggaancgcccaccctctcctgcagggccagtcagatgtgcagctactagcctgtaccagcagaacctggccaggcctcccgagttcctcctctattcgtttgattcgctaccgtcccgcggacgggcccnctacgacctactccccgagcccgtaggtccgaggtcggtcggtagggttggggttacggactacgtaccttaccgccgtcctaccgaaccctagtccgacgtaccacggtacctaaggacgtaccgtaggtaagttacttttacgacgtttagttttaacttacgtacgtacaacgtacgtccgtaaaccacggttacggtactttaccgttacccggtttccggacccgtacggggtacctacgggtaggtacggtaaacttacgtaaaccggtaaaaccggtacggttccgggtacgggtcttacggaccctaaccgttacggttccttcggttccttaaccg

SEQ ID NO: 224792 - DNA, 517 bp, Homo sapiens
  misc_feature: GYAE6OF01ASS0Y.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaanagtcaccctctcctgcagggccagtcagagtgttaggagcaacttagcctggtatcagcagaaacctggccaggctcccaggcctcctcatctatggtgcatcccaccaggggccacgtggtactcccagcccaggttcagtggcagtgggtctgggacagacgttcactctcaccatcagcagcctgcagtctgtaagtattttgctagtttattactgtcagcagtataagtgtccggctccggactcgttcgggcggagggaccgaagggtggagatacgaaacgacgtgtcggctcgacacctgtctcg

SEQ ID NO: 224793 - DNA, 547 bp, Homo sapiens
  misc_feature: GYAE6OF01AWW9I.49.33.C11.1.454.CMB.1.raw
  modified_base (404)..(404): a, c, t, g, unknown or other
  misc_feature (404)..(404): n is a, c, g, or t
  modified_base (538)..(538): a, c, t, g, unknown or other
  misc_feature (538)..(538): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctccaggcctcctcatctatggtgcatcccaccaggggcccactggtactcccagccaggttcaggtggcaggtgggtctggggacaggagttcactctcaccatcagcagcctgcagtctgaagtntttgctagtttattactgtcagtcagttaataagtcggtcccgggctcccgggactaccgtttcgggcgggtaacggggtaccaaggggtggaacggtataaccgaaacggtaactggtggtctcggacacctnttccggtcg

SEQ ID NO: 224794 - DNA, 534 bp, Homo sapiens
  misc_feature: GYAE6OF01ECI46.49.33.C11.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaacctggccaggctccaggctcctcatctatggtncatccaccgagggccactggtactcccagccaggttcaggtggctaggtgggtctgggacaggtacgttcactctcaaccatcagcacgcctgctagtctagaagtatttgcttagtttattactgtacagctaagtataagtcggtccgggctaccggactacgtttcgggacgggtagggaccgaagggtggaagtatacgaaacgacgtggacgtctacgacactgtcgtcg

SEQ ID NO: 224795 - DNA, 561 bp, Homo sapiens
  misc_feature: GYAE6OF01DS93S.49.33.C11.1.454.CMB.1.raw
  modified_base (303)..(303): a, c, t, g, unknown or other
  misc_feature (303)..(303): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagtcaccctctcctgcagggccagtcagagtgttaggagcaacttagcctggtatcagcagaaacctggccaggctcccaggcctcctcatctatggtncatccacagggccactggtactcccagccaggttcagtggcaggtgggtctgggacngacgttcactctcacntcagcacgcctgcagtctagtaagttattttgacttagtttacttacgtgtctagtcaagtcgtagctaacgtcggtccttacgtcctacggtttccgggacgggacgggtaaccgtaagggtcggaaggtaacgtacgaaaacgtacgttcggttacgtacgttagacctacccgtagttaccg

SEQ ID NO: 224796 - DNA, 621 bp, Homo sapiens
  misc_feature: GYAE6OF01EVB8S.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacttagcctggtatcagcagaaacctggccaggctcccaggctcctcatctatggtgcatccaccgagggcctacgtggtactcccgagccgaggttcaggtgcgaggtcgggtctcgggacagtagtttcaaccttcgtccaaccatcacgcacgcctgcagtctagtaacgtattttgacttagttttattacgtgtcagtactagttaataacgtcggtaccgggtacgttacccggacgttaccggtttaccggggacgggtaacggggtaacccggtaaagggtacgggaacggtaagttaaccgaaaacgggtaaaccgttacgggtaccggggtactacggtaccctaaaccggtagttccgtttaccgg

SEQ ID NO: 224797 - DNA, 636 bp, Homo sapiens
  misc_feature: GYAE6OF01CYXKR.49.33.C11.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctcagccaccctgtctgtgtctccgaggggaaangtcaccctctcctgcagggccagtcagagtgttaggagcaacttgcctggtatcagcagaaaccgtggccaggctcccaggcctcctnatctatggtncactccaccgagggcccacgtcggtactccccagcccgtaggttccaaggtcggcgtagggttgggtcgtggggacaggtacgtttccacttctacacctatcacgcacgcctagcctagtactagtaagttattttcgacttagtttacttacgttgtctagtactaagttaataacgttcgggtccgggtaccgttacccggtacgttaccgggttttacgggaccgggtaacgggtaacccggtaagggtacggggtaaacggtacgttaaaccggaaaaccggttaacggtaggtacgggtccgttacgacccaaccgtacgttccgttcg

SEQ ID NO: 224798 - DNA, 599 bp, Homo sapiens
  misc_feature: GYAE6OF01D6GXF.49.33.C11.1.454.CMB.1.raw
  modified_base (205)..(205): a, c, t, g, unknown or other
  misc_feature (205)..(205): n is a, c, g, or t
  modified_base (416)..(416): a, c, t, g, unknown or other
  misc_feature (416)..(416): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagtccaccctctcctgcagggccagtcagagtgttaggagcaacttagcctggtatcagcagaaacctggccaggcctcccaggcctcctcatctagtggtgcactccaccgagggcccacgtggtactcccgagcctaggttcaggtggcaggtgggtctgggacagtgttcactctcaccatcagcacgcctgctagtctagtaagttnttttgacttagttttattactgtcagtactaagttaatagttccgggtcccgggtccgttacccggacgttaccggtttacggggaccgggtaacggggaacccgtaaggggtcgggtaagtaacgtaaccggtaaaacggtaccgttggtacggtactacggacctaacctgtcgtttaccg

SEQ ID NO: 224799 - DNA, 177 bp, Homo sapiens
  misc_feature: GYAE6OF01C0JDQ.49.33.C11.1.454.CMB.1.raw
  modified_base (171)..(177): a, c, t, g, unknown or other
  misc_feature (171)..(177): n is a, c, g, or t
tcagagtcgagagacacgaccggtgctcgatttagagtgagctcgttgggtttgggggaagaggaagactgacggtcccccaggagttcaggtgctggcacagcggccctggctgcctggtcaaggactacttcctctctcgactctgagcgggctggcaaggcgcatagnnnnnnn

SEQ ID NO: 224800 - DNA, 174 bp, Homo sapiens; identical to SEQ ID NO: 224712
  misc_feature: GYAE6OF01A13RP.49.33.C11.1.454.CMB.1.raw
  modified_base (173)..(174): a, c, t, g, unknown or other
  misc_feature (173)..(174): n is a, c, g, or t

SEQ ID NO: 224801 - DNA, 224 bp, Homo sapiens
  misc_feature: GYAE6OF01A6P6O.49.33.C11.1.454.CMB.1.raw
  modified_base (178)..(224): a, c, t, g, unknown or other
  misc_feature (178)..(224): n is a, c, g, or t
tcagagtcgagagacacgaccggtgctcgatttagagtgagctcgttgggtttggggggaaggaggaagactgaccggtccccccaggagttcacggtgctgggcacagcggccctgggctgcctggtcaaggactacttcctctctcgactctgagcgggctggcaaggcgcatagnnnnnnnnnnnnnnnnnnnnnnnnnnnnnnnnnnnnnnnnnnnnnnn

SEQ ID NO: 224802 - DNA, 566 bp, Homo sapiens
  misc_feature: GYAE6OF01AJ57U.49.33.C11.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (452)..(452): a, c, t, g, unknown or other
  misc_feature (452)..(452): n is a, c, g, or t
  modified_base (547)..(547): a, c, t, g, unknown or other
  misc_feature (547)..(547): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggancaacttgcctggtatcagcagaacctggccaggctcccaggcctcctcatctatggtcgaccatcccaccgacggggccctacgtgggtaactccccaaggcccctaagggtttccgaaggttcgggcgtagggttcggggtccgtagggggaaccaggtacgtttccacgttcctaccaccatcagcacgtcctgctagtctagtaagtnttttgctagttttatactgtcagtctagtatacgtgtccggctccggtactacgttcggcggacggaccgtaagggtgagatacgaacgacgtgnggtctagaccactgtctcg

SEQ ID NO: 224803 - DNA, 647 bp, Homo sapiens
  misc_feature: GYAE6OF01D9GEG.49.33.C11.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (310)..(310): a, c, t, g, unknown or other
  misc_feature (310)..(310): n is a, c, g, or t
  modified_base (448)..(448): a, c, t, g, unknown or other
  misc_feature (448)..(448): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaangtccaccctctcctgacagggccagtcagagtgtaggancaagttgctggtactcgagcaacgaaccgtggccaggcctcccgaggcctcctcactctagtgggtnccactcccgaccggagggcccacgtggtacctcccgagccgtaggttcacgggtgccgtaggtcgggtcgtacgggactaggtacgtcacctcgtaccactatcgagccgacgtcctagcctagtcgtaggaagtttntttcggactttagtttacgtttcgtagtacgtacgtacgtaagttaagtaacgttcggttacggttcgggtaccgttaccggtacgttaccggttacggggacggggtaccgggtaaccggtaaggggtacgggtaagtaacggtaaaccgaaaacggttccggtaggtcggtaccgtagaccctaacgtcgttacccg

SEQ ID NO: 224804 - DNA, 528 bp, Homo sapiens
  misc_feature: GYAE6OF01BXV2S.49.33.C11.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
  modified_base (398)..(398): a, c, t, g, unknown or other
  misc_feature (398)..(398): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttgcctggtatcagcagaacctggccaggctccaggcctcctcatctatggtncatccaccagggccactggtactcccagccaggttcagtggcaggtgggtctgggacagtagttcactctcaccatcagcagcctgcagtctagtaagtnttttgactagtttattactgtcagctaagtataagtcggtccgggctaccggactaccgttcggcggagggaccgaagggtggagtagtacgaaacgtacgtggtacggtctacgaccacctgtcgttcg

SEQ ID NO: 224805 - DNA, 173 bp, Homo sapiens
  misc_feature: GYAE6OF01BT9JN.49.33.C11.1.454.CMB.1.raw
  modified_base (173)..(173): a, c, t, g, unknown or other
  misc_feature (173)..(173): n is a, c, g, or t
tcagagtcgagagacacgaccggtgctcgatttagagtgagctcgttgggtttgggggaagaggaagactgacggtcccccaggagttcaggtgctgggcacaggggccctgggctgcctggtcaaggactacttcctcgtagcactctgagcgggctggcaaggcgcatagn

SEQ ID NO: 224806 - DNA, 616 bp, Homo sapiens
  misc_feature: GYAE6OF01EZ9VC.49.33.C11.1.454.CMB.1.raw
  modified_base (244)..(244): a, c, t, g, unknown or other
  misc_feature (244)..(244): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaagagtccaccctctcctgcagggccagtcagagtgtaggancaacttagcctgtatcagcagaaacctggccaggcctccaggcctcctcatctagtcggtgccactcccaccgagggccctacgtcggtactccccagccctagggttcaggtggctaggtgggtctgggacaggtagtcactctacacctatcacgcacgtcctgctagtctaggtaagtattttacgacttaagttttattacgttgtacgtagactaaggtaactaagttccgggttcccgggtcgttacccgggtaaccgttaccggtttccggggacgggtaaccggggtaaccgtaaaggggtgggaacgtaagtaaccgtaaacggtaccgtaggtacggtcgtacgacacccgtatccgttacg

SEQ ID NO: 224807 - DNA, 685 bp, Homo sapiens
  misc_feature: GYAE6OF01B2N07.49.33.C11.1.454.CMB.1.raw
  modified_base (205)..(205): a, c, t, g, unknown or other
  misc_feature (205)..(205): n is a, c, g, or t
  modified_base (311)..(311): a, c, t, g, unknown or other
  misc_feature (311)..(311): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangtccaccctctcctgcgagggccagtcagagtgttaggagcaacttgcctggtatcagcaagaaaccgtggaccaggcctcccgaggcctcctcatctagtcggtncactccacgacggccacgtggtactcccgagccgtaggttcaggtcggcgtaggttcggggtacgtagggaacgtaggtacgttccacttccgtaccaacctagtacgacgtccacgacccgttggacctaggttcgtaaggtaacgtttagttttcgaactttaagtttttacttacgttgttacgacgtacgttaagttaacgttacggttacgggttacccgggaccgttacccggtacgttaccgggtttaccggggacggggtaaccgggtaaccggtaaggggtacgggtaacggtaaccgtaacggtaaaaccggtaccggttacggtacggtaccgttacggaccctaacctgtttaccgttaccg

SEQ ID NO: 224808 - DNA, 601 bp, Homo sapiens
  misc_feature: GYAE6OF01CQ0OI.49.33.C11.1.454.CMB.1.raw
  modified_base (204)..(204): a, c, t, g, unknown or other
  misc_feature (204)..(204): n is a, c, g, or t
  modified_base (438)..(438): a, c, t, g, unknown or other
  misc_feature (438)..(438): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacttgcctggtatcagcagaaacctggccaggcctcccaggctcctcatctatggtgcactccaccaggggcccaacgtggtaactcccgaagcctaaggtttccaggtgggacagggtggggtctaggggactaggtagtttcacgttcctacaccgtataccagtccacgcctggcctagttctagaagttntttgcttagtttattactgtcagtctagtaatagtcggtccggtacgtcccggtactcggtttaccgggcgggtaaccggggacgtaaggggtacgggataagtaaccggaaaacgtaccgttgggtacggtacgtacggacccaaacccgtgttccgttacg

SEQ ID NO: 224809 - DNA, 626 bp, Homo sapiens
  misc_feature: GYAE6OF01EESS8.49.33.C11.1.454.CMB.1.raw
  modified_base (205)..(205): a, c, t, g, unknown or other
  misc_feature (205)..(205): n is a, c, g, or t
  modified_base (433)..(433): a, c, t, g, unknown or other
  misc_feature (433)..(433): n is a, c, g, or t
tcagagtcgagagacacgaccggtgctcgatttagagtgagctcgttgggtttggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttaggagcaacttagcctggtatcagcaagaaacctggccaggcctcccgaggcctcctcatctagtggtcgacactcccaccgtacgggcccacgttggtactcccgagtccctaggttcgaggtggacagggtcgggtcgtagggactaggtacgttcactctacacatcgagcagctgcagtctagtaagttntttgacttagtttactacgttcgtcagtctaagtactagtcgggtacccgggtccgtaccgggtaaccgttaccgggtttaccggggacgggtaaccggggaacgtaacgggggtaggtaaacggtaacgtaaaccggaaaaccggtaacggttcggtacgggtacctcggaacctaccctgttcccgttacg

SEQ ID NO: 224810 - DNA, 181 bp, Homo sapiens
  misc_feature: GYAE6OF01BDPBM.49.33.C11.1.454.CMB.1.raw
  modified_base (162)..(162): a, c, t, g, unknown or other
  misc_feature (162)..(162): n is a, c, g, or t
  modified_base (168)..(181): a, c, t, g, unknown or other
  misc_feature (168)..(181): n is a, c, g, or t
tcagagtcgagagacacgaccggtgctcgatttagagtgagctcgttgggtttggggagaggaagactgacggtccccaggagttcaggtgctgggcacagcggccctgggctgcctggtcaaggctacttcctctctcactctgagcgggctggcaaggcncatagnnnnnnnnnnnnnn

SEQ ID NO: 224811 - DNA, 501 bp, Homo sapiens
  misc_feature: GYAE6OF01EKO38.49.33.C11.1.454.CMB.1.raw
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
  modified_base (495)..(495): a, c, t, g, unknown or other
  misc_feature (495)..(495): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctccaggctcctcatctatggtgcatccaccagggccactggtactcccagccaggttcagtgcaggtgggtctgggacagtagtcactcncaccatcagcagcctgcagtctagaagtatttgctagtttattactgtcancagtataatgtccggctccgactacgttcggcggaggaccgaaggtgagatacgaaacgaactgtgctagacactntctacg

SEQ ID NO: 224812 - DNA, 541 bp, Homo sapiens
  misc_feature: GYAE6OF01AI1LX.49.33.C11.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (534)..(534): a, c, t, g, unknown or other
  misc_feature (534)..(534): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggancaacttgcctggtatcagcagaaacctggccaggcctcccgaggcctcctcatctatggtncatccaccgagggccacgtggtactcccagccaggttcaggtggctaggtgggtctgggacaggtacgttcacttctccaccatcagcacgcctgcagttcgtagtaagtagttttgacgttagtttattacttgtcagtctaagtatagtcgtaccgggtctccggactacgttcgggcggacggacgagggtgagtagtacgaacggtacgtgtcggctacgacacgtntcgttcg

SEQ ID NO: 224813 - DNA, 175 bp, Homo sapiens; identical to SEQ ID NO: 224707
  misc_feature: GYAE6OF01AM5OH.49.33.C11.1.454.CMB.1.raw
  modified_base (173)..(175): a, c, t, g, unknown or other
  misc_feature (173)..(175): n is a, c, g, or t

SEQ ID NO: 224814 - DNA, 714 bp, Homo sapiens
  misc_feature: GYAE6OF01DUK3F.49.33.C11.1.454.CMB.1.raw
  modified_base (206)..(206): a, c, t, g, unknown or other
  misc_feature (206)..(206): n is a, c, g, or t
tcagagtcgagagacacgaccggtgctcgatttagagtgagctcggttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaangtccaccctctcctgcagggccagtcagagtgtaggagcaacgttgcctggtatcagcaagaaccgtggaccaggcctccccgaggcctcctcacttctagtggtcgcactcccgaccgacgggccacgttcggtactccccgagccgtaggttacaggtcgggcgtaggggttcggggtacgtaggggactaaggtacgtttaccacgttccgtaccaaccgtacgtacacgaccgaccgtccgtacggaccgtaggttcgtaaggtaaacgtttacgttttaggtacgtttaagttttaactttacgttaggttacgtaaggtacgtaaggtttaacgttaacggttccgggttacccgggttaccggttacccgggtaaccgttaccgggtttccggggacgggtaacggggtaaccggtaaaggggttacgggaacggtaacgttaaaccggaaaccgtaacggttacggtacggtacgtacgaccgtaccctagttcgttacg

SEQ ID NO: 224815 - DNA, 211 bp, Homo sapiens
  misc_feature: GYAE6OF01CYX69.49.33.C11.1.454.CMB.1.raw
  modified_base (177)..(211): a, c, t, g, unknown or other
  misc_feature (177)..(211): n is a, c, g, or t
tcagagtcgagagacacgaccggtgctcgatttagagtgagctcgttgggtttgggggaagaggaagactgaccggtcccccaggagttcaggtgcctgggcacagcggcccgtggctgcctggtcaaggctacttcctctctcgactctgagcgggctggacaaggccacatagcnnnnnnnnnnnnnnnnnnnnnnnnnnnnnnnnnnn

SEQ ID NO: 224816 - DNA, 725 bp, Homo sapiens
  misc_feature: GYAE6OF01CHO7L.49.33.C11.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (319)..(319): a, c, t, g, unknown or other
  misc_feature (319)..(319): n is a, c, g, or t
tcagagtcgagagacacgaccggtgctcgatttagagtgagctcggttgggtttgggggaggaactgctcagttaggacccagacggaaccatggaagccccagcgcagcttctcttcctcctgctactctggctcccagataccacgtggagaaatagtgatgacgcagtctccagcccacctgtctgtgtctccgagggaaagngtccaccctctcctgcgagggccagtcagagtgttaggancaacgttagcctggtactcagacaacgaaacctggaccaggtcctcccgaggtcctcctcatcgtagtcggtnaccactcccgaccgacgggcctaacggtcggtacgcccgagtcctaggttcaggtggtacgtaggttcgggtacgtaggggaactaggtacgtttaccacgttccctactaaccgtaacgtcgaacggtcctaacggtcccctagggtacccgtacggttaccgttaagggtaaacgtttacgttttacggaaccctttaaaggtttttacctacgtttggtacctaagtaaccgtaagttaaagtaacggttcccgggtaccggggtccttaacccgggtacgtttaccgggttaccgggggacgggtaaccgggaacccgtaaggggtaggaaaccgtaagttaacccgtaaacggacgttagggtacgtaccgtacggaccctaccgtacgttcgttacccgg

SEQ ID NO: 224817 - DNA, 771 bp, Homo sapiens
  misc_feature: GYAE6OF01DAKWG.49.33.C11.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcacctctcctgcagggccagtcagagtgtagagcaattgcctggtatcagcagaactggccaggctcccagctcctcatctatggtncatccacgnggccacgtggtactacccgagcccgtaaggttcgaaggtcggacgaggttcgggggtaccgttaggggaacctaagggtacggttttaccaacctttccgttaccaaccccgtaattaccgaaccgccgaacggtccccgttacggaccgtaaggttaccgttaagggtaaacggtttacgttttttacggtaccgtttaaacgggttttttaacttttaaccgtttacggttacgtaacggtacgttaaacggtttaaagtttaaacgttacgggttaccccgggggtaccgttaccccggggttaacccggttaccggtttttacccgggggaaccggggtaaaccgggggaaacccggtaaacggggttacggggaaacggttaacgtaacccggtaaaaaaccggtaaacccgttagggtaacgggtaccgttacgggacctaacccgtacgtttccgtttaccgg

SEQ ID NO: 224818 - DNA, 537 bp, Homo sapiens
  misc_feature: GYAE6OF01E0BJC.49.33.C11.1.454.CMB.1.raw
  modified_base (416)..(416): a, c, t, g, unknown or other
  misc_feature (416)..(416): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagtcaccctctcctgcagggccagtcagagtgttaggagcaacttagcctggtatcagcagaaacctggccaggctccaggctcctcatctatggcgcatccaccgagggccacgtggtactccagccaggttcagtggcagtgggtctgggacagagttcactctcaccatcagcagctgctagtctgaagtatttgactagtttattatntacagacagttaataagtcggtacccggtcgttaccggactaccggtttcggacgggaagggaccgaagggtaggacgtaatacgaaacgactagggtcgacgttnaccacgtntcgttcg

SEQ ID NO: 224819 - DNA, 686 bp, Homo sapiens
  misc_feature: GYAE6OF01BFG2P.49.33.C11.1.454.CMB.1.raw
  modified_base (207)..(207): a, c, t, g, unknown or other
  misc_feature (207)..(207): n is a, c, g, or t
  modified_base (507)..(507): a, c, t, g, unknown or other
  misc_feature (507)..(507): n is a, c, g, or t
  modified_base (542)..(542): a, c, t, g, unknown or other
  misc_feature (542)..(542): n is a, c, g, or t
tcagagtcgagagacacgaccggtgctcgatttagagtgagctcggttgggtttgggggaggaactgctcagttaggacccagacggaaccatggaagccccagcgcagcttctcttcctcctgctactctggcctcccagataccatggaagaaatagtgatgacgcagtctccagcccacctgtctgtcgtctccgaaggggaancgtccaccctctcctggcacgggcagtcagtagtggtaggagtcctaaacgttcgccgtaggtaatcgaagacaacgtaaaccgtggaccaggcctaccgaggtcctcctacaactcgtagtcggtcactacacccgaacgacgggccctagttacggtacctaccgacggtaccgtaggttccgaaggtcgggacgtagggtcggggtaccgtaggggaactacgggtacctcctacgtcgtaccaaccgtatccgaacggtacaccgtcctacggaccgtagtacgtagtaacgtttntttagtacgttagtttaacttacgtagtactacgntaacgttacgtaacgttccggtaccggtcgtacccggtacgttaccgggtacgggaaggtaccgggtacggtaaagggtcgaaacgtaagaaaccgtaaacggtcgtacgtagtccgtacgtacctaaccgttagttcgtaacg

SEQ ID NO: 224820 - DNA, 177 bp, Homo sapiens
  misc_feature: GYAE6OF01EENNV.49.33.C11.1.454.CMB.1.raw
  modified_base (173)..(177): a, c, t, g, unknown or other
  misc_feature (173)..(177): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnn

SEQ ID NO: 224821 - DNA, 678 bp, Homo sapiens
  misc_feature: GYAE6OF01B1YOG.49.33.C11.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctctcctgcagggccagtcagagtgtaggagcaacttgcctggtatcgagcaagaaacctggccaggctcccaggcctcctnatctagtggtcncatccaccgacgggcctaacgtggtactcccagcctaggttcaggtcggacaggttgggtctgggacaggtacgttccaacttcctcgaaccctagtaccgacggtccacggtcccctggacctaacgggttcctaaggtaaacgtttcgtttttacgacgtttaaagtttttaactacgtttgggtacctaaggtactaaagtttaaacgttaacgttccggggttaccccgggtaccgttacccgggtaactttacccggtttaccggggaaccgggtaacgggtaaaccgtaaggggtacggtaacgtaacgttaaccgaaaacgggtacgttacggtacgggtctacggacctaacctgttcttaccgg

SEQ ID NO: 224822 - DNA, 178 bp, Homo sapiens
  misc_feature: GYAE6OF01BY60I.49.33.C11.1.454.CMB.1.raw
  modified_base (174)..(178): a, c, t, g, unknown or other
  misc_feature (174)..(178): n is a, c, g, or t
tcagagtcgagagacacgaccggtgctcgatttagagtgagctcgttgggtttgggggaagaggaagactgacggtccccccaggagttcaggtgctgggcacagcggccctgggctgcctggtcaaggactacttcctctctcgactctgagcgggctggcaaggcgcatagnnnnn

SEQ ID NO: 224823 - DNA, 540 bp, Homo sapiens
  misc_feature: GYAE6OF01CPCQ3.49.33.C11.1.454.CMB.1.raw
  modified_base (203)..(203): a, c, t, g, unknown or other
  misc_feature (203)..(203): n is a, c, g, or t
  modified_base (355)..(355): a, c, t, g, unknown or other
  misc_feature (355)..(355): n is a, c, g, or t
  modified_base (397)..(397): a, c, t, g, unknown or other
  misc_feature (397)..(397): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttgcctggtatcagcagaaacctggccaggctcccaggctcctcatctatggtgcatccacagggccacgtggtactcccagccaggttcagtggcagtgggtctggganagagttcacgtctcacctatcagcagcctgcagtctgaagtntttgactagtttattactgtcagtctagtataagtcgtccgggtctacccgggtactacggtttcgggcgggtaacggaccgtaagggtcggaagtataccggaaaacgacgtggtacggtctacgaccacctattcgttacg

SEQ ID NO: 224824 - DNA, 785 bp, Homo sapiens
  misc_feature: GYAE6OF01DYCLV.49.33.C11.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccatggaagaaatagtgatgacgcagtctccagcccaccctgtctgtgtctccgaggggaancgtccaccctctcctgcagggccagtcagagtgtaggancaacgttagcctaggtactcagacaacgtaacctggaccacggcctccccgaggtcctccctacattcctagtcggtacacctactacccgaccgacgggccctacggttcggtacctcccgaggtccgtaggttcgaggtggacgtagggtcgggtcgtagggaactaggtacgttcctaacgttcgtaaccacctagtccaacggtcctaacggtcccgtaggtacccgttacggttacgttaagggttaaacgttttacgttttacggtaaccttttaaggtttttaccttacggttacgttaaccgtaaggtaaccgttaaagggtttaacgttaaccgggtttccggggtaccccgggttaccggttaaccccgggttaaccggttttacccggggttaccgggggaaccgggttaaacggggaacccggttaaagggggtacgggtaaacgttaacgtaaaacccgggtaaacggtaccgggttacggtaccgggtacgtacccggaaccttaacccgttgttccggtttacccg

SEQ ID NO: 224825 - DNA, 751 bp, Homo sapiens
  misc_feature: GYAE6OF01C5HWT.49.33.C11.1.454.CMB.1.raw
  modified_base (207)..(207): a, c, t, g, unknown or other
  misc_feature (207)..(207): n is a, c, g, or t
  modified_base (298)..(298): a, c, t, g, unknown or other
  misc_feature (298)..(298): n is a, c, g, or t
tcagagtcgagagacacgaccggtgctcgatttagagtgagctcgtttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngtccaccctctcctgcagggccagtcagagtgttaggagcaacttgcctggtatcagcaagaaacctggccaggcctcccgaggcctcctnatctagtggtcgcactcccaccgagggccctacgtggtactccccgagccctaaggtttccaggttcggacgtagggttggggtcgttaggggaactagggtacgtttccaaccgttcctacccgacctagtccgaacggccaacggtcccgtggacccttaggttccgttaaggtaaaggtttacgttttttacggaccgttttaaaggtttttaactttaccgtttacggttaccgtaagggttacgttaaaggtttaaacgtttaacggtttccggggtacccggggtaccgtttacccgggtaacctttaccgggttttaccggggaacgggggtaaaccgggtaacccggtaagggggttacgggaaacggtaccggttaaacggtaaaaccggtaacggttgggtacgggtacctacgggaccctaacccgtgttcccgtttaccgg

SEQ ID NO: 224826 - DNA, 177 bp, Homo sapiens
  misc_feature: GYAE6OF01DKLFB.49.33.C11.1.454.CMB.1.raw
  modified_base (169)..(177): a, c, t, g, unknown or other
  misc_feature (169)..(177): n is a, c, g, or t
tcagagtcgagagacacgaccggtgctcgatttagagtgagctcgttgggttgggggaagaggaagactgacggtcccccaggagttcaggtgctgggcacagcgcctggctgcctggtcaaggactacttcctctctcgactctgagcgggctggcaaggcgcatagnnnnnnnnn

SEQ ID NO: 224827 - DNA, 714 bp, Homo sapiens
  misc_feature: GYAE6OF01DV3EI.49.33.C11.1.454.CMB.1.raw
  modified_base (206)..(206): a, c, t, g, unknown or other
  misc_feature (206)..(206): n is a, c, g, or t
  modified_base (486)..(486): a, c, t, g, unknown or other
  misc_feature (486)..(486): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaattagtgatgacgcagtctccacgcccacctgtctgtgtcgtcgaggggaaancgtccacctctacctgcgacgggccagtacagtacgtcgttaggactactaacgttcgcccgtaggttactacgaacgtacgaacgtaaaccgtcggaccgaacggcctacccgaggtcctccctactaatcgttagtcgggtcacctacgtcccgaaccggacgggtaccctaacgttcgggttaaccctaccccggaacggtacccgttagggtttaccaggggttcggacgtagggttcgggtacgtagggaactaggtacgttcacttcaccaacntcgagctacgcctgactagtacgtaagtaacgttgttttagactttagttttacttacgtcgtactagtacttaagttaattacgtacgggtccggtaccgttaccggtacgttaccgggttcgggaccgggtaaacgggtaccggtaagggtaggtaacgttaaagtaaccggtaaaacgttcggtagggttacggctaacggacctaaaccgttgttcgtttaccg

SEQ ID NO: 224828 - DNA, 750 bp, Homo sapiens
  misc_feature: GYAE6OF01DME2U.49.33.C11.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagaaatagtgatgacgcagtctccagccaccctgtctgtgtctccgaggggaaangtccacctctcctgcagggccagtcagagtgtagganctaacttgcctggtatcagcaagaacctggaccaggcctccaggcctcctactatctagtggtcgacactacccgacgtaccgggcctaacgttcggtacctacccagtacccgtagggtttcaaggtgggcctagggtcgggttacgtacgggtactaggtacgtttacaccttcctaccctaactacgtaccgaacggccgtaaccgtcctacggtacgtaacggttactaaggttaaacgttttgtttttacgtttaaagtttttacctttacgttacgttaccgaaggttcctaaggtttaaagttacggttccggggtaccccgggtttaccggtaaccggttaccggttaaccggttttccgggggaaccggggtaaacgggtaaccggtaaaggggtttaacggaaggttaacccgtaaacggaaaaacggttaccgggttacgggtacggttaccctacgggttaacccctaacggttaccgtttcgtcggttttaaccccg

SEQ ID NO: 224829 - DNA, 694 bp, Homo sapiens
  misc_feature: GYAE6OF01CNKOD.49.33.C11.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangtcaccctctcctgcagggccagtcagagtgttagganctaacttgcctggtatcagcagaaacctggccaggctccaggcctcctcatctagtggtgacactccaccgagggccacgtcggtactccacgccgtaggttcaaggtggcgtaggtcggtcgtaggggactaggtacgtttacgactccgtctaacctataccgacgcacgtcctaggacctaggttactaggtaagttgttttacgacgtttagttttacgtttaacgttgtactagtacgtaacgtttaacgttaacggttcgggttacccgggtaccgttacccgggtaccgttaccggttttaccgggggaccggggttaacgggaaacccgggttaaggggttacggggtaaacggtaacggtaaaacccggtaaaaccggttaaacggttacgggtacgggtacccgttacggaacccctaacccgttcggttaccgtttaccggg

SEQ ID NO: 224830 - DNA, 182 bp, Homo sapiens
  misc_feature: GYAE6OF01CHJTF.49.33.C11.1.454.CMB.1.raw
  modified_base (174)..(182): a, c, t, g, unknown or other
  misc_feature (174)..(182): n is a, c, g, or t
tcagagtcgagagacacgaccggtgctcgatttagagtgagctcgttgggtttgggggaagaggaagactgacggtccccccaggagttcaggtgctgggcacagcggccctgggctgcctggtcaaggactacttcctctctcgactctgagcgggctggcaaggcgcatagnnnnnnnnn

SEQ ID NO: 224831 - DNA, 687 bp, Homo sapiens
  misc_feature: GYAE6OF01BXPSA.49.33.C11.1.454.CMB.1.raw
  modified_base (205)..(205): a, c, t, g, unknown or other
  misc_feature (205)..(205): n is a, c, g, or t
  modified_base (309)..(309): a, c, t, g, unknown or other
  misc_feature (309)..(309): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcgagggccagtcagagtgtaggagcaacttagcctggtatcagcaacgaaacctggccaggcctcccgaggcctcctcatctagtggtcncactcccaccgacgggccctacgttacggtactcccgacgcccgtaggttcaggtcggcgtaggtcgggtcgtacgggacaggtacgttcactcctaccaccatccgacgcagtcctggacctaggttctaagtaagttattttcggactttaagttttaacttacttggttaccaggtacgaacggtccgttaacgaccttaaccgtccggttccctacgttcccgtaaccggttttcccgggggaccgggtaaacggggaacccggtaaagggggtacgggtaaacggtaaccgttaaacccgggaaaaacgggttaccgttacggggttacgggtaccgttacccgggaacccttaacccgttgtttaaccccgg

SEQ ID NO: 224832 - DNA, 748 bp, Homo sapiens
  misc_feature: GYAE6OF01B0HVB.49.33.C11.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtccaccctctcctgcagggccagtcagagtgttaggagcaacttagcctggtatcagcaagaaacctggccaggcctcccgaggcctcctcatctatggtncactcccaccgacggggccctacgttgggttacctccccgaaggtcccgtaagggtttccagggttgggaccgtaggggttcgggggtaccgtgggggaacctagggtacgtttccaccgttcctaccaacccgtattccgaacggccacgtcccgtacggaccgtacggttcgtaaggtaaagttagtttttacggaccgtttaagtttttaactttacgttggttacctaaggtactaaggtttaacgttaaacgttcgggttacccggggtccgttacccggggtaaccgttacccgggtttaccggggacccgggggtaacggggtaaacccggtaaagggggttacgggtaaacggtaacgttaaaccggaaaacggtaaccggttacgggtacgggtaccgttacggacccgtaacccgtagttccgtttaccgg

SEQ ID NO: 224833 - DNA, 663 bp, Homo sapiens
  misc_feature: GYAE6OF01CID1N.49.33.C11.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctccagataccactggagaaatagtgatgacgcagtctccagccacctgtctgtcgtctcgaggggaaangtcaccctctcctgcgagggcagtcagagtgtaggancaactgctaggtatcagacagaaacctggaccacggctcccgaggcctcctcatctagtggtcgcactccgacgacgggcctacgtcggtacctacccgacgtccgtaacggttcgaaggttcggaccgtagggttggggtacggttaggggaacctagggtacgtttccaaccttccttaccgaaccctagtaccgtaacggacctaccggtccgtacgggtacctaggttacttaagggtaacgtttagttttacggactttaacgttttattaccgtgtaccgtagcttaagttaatacggtcggtccgggtaccgttccgaacgttcggttaccggggacggtacgggaccgtaggggacgtacgtactaacggaaacgttaggtcggtacgtcgtacgtacccaactcgttcgttacg

SEQ ID NO: 224834 - DNA, 606 bp, Homo sapiens
  misc_feature: GYAE6OF01D3TZO.49.33.C11.1.454.CMB.1.raw
  modified_base (203)..(203): a, c, t, g, unknown or other
  misc_feature (203)..(203): n is a, c, g, or t
  modified_base (461)..(461): a, c, t, g, unknown or other
  misc_feature (461)..(461): n is a, c, g, or t
  modified_base (565)..(565): a, c, t, g, unknown or other
  misc_feature (565)..(565): n is a, c, g, or t
  modified_base (601)..(601): a, c, t, g, unknown or other
  misc_feature (601)..(601): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgtaggagcaacttgcctggtatcagcagaaacctggaccaggcctcccgaggcctcctcatctagtggtgccactcccaccgagggcccacgttcggtactccccgacggcccgtaaggtttcgaggttggccgtagggttcggggtcgtgggggactaggtacgttccactccgttaccaaccctatccgaggccgacgcctggacctaggttcctagtaagtttntttggtacctttaagttttactttacgttgtacaggctaaggtcgtaacgcctacgtcggtccttctcgtaacgttcgggacgggtacggaacgagggtcgganacgtaacgaaacggtgtagggtcgactgacctcgtntccgg

SEQ ID NO: 224835 - DNA, 536 bp, Homo sapiens
  misc_feature: GYAE6OF01CGEVM.49.33.C11.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (411)..(411): a, c, t, g, unknown or other
  misc_feature (411)..(411): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacttgcctggtatcagcaagaaacctggccaggctcccaggctcctnatctagtggtncactccacgngggccacgtggtactcccagcctaggttcaggtggctaggtgggtctgggacaggtcgttcactctacacctatcagcagcctgctagtctagtaagtntttgacttagtttacttacgtgtactagtactagttataacgtcggtccggtcgtccggtactcgttcggcggacggacgtaggtaggacgatacgaacgacgtggtcgctcgacactgtcgtcg

SEQ ID NO: 224836 - DNA, 612 bp, Homo sapiens
  misc_feature: GYAE6OF01D0WXG.49.33.C11.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagaaatagtgatgacgcagtctccagccaccctgtctgtgtctccgaggggaaangtcaccctctcctgcagggccagtcagagtgttaggagcaacttagcctggtatcagcagaaacctggccaggctccaggctctcatctatggtncatccacagggccacgtggtactcccgagccagggttcagtcgggcaggtcgggtctgggacaggtacgttcactctccacatcacgcacgctgcagtctagtaacgtattttcgcttagtttacttacgtgtactagtactaagttaataacgttcggttcccgggtccgttacccggtaccgttaccggtttccggggaccggggtaacggggtaacccggtaaaggggtcgggaaacggtaacgtaaccggaaaaccggtaaccgttgggtaacggtccgtacggaccctaacccgtagtccgtttaccgg

SEQ ID NO: 224837 - DNA, 570 bp, Homo sapiens
  misc_feature: GYAE6OF01AYT4A.49.33.C11.1.454.CMB.1.raw
  modified_base (204)..(204): a, c, t, g, unknown or other
  misc_feature (204)..(204): n is a, c, g, or t
  modified_base (455)..(455): a, c, t, g, unknown or other
  misc_feature (455)..(455): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctctcctgcagggccagtcagagtgttaggagctaacttagcctggtatcagcaagaaacctggccaggcctcccgaggcctcctcatctagtggtgcatcccaccgacgggcccacgtcggtactccccgagcccgtaggttccgaggtcgggctaggtggggtctggggacaggtacgttcactctacaccatcagcacgcctgcgagtcgtagtaagttatttgacttagttttatcgttntacgagctaagttataagtcggtccggcttccggactacgttcgggcggtacggaccgtaagggtggagacgtacgaaacggtacgtggtacggtctacgaccactatcgttacg

SEQ ID NO: 224838 - DNA, 172 bp, Homo sapiens; identical to SEQ ID NO: 224749
  misc_feature: GYAE6OF01B6DWG.49.33.C11.1.454.CMB.1.raw

SEQ ID NO: 224839 - DNA, 588 bp, Homo sapiens
  misc_feature: GYAE6OF01AUWA4.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaacctggccaggctccaggctcctcatctatggtgcatcccaccgagggcccactggtactcccgagccctagggttcagtggcaggtgggtctgggactggtactcacgtcacactatcagcgacgccgtgactagtctaggtaagttagtttcgtacgttagttttattacgttcgtacagtacgtagttaactaagttccgggtaccggtccgttacccggtaccttacggttccgggacgggacgggtaccgtagggtacggaacgtacgtaaacggaaacgtacggtggtacggtccgtacgacctactgttcgttacg

SEQ ID NO: 224840 - DNA, 538 bp, Homo sapiens
  misc_feature: GYAE6OF01CHC33.49.33.C11.1.454.CMB.1.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangtcaccctctcctgcagggccagtcagagtgttaggagcaacttgcctggtatcagcagaaacctggccaggctcccaggctccnatctatggtgcatcccaccgagggcccacgtggtactccccgagcctaggttcaggtcggcaggtgggtctggggacaggtagttcactctacacatcagcagcctgctagtcagtagtntttgctagttttatacttgtacagtntagtatacgtcggtccgggtctccggactacgttcgggcgggtacggaccgaagggtggacgtaatacgaaacggtactggtacggctacgacacctgtcgtcg

SEQ ID NO: 224841 - DNA, 575 bp, Homo sapiens
  misc_feature: GYAE6OF01AXFDY.49.33.C11.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (422)..(422): a, c, t, g, unknown or other
  misc_feature (422)..(422): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgtaggncaacttagcctggtatcagcagaaacctggccaggcctcccgaggcctcctcatctatggtgccactcccgaccgagggcccacgtcggtactcccgagccctaggttcaggtggcaggtgggtcgtgggacagtacgttcacgtctacacatcagcacgcctgcgtagtcgtagtaagttntttgacttagtttatctgtacagtactagttaatagtcggtccggtctaccggacttacggttcgggacgggtaacggacggtaagggtacggacgtaacgtaaccggtaaacggtacgtgggtacgtcgtacgacccactagttccgttacg

SEQ ID NO: 224842 - DNA, 683 bp, Homo sapiens
  misc_feature: GYAE6OF01CYJ25.49.33.C11.1.454.CMB.1.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctcagccaccctgtctgtgtctccgaggggaaangtcaccctctcctgcagggccagtcagagtgttaggacncaacttgcctggtatcagcagaaacctggaccaggcctacccgaggtcctcctcattcctagtggtcgtacactccgacgacgggcctaacgtcggtacctcccgagtccgtacggttcaggtggacaggttcgggtctagggactaggtcgttacacttcgtacactacgtacacgcacgtcctacgctagttcgtaagtaagttcttttcggactttaagtttacgttacgtcgttacgacgttacgtaagtttaacgttaacggttccgggtacccgggtcgttaacccgggtactttaccgggtttaccggggacgggtaacggggtaaaccggttagggtaccggtaacggttaacgtaaaccggtaaaacccgggttcgttaagggtccgggtacgtaacccggtaccgtaaccgttacgttcgttttaacccgg

SEQ ID NO: 224843 - DNA, 639 bp, Homo sapiens
  misc_feature: GYAE6OF01C43Z2.49.33.C11.1.454.CMB.1.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (315)..(315): a, c, t, g, unknown or other
  misc_feature (315)..(315): n is a, c, g, or t
tcagagtcgagagacacgaccggtgctcgatttagagtgagctcggttggggtttgggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaanagtccaccctctcctgcagggccagtcagagtgttaggancaacttagcctaggtatcgagcaagaaacctggccaggcctccgaggcctcctcaatctagtcggtcnctactaccgaccgagggccctaacgtggtacctcccgagccgtaggtttcaaggttcggacgtagggttcgggtcgtaggggactaggtacgtttccaacgttcctacaactatcgacgcacgtcctgactagtcgtagtaaagttcgttttgacgttaagttttacttacgttcgtacgacgtacgtaagttaagttacggtcgggttcccggtactacccggtacgttacgggttcgggacgggtaacggaaccggtaagggtcggaacgtaacgtaacgaaacggtagtgggtacgtctacgacctacctagttcgttacg

SEQ ID NO: 224844 - DNA, 582 bp, Homo sapiens
  misc_feature: GYAE6OF01CLWIE.49.33.C11.1.454.CMB.1.raw
  modified_base (328)..(328): a, c, t, g, unknown or other
  misc_feature (328)..(328): n is a, c, g, or t
  modified_base (452)..(452): a, c, t, g, unknown or other
  misc_feature (452)..(452): n is a, c, g, or t
tcagagtcgagagacacgaccggtgctcgatttagagtgagctcgttgggtttggggggaagaggaagactgacggtcccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatcgtgggggagtcgtggtagagccgtggggggtccctgagactctcctgtgcagcctctggattcatcttgatgattatgccatgcacgtggatccgtnaagcgtaccggggaggtctggagtggtctcttcttattaagttggatgggtgtatctactactatgcagactctgtggaagggtctattcaacctattcctccgaagacaacaacacgacgaanaaacctcccgtagtactctaggacaaagtcgaaactgttaccacgaagggtaggtcgaacggaccctacccgttcctttacctaaccttcgttacgtacgaaactaaagtactttaacgggcgtaaaccc

SEQ ID NO: 224845 - DNA, 594 bp, Homo sapiens
  misc_feature: GYAE6OF01BP3TZ.49.33.C11.1.454.CMB.1.raw
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
  modified_base (332)..(332): a, c, t, g, unknown or other
  misc_feature (332)..(332): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccatggagaaatagtgatgacgcagtctccagcccaccctgtctgtgtctccgaggggaaangtccaccctctcctgcgagggccagtcagtagtgtaggagcaacttgcctggtatcagcagaaacctggaccaggctcccgaggcctcctcatctagtggtncactcccacgacggccacgtggtacnccagcctaggtcaggtgacgaggtggtcgtagggacaggtacgttcacgtctaccaacctagtccagcacgcctagactagtactagtaagttagtttcgacgttagttttaactcgttgtacgagtactaagttattaacgtcgggttaccgggtccgttacggaccgttacggttccgggacgggtaacggtaccgaagggtacggaagtacgaacgtaaacggtacgtaggtacgtactacgaccacctagtcgttacg

SEQ ID NO: 224846 - DNA, 173 bp, Homo sapiens; identical to SEQ ID NO: 224684
  misc_feature: GYAE6OF01BE0M3.49.33.C11.1.454.CMB.1.raw
  modified_base (173)..(173): a, c, t, g, unknown or other
  misc_feature (173)..(173): n is a, c, g, or t

SEQ ID NO: 224847 - DNA, 652 bp, Homo sapiens
  misc_feature: GYAE6OF01BDBNQ.49.33.C11.1.454.CMB.1.raw
  modified_base (205)..(205): a, c, t, g, unknown or other
  misc_feature (205)..(205): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangtccaccctctcctgcagggccagtcagagtgttaggagcaacttgcctggtatcagcagaaacctggaccaggcctccaggcctcctcatctatggtgcatccaccgagggcccacgtggtactcccgagccctaggttcaggtggcaggtcgggtcgtgggacagtacgttcactctcacctatcagtcacgccgtcgctacgtactaggtaaacgttagtttttacgacgttaagtttttaacgttacttcgttacgtaacgtactaagttaattaacggttccggtacccggggtccgttacccgggtacgttaccggttttccggggacgggtaaccgggtaaccgggtaacgggtacgggtaacgtaacgtaacggtaaaaaccggtaacgttacgggtacgggtaccgtacggtaccgaacccgttaagttccgttacgg

SEQ ID NO: 224848 - DNA, 175 bp, Homo sapiens; identical to SEQ ID NO: 224707
  misc_feature: GYAE6OF01AQ96M.49.33.C11.1.454.CMB.1.raw
  modified_base (173)..(175): a, c, t, g, unknown or other
  misc_feature (173)..(175): n is a, c, g, or t

SEQ ID NO: 224849 - DNA, 1024 bp, Homo sapiens
  misc_feature: GYAE6OF01B6DFQ.49.33.C11.1.454.CMB.1.raw
tcagagtcgagagacacgaccggtgctcgatttagagtgagctcgttggggtttgggggagggaactggctcccacgttagggtaccccaggacggtaaccatggtaaggccccagcgcagcttctcttacctcctgactactctggctcccgagtagtaccactggacgtaaagtttacgttgtaatgtaacgttacgagttcctaccgaggccgaacccgttggtcctggtcgttcgtccggaagggggtaaaacgtggggtcctacccttcgtccctaggccggacgggggtccctaggtaccaacggtacgttcggttagggacgaccgtaaacgttcggtccgttagggtacttaccgaacggtactaaacggtaaaacccgttcgggacccgaacgggttccctaccccggaacggggtccccttaccccgggtacctaaccgtttaccggttaacggttccggggtaacgggaacccgtaaccgttaccccgggtaaacccggtaacggggtaccccttaaccggtttaacgggttaaacccgttaccccggtaaaacggtaacccggttaaacggggtttccgaaacgggttaacgggtaacccgttaaggggtttacggggtttacgttacgggggaaacctaacggttaaaccgtttcccgtaaacgtttccggaaccgtaacctaagttacccgaacgtacccgtacgtccccgttacgggaccgttaaacgtttaccgtaacggtaaaacgttaccgtttttacggaccgttttaaacgtttttaacttaacccggttaaggtaaccgtaacggtaaccgttaaacgttaacgttaaacggtccgggttacccgggtaccgttaccgggtaacgttaccggtttaccggggacgggttaaacgggaaacccgttaaggggttacggtaacggtaacggtaaccgtaaaaacggggtcttagggtaacggttacggtaacggttacccgaacggttacggtccgttaaccggg

SEQ ID NO: 224850 - DNA, 177 bp, Homo sapiens
  misc_feature: GYAE6OF01CPGXI.49.33.C11.1.454.CMB.1.raw
  modified_base (173)..(177): a, c, t, g, unknown or other
  misc_feature (173)..(177): n is a, c, g, or t
tcagagtcgagagacacgaccggtgctcgatttagagtgagctcgttgggtttgggggaagaggaagactgaccggtcccccaggagttcaggtgctgggcacagcggccctgggctgcctggtcaaggctacttcctctctcgactctgagcgggctggcaaggcgcatagnnnnn

SEQ ID NO: 224851 - DNA, 173 bp, Homo sapiens; identical to SEQ ID NO: 224684
  misc_feature: GYAE6OF01DEMRO.49.33.C11.1.454.CMB.1.raw
  modified_base (173)..(173): a, c, t, g, unknown or other
  misc_feature (173)..(173): n is a, c, g, or t

SEQ ID NO: 224852 - DNA, 799 bp, Homo sapiens
  misc_feature: GYAE6OF01CLSD0.49.33.C11.1.454.CMB.1.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
tcagagtcgagagacacgaccggtgctcgatttagagtgagctcgttggggtttgggggaggaactgctcagttaggacccagacggaaccatggaacgccccagcgcagcttctccttcctcctgctactctggcctccagactaccacgtggaagaaatagtgatggacgcagtctccacgcccacccgtgtctgtacgtcctaccggaaggggaancgtccaccctctccgngcgacgggccagtcgagtagtggtacgganacctaacgttgccgttaggtactcagacaacggaaccgtcggaccgaggtccctaccgacggtcctccgtactactctagtcgaactcgactacctaacccgaacggacgggaccctacggtccggacctaaccgtcccgaccgtacccggttagggtaccgagggttaccggaggtacgggttcgggtactaggtacgacgtaccggtactttacccacgtttaccctacctaccgtactacgaacgtccggtaacgtacccggtaacggaccgttacgtaaacggtacggttactttaccggtactaaccgtttttatttaaccgttacgttacgggtaccaacgggttcgtaaacccggttccgtaacggtaccccgttaacccggtccgttaccccgttacgtccccgggttaaaccgggggttacgggaaacccggggggtaacgggtaaaccggggtaagggtaacgggtaccggttaaaacgtaccgggaaacggttacggttcggggacacccgtaggtaaccccg

SEQ ID NO: 224853 - DNA, 636 bp, Homo sapiens
  misc_feature: GYAE6OF01C7O8I.49.33.C11.1.454.CMB.1.raw
  modified_base (207)..(207): a, c, t, g, unknown or other
  misc_feature (207)..(207): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagcccacctgtctgtgtcctccgaggggaaagngtcaccctctcctgcagggccagtcagagtgttaggagcaacttgcctggtatcagcagaaacctggccaggctccgaggcctcctnatctagtggtncatcccacgagggcctacgtggtactccccagccgtaggttcaggtcggctaggtcgggtcgtgggacaggtacgtttcacttcctacaccatcagcacgcctgactagtctagagttatttcgacgttagtttacttactgtactagtactaagttaataacgttcggtacccgggtaccgttccgggtaacccgttaccggtttaccgggggaccgggtaacggggtacccggtaaaggggtacgggtaaacgtaaacgttaccggaaaaaccggtacgttacgggttacggtaccgttacggaccctaacccgtgttccggttaccgg

SEQ ID NO: 224854 - DNA, 756 bp, Homo sapiens
  misc_feature: GYAE6OF01DNHTB.49.33.C11.1.454.CMB.1.raw
  modified_base (205)..(205): a, c, t, g, unknown or other
  misc_feature (205)..(205): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctccagataccactggagaaatagtgatgacgcagtctccagccaccctgtctgtgtctccgagggggaaangtccaccctctcctgcagggccagtcagagtgttaggagcaacttagcctggtatcagcaagaacctggaccaggctccccgaggcctcctctattccgtagtcgggtcacctaacgtcccgaaccggacggggacccctacggttacgggtacctaccccgaaggcccgttaaggggtttcccgaagggttcggggaccgtaaggggttcggggttacgtacgggggaacctaggtacggtttccaacgttccgtaccaaccgtatccgaacgccgtaacgtccccgttaggacctaaggttaccgtagtaaacggtttacttttcggaactttaaggtttttacttaacgttcggtaacccaaacgtacggtaacccgttaacctaacggtaagggttacctttaccggttaacccggttttcccgggacccgttacggggtaaccctagggtacggttacggtaacgtttaaacgaacccgaaaacggttaccgtagggtacggtaccgttcggaaccctaccgttaacgttcccgtttcgttacccg

SEQ ID NO: 224855 - DNA, 731 bp, Homo sapiens
  misc_feature: GYAE6OF01BR3LR.49.33.C11.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaancgtccaccctctcctgcgagggccagtcagagtgtagngcaacttgcctggtatcagcagaaaccgtggccaggcctccgaggtcctcctcattccgtagtcggtnaccgactacccgaaccgtacgggcccctaacggtcgggtaacctccccgaggtacccgtagggttaccgagggtcggtacgacgggttcggggtccgttaggggaacctaaggtaccgttttccgaaccgttcctccaaccctagtccgacgccgaacgtccgttagcttaacggtcgttaggtaaagttacgttttacggacgtttaacgtttttacgtactacgttcgaagtccttaaaggttaacgttaacggttcgggttaccccgggtcccttacccggggttaaccgttacccggtttccggggaaaccggggtaccgggtaaacccggtaaagggttcggaacggttaacgttaaacccggaaaacggtacgttcgggtaccggacttaggacccttaaccgtgtcccgttacg

SEQ ID NO: 224856 - DNA, 749 bp, Homo sapiens
  misc_feature: GYAE6OF01B9HKG.49.33.C11.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
tcagagtcgagagacacgaccggtgctcgatttagagtgagctcggttgggtttgggggaggaactgctcagttaggacccagacggaaccatggaagccccagcgcagcttctcttcctcctgctactctggctccagataccactggaagaaatagtgatgacgcagtctccagcccaccctgtctgtcgtcgtaccggaaggggaaancgtccaccctctccngcgaggccagtcagagtgtaggacgtactaacgttcgccgtaggtactcgaacgacgaacgaaaccgtcggacccgacgggtccctacccgacggtccttaccctactaacgttcctaggttggtaccaccaccttacccgaaccggtacgggaccctaaccggttacggtacctaccccgacggcccgttaaggttaccgaagggttcggacgtacgggtcgggtacggtacggggaactagggtacgttacgaaccttcctaccgaacctactccgacgacgtaccggaccctggaacctacggttaccgtaagtaacgtttgtttacgtactttaagttttactacgtgtacagttataacgttaagtacggttccggtaccggtccgtaccggttacgtaccgggttcgggaacggtaaccgggaacggtaagggacggtaacgtaacgtaaaccggtaaaacggttacggtcggtacggtcccgtacgtaacccgtacgttaccgttccgtttaaccg

SEQ ID NO: 224857 - DNA, 749 bp, Homo sapiens
  misc_feature: GYAE6OF01A0BRN.49.33.C11.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagtaaatagtgatgacgcagtctccgagccacctgtctgtgtctccgaggggaaangtccacctctcctgcagggccagtcagagtgtaggngctaagttgccttggtactcgagcaagtaaccgtggaccaggcctccgaggtcctcctacagttaccttagtcgggtacgcctaacgttccccgaaccggtacggggtccctacggttacggggtaacctcccccggaaggtccccgttaaggggttccaagggttcgggccttaagggggttcggggttcgtaacgggggaacctaagggttacgtttaccgaactttaccggtacccaacccgtaagttaccgaacggtaccctaacggtcccgttacgggtacctaacggttaccggtaaggtaacggtttacgtttacggtaccgtttaagttttaacgttacgttacgttacgtaacgtaccgtaagttaacgtaacggttcgggtaccggtaccgttaccggtaacgttaccggttcgggacgggtacggtaccgtaagggtcggaacgtacgtaacgtaaacggtacgtaggacggtcttacggactaccgtagttcgtacg

SEQ ID NO: 224858 - DNA, 522 bp, Homo sapiens
  misc_feature: GYAE6OF01BZWF7.49.33.C11.1.454.CMB.1.raw
  modified_base (243)..(243): a, c, t, g, unknown or other
  misc_feature (243)..(243): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagagtcaccctctcctgcagggccagtcagagtgttaggngcaacttagcctggtatcagcagaaacctggccaggcctccaggctcctcatctatggtgcatccaccgagggcccacgtggtactccccagccctaggttcaggtggcgagtgggtctgggacnggagttcactcncaccatcagcagcctgcagtctgaagtnttttgctagtttatactgtcagtctagtaatagtgtccggtctccggactacgttcggcgggaggaccgagggtggagatacgaaacgtatggtggctagacacctatcgtacg

SEQ ID NO: 224859 - DNA, 237 bp, Homo sapiens
  misc_feature: GYAE6OF01AI1ZV.49.33.C11.1.454.CMB.1.raw
  modified_base (180)..(237): a, c, t, g, unknown or other
  misc_feature (180)..(237): n is a, c, g, or t
tcagagtcgagagacacgaccggtgctcgatttagagtgagctcgttggggtttggggggaagaggaacgactgacggtccccccaggagttcaggtgctgggcacgacgcggccctgggctgccgtggtcaaggctacttcctctctcgactctgagcgggctggcaaggcgcatagcnnnnnnnnnnnnnnnnnnnnnnnnnnnnnnnnnnnnnnnnnnnnnnnnnnnnnnnnnn

SEQ ID NO: 224860 - DNA, 711 bp, Homo sapiens
  misc_feature: GYAE6OF01A4SMZ.49.33.C11.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (292)..(292): a, c, t, g, unknown or other
  misc_feature (292)..(292): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaangtcaccctctcctgcagggccagtcagagtgtaggncaacttagcctggtancagcaagaacctggccaggcctcccgaggtccctcctnacttcgtagtggtcgacctacccgtaccgacgggaccctacgtcggttaacctccccgaaggtcccgtaacgggtttcaacggttcgggactaggggttggggttccggtacggggtaaccaaggttacggttcaacctcgtacccacctaactccgtaacgcctaacggccgtacggtaccgtacggttacgtacggtaagttaagtttttcgtacgtttaacgttttacgtttacgtcgtttacgagtacgttacgttaattaacgtcggttacccgggtaccgtaccggttaaccgttaccgggttttacgggaccgggtaacggggtaaccggtaacgggtacggggaaacgtacgtaacggaaacggtaacgtcgggtaggtaccgtcgtacaccgtacgttcgtcggtttacc

SEQ ID NO: 224861 - DNA, 555 bp, Homo sapiens
  misc_feature: GYAE6OF01DUSH5.49.33.C11.1.454.CMB.1.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagtccaccctctcctgcagggccagtcagagtgttaggagcaacttgcctggtatcagcaagaaacctggccaggctcccaggctcctnatctatggtncatccacgagggccagtggtactcccagccaggttcagtggcaggtgggtctgggacagagttcactctcacctatcagcagcctgcagtctagaagtattttgacttagtttattactgtcagtctaagttataagtcggtccggtcttaccggactacgtttcgggaccgggtagggaccgaagggtcggaacgtaagtaccgaaacggtaacgtggtacgggtactacgacctaaccgtgtccgttacg

SEQ ID NO: 224862 - DNA, 758 bp, Homo sapiens
  misc_feature: GYAE6OF01EH0HB.49.33.C11.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagaaatagtgatgacgcagtctccagcccaccctgtctgtgtctccgaaggggaanagtccaccctctcctgcagggccagtcagngtgtagancaatgctgtatcagacagtaaacctggaccaggccctaccgaggtcctaccctnacttcgtaagttcgggtanccctaactccccgaaccggacggtacccaacggttacggttaaccctccccgaacgtcccgtaagggtttccgacgggttcggaccggtagggttcggggttaccggtaaggggacgtaacggtaccgtttaccaaccgttcctaaccgaacctacgtacctaacgcctaccgtcctacggtacgtacgtacgtaggtaagtttacgttttacgtacgtttagttttaacttacgttagtacgtaagacgttaagttaacgtaccggttccgggttacccgggttaccgttacccggtacggttaccgggtttaccggggaaccgggtaaccggggtaaaccggtaaaggggttacggtaaaccggttaaacgtaaccgtaaaaccgggtacgttacgggtacgggtaccgtaccgaaccctaacgttcgtacgtttacccgg

SEQ ID NO: 224863 - DNA, 626 bp, Homo sapiens
  misc_feature: GYAE6OF01C6XA0.49.33.C11.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctctcctgcagggccagtcagagtgttaggagcaacttgcctggtatcagcagaacctggccaggctccaggcctcctnatctatggtgcactcccacgagggcccacgtggtactcccgagcccgtaggttcaggtcggcaggtcgggtctggggactaggacgtttcacgttctacaacctatcaacgcacgtccgtacgcgtacgtctagtaagttattttgacttagttttacttacgttgtacagtactaagttataacgttcggtaccgggtcctaccggtacgtaccggtttacgggaccgggtaacggggaacccgtaaggggtacgggtaacggtaacgtaaccggaaaacggtaaccggttaggtacgggtacgttacgacccgtaaccgtacgttccgttacgg

SEQ ID NO: 224864 - DNA, 727 bp, Homo sapiens
  misc_feature: GYAE6OF01C7R6O.49.33.C11.1.454.CMB.1.raw
  modified_base (209)..(209): a, c, t, g, unknown or other
  misc_feature (209)..(209): n is a, c, g, or t
tcagagtcgagagacacgaccggtgctcgatttagagtgagctcgttgggttgggggaggaactgctcagttaggacccagacggaccatggaagccccagcgcagcttctcttcctcctgctactctggcctcccagtactaccacgtggagaaatggtcgatgacgcagtctccagcccaccctgtctgtgtctccgaaggggaaancgtccacccgtctccgtgccgacgggccagtcagtagtgtaggacgcaacgttgcctaggtactcgagacaagaaaccgtggaccgaacggtcctaccccgaggtccctccgtactacgttcgtagtcgggtcgcctaactcccgaacgacgggacctacgtacggtacctcccgacggtccgtaaggttcgtaacggtcggtcgtaagggttcggggtacgtacggggaactacgggtacgtttaccaaccgttccgtaccaacctacgtaccgacgtacctacggtcctaggaccgtagttacgtaaaggtaactttagttttacgaccgttttaaagtttacttaccgttgtaaccgagttacgtaagtttaccgttaaggttccgggtacccggtaccgttaccggaacctttcggttaccggggaccggaacgggtaccgtaggggtcgtaaacggtacgtaacgtaaaacgtacgttcggacggtacctacgacctaaccgtgttccgtacg

SEQ ID NO: 224865 - DNA, 536 bp, Homo sapiens
  misc_feature: GYAE6OF01AQIUB.49.33.C11.1.454.CMB.1.raw
  modified_base (203)..(203): a, c, t, g, unknown or other
  misc_feature (203)..(203): n is a, c, g, or t
  modified_base (530)..(530): a, c, t, g, unknown or other
  misc_feature (530)..(530): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagccaccctgtctgtgtctcaggggaaanagtcaccctctcctgcagggccagtcagagtgttaggagcaacttagccttggtatcagcagaacctggccaggctcccaggcctcctcatctatggtgcatccaccgagggcccaactggtactcccgagccaggttcaggtcggcaggtgggtctgggacaggagttcactctcaccatcagcacgctgcagtctagtagtatttgctagtttacttactgtcagtcagtatagtcggtccggtctccggtactaccgttcgggcggtacgggaccgtaagggtggacgagtacgaaacgtacgtggtaggtcctaggaccactntcgtcg

SEQ ID NO: 224866 - DNA, 579 bp, Homo sapiens
  misc_feature: GYAE6OF01CYRB0.49.33.C11.1.454.CMB.1.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (452)..(452): a, c, t, g, unknown or other
  misc_feature (452)..(452): n is a, c, g, or t
  modified_base (570)..(570): a, c, t, g, unknown or other
  misc_feature (570)..(570): n is a, c, g, or t
tcagagtcgagagacacgaccggtgctcgatttagagtgagctcgtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacttgcctggtatcagcagaaacctggccaggctccaggctcctcatctatggtncactccaccgacgggccctactcggtactccccgagccgtaggtttccaaggtcggctaggttcgggtcgtggggaactaggacgtttcactctcaccatcgacgcagcctgcagtctagtagttatttgacttagtttattacttgtcagntaagtaattaagtcggtccgggtccttccggtacgtccggtttcgggcgggtacggaccggtaagggtggtaacgacttaacgaaacggtacgttggtacggtcgtacgaccaccgtnttccgttcg

SEQ ID NO: 224867 - DNA, 173 bp, Homo sapiens
  misc_feature: GYAE6OF01AU993.49.33.C11.1.454.CMB.1.raw
  modified_base (168)..(173): a, c, t, g, unknown or other
  misc_feature (168)..(173): n is a, c, g, or t
tcagagtcgagagacacgaccggtgctcgatttagagtgagctcgttgggtttgggggaagaggaagactgacggtcccccaggagttcaggtgctggcacagcggcctggctgcctggtaagactacttcctctctcgactctgagcgggctggcaaggcgcatagnnnnnn

SEQ ID NO: 224868 - DNA, 742 bp, Homo sapiens
  misc_feature: GYAE6OF01CQ0YZ.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgtccaccctctccgtgcagggccagtcagagtgttaggagctaacttgccgtggtatcagccaagaaaccgtggccaggcctcccgaggtcctccctcgattcgtaagtggtcgacctaccgtcccaaccgacgggtcccctaacggttcgggtaacctacccccgaggtacccgtagggtttacaggttcgggcgtaagggttcgggtcgtaggggaactaaggtcgtttaccaccgttccgtaccacctatccgacgccgtacgtcctcggacgtacgttcgtaagtaacgtttagtttacgtactttacgttttaactttacgttacgtacgtaagtacgttaagttaacgttaacggtccgggttacccgggtaccgttacccggttaaccgttaccgggtttaccggggaccggggtaaccggggaaccggttaaggggtaacggtaacggtaaccgtaaaccggtaaaaccggtacggttacgggtaccggttaccgtacgacccgtaacccgttacgttccgtttaccgg

SEQ ID NO: 224869 - DNA, 760 bp, Homo sapiens
  misc_feature: GYAE6OF01CZOS9.49.33.C11.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (415)..(415): a, c, t, g, unknown or other
  misc_feature (415)..(415): n is a, c, g, or t
tcagagtcgagagacacgaccggtgctcgatttagagtgagctcgttggggtttgggggaggaactgctcagttaggcccagacggaaccatggaagccccagcgcagcttctcttcctcctgctactctggctcccagataccactggagaaatagtgatgacgcagtctccagcccaccctgtctgtgtctccgaggggaaagngtccaccctctcctgcagggccagtcagagtgttaggancaacttgcctggtatcagcaagaaaccgtggccacggctccgagctcctcatctatgncactccacgnggcctacgtaggtactccccgagccctaaggttcgaggtcggacgaggttcggggtacgtggggaacctaggtacgtttccaaccgttacctaccaaccctnttaccgacgaccaacggtccctggtacctacggttactaggtaacgtttagtttttacggaccgttttaaggttttactttaccgttacggtttaccgaaggttaccgttaaagggtttaacttaaacggtttccggggttacccggggtaccgtttacccccggggttaaccgtttaccggggttttcccggggaacgggggttaaacccggggtaaccggtaaaacggggggttacgggtaacggttaaaccgggtaaacccggtaaaaaccgggtaaccggttacgggttacgggtaccccttacggaaccccgttaacccttacggtttacccgttaccgg

SEQ ID NO: 224870 - DNA, 726 bp, Homo sapiens
  misc_feature: GYAE6OF01DEB1M.49.33.C11.1.454.CMB.1.raw
  modified_base (208)..(208): a, c, t, g, unknown or other
  misc_feature (208)..(208): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggaagaaatagtgatgacgcagtctccagcccaccctgtctgtcgtctccgaaggggaaancgtccaccctctcctgcgagggccagtcagtagtgtaggacgacaacgttgcctaggtatcgaagacaagaaaccgtcggaccgacggcctacccgaggccttcctntacgtctagtcgggtcacnctacccgaccgtacgggacctaacggttcggtacctacccgacgtaccgtaggttacgaggtcgggtacgaggggttcgggtacggtacgggactaggtacgttaccacgtcctacgacctaatcgaacgcgacgtccgtagtctacgtacgttaagtagtttacgtttcgtactttaaacggttttacttacgttacgtagtaacgtacgttaaagttaacgtacggttccgggtcccgggttaccgttacccggtacgttacggggttccggggaaacggtacgggtaaccggtaaggggtaacggaacgttaaaccggtaaaccgtaaaccgggttaacgggttcggaccgggtctaaaccggccctaacggttattcccggtttaccg

SEQ ID NO: 224871 - DNA, 750 bp, Homo sapiens
  misc_feature: GYAE6OF01CLQAS.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctctcctgcgaggccagtcagagtgtaggagcaacgttgcctaggtaaccaacgaagaaacccgtggacccagggccctcccgaggcctcctcatccttaatggatcggactaactacccgaaacgtacggggccctacgtcgggacctactacccccgagtccgtaagggtttccacgggtcgggtcctaaggggttcgggtctaggtcgaacacggtacctttcgaaccttctacccgaacctagtccgacgaccgaacgtaccctaaggaccgtacccgttaaaggtaaacgttacgtttcgtacgggtaacctttaaggtttttaaccttaacgttggtacgaacggtcgtaaacgggtcccggttaacgtacccgttaaaccgtccgggtacccttcgttaacccggttaccgggtttaccggggaaccggggttaaacgggaacccggtaaaggggttacgggaaacggttaaaccgttaaaccggaaaaccggttaacggtggtacggtacctacggccctaacgttaaccg

SEQ ID NO: 224872 - DNA, 556 bp, Homo sapiens
  misc_feature: GYAE6OF01EBW84.49.33.C11.1.454.CMB.1.raw
  modified_base (301)..(301): a, c, t, g, unknown or other
  misc_feature (301)..(301): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccatgggaaagagtcaccctctcctgcagggccagtcagagtgtaggagcaacttagcctggtatcagcagaaacctgggccaggctcccaggctcctcatctatggtncatcccacagggccactggtatcccagccaggttcagtggcaggtgggtcngggacagnttcactctcacntcagcagcctgacgagtctagaacgttagttttgctagttttattacttgtcagtctagtaagtaagtcggtccgggtccgtccggtactaccggtttcgggacgggtacgggaaccgaagggttgggaagagtaacgaaaaccggtaacgttggtacgggtactaggacctaccgtagttccg

SEQ ID NO: 224873 - DNA, 764 bp, Homo sapiens
  misc_feature: GYAE6OF01CSLCU.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctctcctgcagggccagtcagagtgttaggagcaacgttagcctggtatcagcaagaaacctggccaggctacccgaggcctcctcatctagtggtagcactccgaccgacgggaccctacgttacggtactaccccgacggtccgtaacggttcaggttcggacggtaggtcggggttacgtaggggaaccgtaaggtacgtttaccgacgtttaccctaccgtaacctacgtaccgaaccggtaccgtaccggtcccgttacggtacccgttaacgggtttaccgttaaagggttaaacggttttacttttttacgggacgttttaaacgtttttaacgtttaccgttacgtaaccgtaaacgtaccggtaacccgttaacccgaacggttacggtaccttttaccgttaccggtttacccgggacccggtttacgggaaccgtaggtaacggtttaggaaactttaaacggtaaccgtaaaaccggtaacgttcgggtaccggttacgtaccggtaacctaccgttaaagttcccgtttacggtttaccc

SEQ ID NO: 224874 - DNA, 736 bp, Homo sapiens
  misc_feature: GYAE6OF01BPKEA.49.33.C11.1.454.CMB.1.raw
  modified_base (180)..(180): a, c, t, g, unknown or other
  misc_feature (180)..(180): n is a, c, g, or t
  modified_base (216)..(216): a, c, t, g, unknown or other
  misc_feature (216)..(216): n is a, c, g, or t
  modified_base (418)..(418): a, c, t, g, unknown or other
  misc_feature (418)..(418): n is a, c, g, or t
tcagagtcgagagacacgaccggtgctcgatttagagtgagctcgttgggtttgggggaggaactgctcagttaggacccagacggaaccatggaacgccccagcgcagccttctcttcctcctgctactctggcctcccgagactaccacgtggaagtaaatgtgatcgacgcagtccnccacgcccaccgtgtctgtcgtcgacggaagggaancgtccacccgtctccgtgcgacggccagtcgagtagtggtagacgtactaacgttcgcgtaggtacacgacgacgtaacgaaccgtcggaccgtacggtcccttacgacggtcctacctactactcgtacgtcggcacctacacccgaaccggacggtaccctacggttacggtaccctaccgacggtccggttaggtacgngggtacggcggtaggtcgggtacggtaacggacgtacgtcgtaccacctccgtacacctcgtaccaggacctacggtcctaggactacggttgtaaacggttagtttacgtttcgtaagtttacgttttaacttacgtagtaacgtacgtaacgttaagtaacgtttacggacccgggttacccggtaccgttaccggttaaccggttacgggttcccggggaaacgggtaaccgggtaacgggtaaagggtcgtaaacgaacggtaaacgtaaacggtggtacggaccgcttaacgccgtaactccgtttcgtaccg

SEQ ID NO: 224875 - DNA, 643 bp, Homo sapiens
  misc_feature: GYAE6OF01C5D5A.49.33.C11.1.454.CMB.1.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (312)..(312): a, c, t, g, unknown or other
  misc_feature (312)..(312): n is a, c, g, or t
  modified_base (404)..(404): a, c, t, g, unknown or other
  misc_feature (404)..(404): n is a, c, g, or t
  modified_base (633)..(633): a, c, t, g, unknown or other
  misc_feature (633)..(633): n is a, c, g, or t
tcagagtcgagagacacgaccggtgctcgatttagagtgagctcggttgggtttgggggaggaactgctcagttaggacccagacggaaccatggaagccccagcgcagcttctcttcctcctgctactctggctccagataccactggagaaatagtgatgacgcagtctccagccacctgtctgtgtcnccgaggggaaangtcaccctctcctgcagggccagtcagagtgttagganacaactagcctggtatcgaagcaagaaacctggcaaggcctaccgaggcctcctcaattctaagtcggtanccatccgaaccgagggcctacgtggtactcccagtccgtaaggttcaggtggacaggtgggttcagggacagtagttccacgttcacgactntacgacgccaagtccttgactaggttactaaggtaacttagttttcggtacttaaggtttttaactacggttatacctaggtactaaagtttagttaaacggttcgggtacccgggtccgttacccgggtaacttccgggtttacgggacggggttaaacggaccggaagggttggaaacggtacgtaacgaaacgggtaaccgtggtacggtactaacgccaaccgtnttccgttacg

SEQ ID NO: 224876 - DNA, 562 bp, Homo sapiens
  misc_feature: GYAE6OF01EM4OA.49.33.C11.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (420)..(420): a, c, t, g, unknown or other
  misc_feature (420)..(420): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagngtccaccctctcctgcagggccagtcagagtgttaggancaacttagccttggatcagcagaacctggccaggctcccaggctcctcatctatggtgcactccaccgagggcccacgtggtactcccgagccaggttcaggtggctaggtgggtcgtggggacaggtacgtttcactcgtaccacctatcagcacgcctgcagtctagtaagtntttgcttagtttattctgtcagtctagttatagtcggtcccggcgtccggtacgtcgttcgggacggtacgggaccgtaagggtcggtagtacgtacgaaacggaacgtggtacggtctacggaccaccgtagtcgttaccg

SEQ ID NO: 224877 - DNA, 757 bp, Homo sapiens
  misc_feature: GYAE6OF01CW7A8.49.33.C11.1.454.CMB.1.raw
  modified_base (205)..(205): a, c, t, g, unknown or other
  misc_feature (205)..(205): n is a, c, g, or t
  modified_base (744)..(744): a, c, t, g, unknown or other
  misc_feature (744)..(744): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctccagataccactggagaaatagtgatgacgcagtctccagcctaccctgtctgtgtctccgaggggaaancgtccaccctctcctgcaggccagtcagagtgtaggagactaacgttagcctaggtatcgagacgaacgaaaccgtggaccacggcctaccgacggtcctcctcagtctatgtatgctactaccgaacgacggtccacgtcggacctacgtccgaacgtccgtaaggtacgaggtcggacgtaggttcgggtctaggtacgaacctacggtacctttaccgaccttaccgtaccgtaacctacgttaccgaacgtacccgaaaccggttacccgttaaacgggaacccgttacccggtaagttaaacgtttaccgtttaccggttacggttaaccttttaacgggtttttaacttacccggttacggttacccgtaacggtacgttaccggtaaccgggttaaccgtaccgttaacccggttcgggtaccccctttacggttacccgtaccgggttttaccggggaaccggggtaaaccgggtaccgtaaaggggtcggtaacgtaaccgtaacggtaaaaccggtgtacgggtaccgngtacccgtaaccg

SEQ ID NO: 224878 - DNA, 570 bp, Homo sapiens
  misc_feature: GYAE6OF01AM7U7.49.33.C11.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctctcctgcagggccagtcagagtgttaggancaacttagcctggtatcagcagaacctggccaggctcccaggcctcctcatctatggtgcactccaccgagggcccagtcggtactccgagcctaggttcagtcggcaggtcggtctgggacaggtacgttcactctcactatcagcagtcctgctacgtctagtaagtactttgacttagttttactacgtcgtacacgtactaagttaactagtcgtccgggtcttaccggaccgttacgttcgggacggtagggaccgtaagggtacggacgtaagtacgaaacgtacgtggtacggtccttacgacctacgtacgttcgtacg

SEQ ID NO: 224879 - DNA, 569 bp, Homo sapiens
  misc_feature: GYAE6OF01CB58H.49.33.C11.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngtcaccctctcctgcagggccagtcagagtgttaggagcaacttgcctggtatcagcagaaacctggccaggcctccaggctcctnatctatggtgcactccaccgagggcccacgtcggtactcccagccaggttcaggtcggcaggtgggtctgggactaggtacgttcactctacacctatcagcacgcctgctagtctagtaagtatttgtactagtttattactgtactagtacgtagttaatacgtcggtccggtcgtaccggacgtacgtttcgggacgggtacgggaccgaagggtacggagtaagtaacgaaacgtacgtaggtacggtacgtacgacctaacctagtcgttacg

SEQ ID NO: 224880 - DNA, 174 bp, Homo sapiens
  misc_feature: GYAE6OF01B9SQF.49.33.C11.1.454.CMB.1.raw
  modified_base (173)..(174): a, c, t, g, unknown or other
  misc_feature (173)..(174): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctcgtagcactctgagcgggctggcaaggcgcatagnn

SEQ ID NO: 224881 - DNA, 792 bp, Homo sapiens
  misc_feature: GYAE6OF01EGOIF.49.33.C11.1.454.CMB.1.raw
  modified_base (167)..(167): a, c, t, g, unknown or other
  misc_feature (167)..(167): n is a, c, g, or t
  modified_base (208)..(208): a, c, t, g, unknown or other
  misc_feature (208)..(208): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggaagaaatagtgatgacncagtctccagcccaccctgtctgtgtctaccgaggggaaancgtccacccttctcctgcgacgggccaaggtcaggtagtggttaaggacgactaacgttcgccgttggtactacgagtacgaacgaaaccgtcggaccgaggtccacccgacggtcctcctactaactcgttaacgttggtcggactaccgtacccgaaccggaacgggtccctacggtacggttaacctacccgtaccggtacccggttaagggtccgtaacggggttcggacccgtagggttcgggtttcgggtacggggaaccgtaaggttacgggtttaccctaccgttacccgtaccgtaacccacgttaccgaaccggactaaccgggtcccgttacgtaccggtagttaccgtaaggtaacgttttacgtttacggacgttttagtttaacttccgtaggtacctagtcgttaaagttacgtaacgttccgggtcgtaccgttacccgggtaccttacgggttcccgggaacggtaagggttacccgaaaggggttaccgggaactaacgggttaaacctaaacgggtacgtttgggaccgtaccgtgaaccccgtacgttaccgtcgtttacccgg

SEQ ID NO: 224882 - DNA, 176 bp, Homo sapiens
  misc_feature: GYAE6OF01DGOUT.49.33.C11.1.454.CMB.1.raw
  modified_base (174)..(176): a, c, t, g, unknown or other
  misc_feature (174)..(176): n is a, c, g, or t
tcagagtcgagagacacgaccggtgctcgatttagagtgagctcgttgggtttgggggaagaggaagactgaccggtcccccaggagttcaggtgctgggcacagcggccctgggctgcctggtcaaggactacttcctctctcgactctgagcgggctggcaaggcgcatagnnn

SEQ ID NO: 224883 - DNA, 728 bp, Homo sapiens
  misc_feature: GYAE6OF01CD3ND.49.33.C11.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangtccaccctctcctgcagggccagtcagtagtgttaggngctaaacttgctggtatcgagacagaaaccgtggaccaggcctaccccgaggtcccttaccctctacttcctagtcgggtgaccactacccacgacgggcctacggtgtactcccgagccgtaggttcaggttggcgtaggtcgggtacgtaggggactaggtacgtttccacttacccgtacctaactacgtacgtacgacgtaccgtaccgtcgaaccgtttacgtacggttaaagttacggttttacgtttacgttaacgttttaagttttaacctacggttacgacgtaacggtaactttaagttaacggttacggttccggggtcccgggttaaccgttaccgggttaacccgttaccgggggttaacggggaaccgggtaaccgggtaacgggtacgggaaggttaaccgaaacgtaaaccggtaaacggttccggtaggtaccgtacgtacgtaaccctagtcgtttcggttacccg

SEQ ID NO: 224884 - DNA, 836 bp, Homo sapiens
  misc_feature: GYAE6OF01C7MNP.49.33.C11.1.454.CMB.1.raw
  modified_base (205)..(205): a, c, t, g, unknown or other
  misc_feature (205)..(205): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccacctgtctgtcgtctccgaagggaaancgtccaccctctccgtgcgacgggccagtcgaggtagttggttaggacgactaaacgttcgccgtaggtactcgacgaccgaacgtaaacccgtcggtacccgacggtccctaccccgagggtccccttcccgttacgtactttccgttaagttcgggttacgacctaaccgttaccccgaaccggacgggtacccctaacgttccggtaaccgttacccccgaacggtcccggtaacgggtttcaaggggttccggtacgggtacggggttcggggtttaccggtacgggggtaaccgtaacggggttaccggtttaccctaccccgtttaccgtacccgaacccttacgttaacccgaacggtacccgtaacccggtccgtacgggtaccctaagggttccgttaaggggtacgttttaacgttttcggaccgttttaaacggtttttacgttacgttacggtaccgtaagtacgttaacggttaaagttaccgttccggggtaccccggttaccgtaacccggttaccgttacgggttcggggaccggtaacgggaccggtaagggtcggtaatacgtaaacggaaacgtacgttggacgtcgtacgaccctaacgtctcggttaccg

SEQ ID NO: 224885 - DNA, 173 bp, Homo sapiens
  misc_feature: GYAE6OF01D9HFO.49.33.C11.1.454.CMB.1.raw
tcagagtcgagagacacgaccggtgctcgatttagagtgagctcgttgggtttggggggaagaggaagactgacggtcccccaggagttcaggtgctgggcacagcggccctgggctgcctggtcaaggactacttcctctctcgactctgagcgggctggcaaggcgcatag

SEQ ID NO: 224886 - DNA, 174 bp, Homo sapiens
  misc_feature: GYAE6OF01E2E7R.49.33.C11.1.454.CMB.1.raw
  modified_base (174)..(174): a, c, t, g, unknown or other
  misc_feature (174)..(174): n is a, c, g, or t
tcagagtcgagagacacgaccggtgctcgatttagagtgagctcgttgggtttgggggaagaggaagactgaccggtcccccaggagttcaggtgctgggcacagcggccctgggctgcctggtcaaggactacttcctctctcgactctgagcgggctggcaaggcgcatagn

SEQ ID NO: 224887 - DNA, 174 bp, Homo sapiens
  misc_feature: GYAE6OF01BDPV0.49.33.C11.1.454.CMB.1.raw
  modified_base (174)..(174): a, c, t, g, unknown or other
  misc_feature (174)..(174): n is a, c, g, or t
tcagagtcgagagacacgaccggtgctcgatttagagtgagctcgttgggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 224888 - DNA, 609 bp, Homo sapiens
  misc_feature: GYAE6OF01B6E7U.49.33.C11.1.454.CMB.1.raw
  modified_base (208)..(208): a, c, t, g, unknown or other
  misc_feature (208)..(208): n is a, c, g, or t
  modified_base (440)..(440): a, c, t, g, unknown or other
  misc_feature (440)..(440): n is a, c, g, or t
  modified_base (473)..(473): a, c, t, g, unknown or other
  misc_feature (473)..(473): n is a, c, g, or t
  modified_base (494)..(494): a, c, t, g, unknown or other
  misc_feature (494)..(494): n is a, c, g, or t
  modified_base (596)..(596): a, c, t, g, unknown or other
  misc_feature (596)..(596): n is a, c, g, or t
tcagagtcgagagacacgaccggtgctcgatttagagtgagctcgttgggtttgggggaggaactgctcagttaggacccagacggaaccatggaacgccccagcgcagcttctcttcctctgctactctggcctccagataccatggaagaaatagtgatgacgcagtctccagcctaccttgtctgtcgtcaccgaaggggaaacncgtccaccctctcctgacgtagggccaagtcgaggtagtaggttaggacgcaaacgtttgccgtaggtactcgagacgaacgaaaccgtggaccgacggcctaccgaggcctctcatcgtagtggacacactccgaacgcgggacctacgttacggacctaccgacgtccgtaacggttcgaggtcggtacgaggtcgggtcgagggactaggtactccgactcgacaaccntaccgacgcacgtccgtgactgtactagtagtntttgacttagtttactctgtnaacgtgtaagttaactcggtcggtccgacttccggagttaccggtcgggaggtacggaccgtagggacgacacgtaacgaaacgtgtgacggtactaccganctagtcgttaccg

SEQ ID NO: 224889 - DNA, 703 bp, Homo sapiens
  misc_feature: GYAE6OF01B9I5M.49.33.C11.1.454.CMB.1.raw
  modified_base (208)..(208): a, c, t, g, unknown or other
  misc_feature (208)..(208): n is a, c, g, or t
  modified_base (249)..(249): a, c, t, g, unknown or other
  misc_feature (249)..(249): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaagggggaaancgtccaccctctcctgcgagggccagtcagagtgttaggancaacttgccttggtactcagacaacgaaaccgtggacccaggcctcccgacggtcctcccgtacacgttcttaggtggtcgacctacgtacccgaaccggtacggggaccctaacggttcgggtaacctccccgaacggtcccgtaggggtttacagggttcggcgtagggttcggggttcgtaggggaactaggtacgttaccaccttcctaccacctatacgacgcgacgtccgtacgacgtacgtacgtaggtaagtttacgttttcgtacgtttaacgttttacgttacgttacgtacgtacgtacgtaagttaacgttacggttccggtaccgggtccgttaccggtacgttaccgggttaccgggacgggtaacgggtaccggtaagggtaggtacgtaagtaaaccggaaacgtacgtggtacgtctacgactacgtcgttcgtacg

SEQ ID NO: 224890 - DNA, 678 bp, Homo sapiens
  misc_feature: GYAE6OF01CMXZ7.49.33.C11.1.454.CMB.1.raw
  modified_base (202)..(202): a, c, t, g, unknown or other
  misc_feature (202)..(202): n is a, c, g, or t
  modified_base (410)..(410): a, c, t, g, unknown or other
  misc_feature (410)..(410): n is a, c, g, or t
tcagagtcgagagacacgaccggtgctcgatttagagtgagctcgttgggtttgggggagaactgctcagttaggacccagacggaaccatggaagccccagcgcagcttctcttcctcctgctactctggctcccagatacccatggaagaaatagtgatgacgcagtctccagccacctgtctgtgtctcgaggggaaancgtccacctctccgtggcgagggccagtcagtaggtgtacggatactaacgttgctggtatcgagccaagtaacccgtggccgtaaggccctaccgaggccttcctacgtaattccgttagtggtcactaccgtacccgaaggacggtccctaacggttacggtaaccctccccggaaggtacccgttacgggtttcacggttacggnggtacgggttcgggtacgtacgggaactaagggttcctacaccgttccacgaaaccctgtaccgaaccgcgtaccgtaccgtacgtaccgtacgtacgtaacgttaagttagtttacgtacgtttaacgtttactttacgttacgtacgtagtacgtaacgttattaacggtcggtcgtccgtacgtacgtacggttccgggacggtacgacggaggtacggacgtagtacgaaacgtacgtgacgtacgtacacgaactgtcgtacg

SEQ ID NO: 224891 - DNA, 673 bp, Homo sapiens
  misc_feature: GYAE6OF01D7NTE.49.33.C11.1.454.CMB.1.raw
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (498)..(498): a, c, t, g, unknown or other
  misc_feature (498)..(498): n is a, c, g, or t
tcagagtcgagagacacgaccggtgctcgatttagagtgagctcgttggggtttggggggaggaactgctcagttaggacccagaacggaaccatggaacgccccagcgcagcttctcttcctcctgctactctggcctccagataccactggagaaatagtgatgacgcagtcctccacgccctacccttgtctgtcgtcctaccggaaggggaaancgtccaccctctccgtgcgagggccagtcagtagtggtagganctaacttcgctggtancagacaacgaaccgtggccgacggcctccgacggtcctccgtcacttcgtaggttcggtcaccgtaccgtacccgaaccggacgggtaccctacggttaccgtacctacccgacggtccgtaaggttccgagggtcggacgtagggttcgggtcgtagggactaggtctacacttccaacacatacgacgcacgtctcgtacgtagtacgtagttaagttntttacgtactttagtttacttgtcgtagacgttacgtaagtttaacgtcggttcgggtccggttaccgtaccggtaacttcggggttacgggacgggtaacgggacgtaagggtgaacgtaacgtaacggtaaacggtcgtagggtacggcttacggaacctcgtgttcgttccg

SEQ ID NO: 224892 - DNA, 740 bp, Homo sapiens
  misc_feature: GYAE6OF01AIXK3.49.33.C11.1.454.CMB.1.raw
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggaagaaatagtgatgacgcagtctccagccacctgtctgtcgtctccgaaggggaancgtccacccgtctcctggcgacgggccagtcagacgtgtagganctaacttgcctggtatcgagaccaacggaaccgtcggacccagggccctacccgaggtccctcctactagtccttaggtcggtacgacctacgtcccgaaccggtacgggacccctacggttcgggttaacctccccgaacgggtcccttaagggggttccaggggttacggacggtacggggttcggggtaacccttagggggacttaacggtacggtttccaaccgttccgaccacctaactaccgacgtaaccgcgtcccgttacgacgtaacgttacggtaagtttaacgtttacgtttacgtaacgtttacgttttaactttacggttcgtacgtacgtacgttaagttaacgttacggttccgggtaccggtaccgttacgtacggttaccgttcggggaacgggtacggtaccggtaagggtccggaaggtacgtaacgaaccggtacgtaggacgggtctacgaccgtaacgttcgtcttaccg

SEQ ID NO: 224893 - DNA, 613 bp, Homo sapiens
  misc_feature: GYAE6OF01EGWKT.49.33.C11.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (300)..(300): a, c, t, g, unknown or other
  misc_feature (300)..(300): n is a, c, g, or t
  modified_base (603)..(603): a, c, t, g, unknown or other
  misc_feature (603)..(603): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccatataccatggagaaatagtgatgacgcagtctccagccaccctgtctgtgtctccgagggaaangtcaccctntcctgcaggccagtcagagtgtagnactaacttagctaggtatcagacagaacctggccaggctccaggtcctccgtacatctagtggtnctactccacgacgggtccacgtgtactcccgagcctaggttacaggtgacgtaggttcgggtcagggactaggtacgttcctacgtacctacgaacctagtacgacgacgtacggtaccttaggacctagttactaaggtaacgttagttttacgactttaagttttacgtactgtacagtagagttaatacgtcggtacccggtactacccgattaccggttacgggacggtaacgggacgtaaggggtagaacgttacaacggtaaacggtacgttcgggtacgacgtacggaactacgtntcggttaccg

SEQ ID NO: 224894 - DNA, 688 bp, Homo sapiens
  misc_feature: GYAE6OF01C03MX.49.33.C11.1.454.CMB.1.raw
  modified_base (205)..(205): a, c, t, g, unknown or other
  misc_feature (205)..(205): n is a, c, g, or t
  modified_base (347)..(347): a, c, t, g, unknown or other
  misc_feature (347)..(347): n is a, c, g, or t
  modified_base (437)..(437): a, c, t, g, unknown or other
  misc_feature (437)..(437): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccacctgtctatgtcctccgaggggaaanagcccaccctctcctgcagggccagtcagatgttggcagctacttagcctaggtaccagaccagaaaccgtggaccaggcctacccagttcctacctcagtttctttaggactgaccacctcccggagtacgggcctcgtanacccacgttccccaggacccttaggttccagggttacggccgtagggtttggggttacgggatagacctttcaccggtctaaccgacctntacgtacgccgagtaccgtagacgtaccgtagtaaagtgttttcgcgtttaagttttacgttactcggtaaccaaccgtaggtacccgttaacgaaccggtacggttacctttaccgttacccgttttaccgggtaccccggtttacggggaaccgtaacggttacggtaggttaacctaacgtaaaccgaaacgttaacggtcggttacgggacctacgtacccaaccttgtttctcgtttccttaaccg

SEQ ID NO: 224895 - DNA, 834 bp, Homo sapiens
  misc_feature: GYAE6OF01DHW3P.49.33.C11.1.454.CMB.1.raw
  modified_base (294)..(294): a, c, t, g, unknown or other
  misc_feature (294)..(294): n is a, c, g, or t
  modified_base (623)..(623): a, c, t, g, unknown or other
  misc_feature (623)..(623): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctccagactacccacgtggaagaaatgtgaatgacgcagtctccagcccaccctgtctgtcgtaccgtccggaagggaaagtcgtccaccctctccgtagcgacgggccagtcgaaggtaggttcgtaaggacgtactaacttaggccgttggtacacganccgaaagaaaccgtcggacccgtacggccctaccccgacggtccccttaccccgttactacgtttaccgtaggttcggtaccacctaccgtacccgaacccgggacgggtaccctaacccggttggtaaccctacccccggaggtaccgtaacggtttaccgaagggtcggtacccggtaggggttcgggtaccggtaaggggaacttaggaccgtttacccgactacccgtacacccgtaatccgtacggaccaaccggtcgtacggtctaaggtttaccgtaaggttaaagtttgtttaccggttaagttttaacggtttttaaacncgttaactacgacgttaaccggtagtttaaacggtccgttaccgggttacccggaccccggtttaacgtcccgggtttaaccgggttacgggaccggggttaaccgggaccggttaaaggggaccgggtaaaggtaaccccggttaacgtaaaccgggtaggttcccgggtacgtaccggtactaacccgacctttaacgttccggtaacc

SEQ ID NO: 224896 - DNA, 183 bp, Homo sapiens
  misc_feature: GYAE6OF01DBUEH.49.33.C11.1.454.CMB.1.raw
  modified_base (175)..(183): a, c, t, g, unknown or other
  misc_feature (175)..(183): n is a, c, g, or t
tcagagtcgagagacacgaccggtgctcgatttagagtgagctcgttgggttgggggaagaggaagactgaccggtccccccaggagttcaggtgctgggcacagccggccctgggctgcctggtcaaggactacttcctcgtagcactctgagcgggctggcaaggcgcatagnnnnnnnnn

SEQ ID NO: 224897 - DNA, 595 bp, Homo sapiens
  misc_feature: GYAE6OF01AP5NC.49.33.C11.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
  modified_base (363)..(363): a, c, t, g, unknown or other
  misc_feature (363)..(363): n is a, c, g, or t
  modified_base (412)..(412): a, c, t, g, unknown or other
  misc_feature (412)..(412): n is a, c, g, or t
  modified_base (432)..(432): a, c, t, g, unknown or other
  misc_feature (432)..(432): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtcaccctntcctgcagggccagtcagagtgtaggngcaacttgcctggtatcagcagaaacctggccaggcctcccaggcctccgtcactctagtggtncactccaccgacgggccacgtggtactcccgagcctaggttcagtgcaggtgggtcgngggacaggtacttcactctcaccatcagcacgctgcagtctagtaagtntttgattagtttattacgtntacagtactagtatacgtcggtccggtacctccgggtacgtaccggttcgggccggtaacgggtaccgtaaggggtacgggacgtaaccgttaaccggaaaacggtaccggttaggtacgggtaccctacgggaacccgtaacccgtacggttgttaccccgg

SEQ ID NO: 224898 - DNA, 714 bp, Homo sapiens
  misc_feature: GYAE6OF01BN9HU.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggaggaactgctcagttaggacccagacggaaccatggaacgccccagcgcagcttctcttcctcctgctactctggcctcccagataccactggagaaatagtgatgacgcagtctcacgccacctgtctgtgtctcgaagggaancgtcaccctctcctgcgacgggccagtcaagtagtggttaggagactaaacgttcgccgttaggtactacgagacaacggaaacctcgggaccacggcctcccgaacggtccttaccacgtacttacgtagtgggtacgacacgtacccacggacgggacctacgttacggtacctacccgaggtacccgtaaggttcgacggtacgggactacgggttgggtacggtcggggaactacggtacgttacccaacgtttaccaccgtaaccctaagtccgaacggaccctacggtaccgtacgggtactacggtacgttaaggtaagtttacgtttcgacgtttaagttttactacgtgtacgtaacgtctaagttaacttacgtacgggtacccggtaccgtaccgtacgtacggttaccggggaacggaacgggtaccgtaaaggggtcgaaacggtacgtaacgaaaaggtcgttaggacgtacgacggtaaccacgtattccggttac

SEQ ID NO: 224899 - DNA, 763 bp, Homo sapiens
  misc_feature: GYAE6OF01ASEJ7.49.33.C11.1.454.CMB.1.raw
  modified_base (202)..(202): a, c, t, g, unknown or other
  misc_feature (202)..(202): n is a, c, g, or t
  modified_base (365)..(365): a, c, t, g, unknown or other
  misc_feature (365)..(365): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgacgcagtctccagccacctgtctgtgtctccgagggaanacgtccaccctctcctgcgagggccagtcagtagtgtaggagcaacttagccgtggtactcgagacaacgaaccgtggaccaggcctcccgaggtcctccgtctattccgtagtcgggtcgaccacgtcccaaccggacgggaccctacggttcggttaaccnccccgaaggtacccgtagggtttaccgagggttcgggaccgtaggggttcgggtaccggtaggggaactaggttacgtttaccaccgttcctaccgaccctagtcgacgtaccgtcgtacccgtggacctacggttacgtaaggttaacgtttagttttacggaccttttaagtttttaacgttacgtacgttacgaacggttactaaaggtttaacttaaccgggttccgggtacccggttaccgttaccccgggtacgttacccgggttacggggacggttacgggaacccgggtaaggttaacgggcggttaaacgtaaccgggtaaaacgttaacccgggtaggttacccgggtaggtacccgttaaccggtaccctaacggttccgttaccgg

SEQ ID NO: 224900 - DNA, 963 bp, Homo sapiens
  misc_feature: GYAE6OF01EY16S.49.33.C11.1.454.CMB.1.raw
  modified_base (208)..(208): a, c, t, g, unknown or other
  misc_feature (208)..(208): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctccagataccactggagaaatagtgatgacgcagtctccagccctaccgtgtctgtgtcgtccgaaggggaaancgtccaccctctcctggcgacgggccagtcagtagtgtagagactaagtacgcgtagtatcagacacgaaccgtggaccacggcctacccgaggtccttacctctacttccgtagttcgggtacgccactccccgaaccgtacggggaccctacgttacgggtacctaccccgacggtacccgtaaggttccgaacgggttcggacggtacgggtttacggggtaccggttaacgggggaaccgtaacggggtttaaccgtttacccgtaaccgtttacccgttaaccctaacccgtaacgttaccggaaccggtacccgtaaccgggttaccccgttacggtacggttaaccggttaacgttaacgggttaaaacgggttttcgttttttaaacccggacggttttttaaacggttttttaacgtttacccggtttaacgggttaacccggtaacgggtaaccgttaacccggggtttaaccgggtaaaccgggtaaaccccgtttaaacccggggttccggttaaacccccgtttccggttttaaaccccgggttacccgggttttaaccccggggggaaccgggggtttaaacccggggggtaaaaacccgggttaacgggggttaaacggggtaaacccggttaaacccggttaaaaaccgggggtaaaacccgttaacgggtttaccggggtacccggggttacccttaacggttacccccggtaaaaccggttccgttttaaccccggg

SEQ ID NO: 224901 - DNA, 525 bp, Homo sapiens
  misc_feature: GYAE6OF01DWIP8.49.33.C11.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (518)..(518): a, c, t, g, unknown or other
  misc_feature (518)..(518): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngtcaccctctcctgcagggccagtcagagtgttaggagcaacttagcctggtatcagcaagaaacctggccaggctcccaggctcctcatctatggtncatccaccagggccactggtactcccagccaggttcaggtgcaggtgggtctgggacaggtagttcactctcaccatcacgcacgcctgcgagtcgtagaagtattttagctagtttattacttgtactagtacagtataagtcgtccggctccgtactacgttcggcggaggaccgtaaggtggagtatacgaaacgaacgtgacgctagacacngtcgtcg

SEQ ID NO: 224902 - DNA, 832 bp, Homo sapiens
  misc_feature: GYAE6OF01BRDU1.49.33.C11.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggcctcccagataccactggagaaatagtgatgacgcagtctccagccaccctgtctgtgtctcgaggggaangtccaccctctcgtgcacgggccagtcagtagtgttagganactaacttagccttaggtatcagctaacgaaccgtggaccctaggtccctacccgaggtcctcccgtactattccgtagtcggtcgctactacccgaccggacgggaccctaacgtcggtaacctcccgagtaccgtaggttcgaggttcggacgtacgggttcggggtcgtacggggaacgtacggttacgtttaccgtacccgttaccgtacccaaccccgttagtacccgtaggaccccgtacgtacccgttaccgggtactaacggttacgttaacgggttaaagtttacggttttttcggtacgttttaaaacgggtttttactttacgtttacggtaccgtacgttaaccgttaagggtttaaaccgttaaccggttaccgggggtttaccccgggttacccgttaccccggggttaaccgtttacccggggtttacggggaacccggggtaaacgggggtaaacccggtaggggttacgggaaacggttaacccgtaaacccgggtaaaaccggtaaccggttacggggttaccggtacgttaacccgtacccgttaaccgtcggtttacccggttaccg

SEQ ID NO: 224903 - DNA, 181 bp, Homo sapiens
  misc_feature: GYAE6OF01CH7GB.49.33.C11.1.454.CMB.1.raw
  modified_base (174)..(181): a, c, t, g, unknown or other
  misc_feature (174)..(181): n is a, c, g, or t
tcagagtcgagagacacgaccggtgctcgatttagagtgagctcgttgggtttgggggaagaggaagactgacggtccccccaggagttcaggtgctgggcacagcggccctgggctgcctggtcaaggactacttcctctctcgactctgagcgggctggcaaggcgcatagnnnnnnnn

SEQ ID NO: 224904 - DNA, 614 bp, Homo sapiens
  misc_feature: GYAE6OF01ASKRG.49.33.C11.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
  modified_base (608)..(608): a, c, t, g, unknown or other
  misc_feature (608)..(608): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatcgacgcagtctccagcccacctgtctgtgtctccgaggggaangtccaccctntcctgcacgggccagtcagtacgtgtagganctaacttagcctggtatcagcagaacctggaccaggcctccgaggtcctcctctatctagtcggtcacactaccgacggacgggacctacgtcgtacctcccgacgtccgtaggttcgaaggtcggacgtacgggtcgggtacggtacgggaactaggtacgttcctacgttctaccgtacctatccgaacgtaccacgtccgtcggaccgtacgttcgaagttaacgttcgttttacggactttagtttactaacgtcgtacagtcgacgtacgtacgactacgttcgccttcgtacgtcggttcgggcggtacgacgtaggtgacacgtacgaaacgtgtacggcgtactacgactacgtnttaccg

SEQ ID NO: 224905 - DNA, 753 bp, Homo sapiens
  misc_feature: GYAE6OF01A09I4.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtcctaccgaaggggaacacgtccaccctctcctgcgagggccagtcagagtgtaggacgactaacgttagccgtaggtatacagacgaacgtaaccgtggacccgaggccgtacccgaggtcctaccgtactagtcgttgtaggcgacctacgtcccgaacggacggccctacgtacggtaccctacccgacgtaccgtacggttacagggtacggacgtagggtcgggtacgtagggacctaaggtacgttccaacttccgtaccaccgtatccaacgtcaacgtcccgagtactacggttcgtaagttaacgttacgttttcgtaactttaagtttttaaccgtacctttagggtacctacggtaagttaaccgttaatttaacccggtccggggttaaccccgggtctttaaacccggggtacctttaacccggggtccggggggtaaccggtaaccggggtaaccgttaaagggggtaccgggaaacttaaccgggtaaaccggtaaacgtaccggtgggtaccgtacttacccggaactcccgttaagttcccgttacg

SEQ ID NO: 224906 - DNA, 728 bp, Homo sapiens
  misc_feature: GYAE6OF01DEYVE.49.33.C11.1.454.CMB.1.raw
  modified_base (206)..(206): a, c, t, g, unknown or other
  misc_feature (206)..(206): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgcctactctggctcccagataccactggaagaaatagtgatgacgcagtctccagcccaccctgtctgtgtctccgagggaaangtccaccctctcctgcacgggccagtcagtagtggttaggagtcaacgttgcctaggtatcagcaacgaaacctggaccacggcctccccgaggccctcctacacttcctaagtcggtcgacctaccgtccctaaccggacgggaccctacgtacggtacctacccgacgtaccgtaggttcgaggtgggactgggttcgggtctaggggactaggtacgttacacttcctaccactacgtacgacgcgaacggtcctagactacggttcgtaagtaacgtttcttttacgtacgtttaacgttttacgttaacgttcgtaacgttagtacgtaaagttaactttacgggttccgggttcccgggtacccgttaccgggttacccgtttacgggttacccgggggtaacgggtaaccggggtaaccggtaaggggttaacgggaaacttaaacggtaaaccggaaaacggttacggtagtaccgggtaacttaccggacctaaccgttacgttcggtttacg

SEQ ID NO: 224907 - DNA, 791 bp, Homo sapiens
  misc_feature: GYAE6OF01ATQBO.49.33.C11.1.454.CMB.1.raw
  modified_base (157)..(157): a, c, t, g, unknown or other
  misc_feature (157)..(157): n is a, c, g, or t
  modified_base (216)..(216): a, c, t, g, unknown or other
  misc_feature (216)..(216): n is a, c, g, or t
tcagagtcgagagacacgaccggtgctcgatttagagtgagctcggttggggtttgggggaggaactgctcagttaggacccagacggaaccatggaagccccagcgcagcttctcttcctcctgctactctggacctcccagactaccactggaanaaatagtgatgacgctagtctccagcccacctgtctgtcgtctaccggaaggggaaacncgtccaccctctcctgacgagggtccaaggtccaaggagttaggttaacggacactaacgttagcctaggtaccagcaaacgaacctcggaccaggtcctacccgagtcctacctactaacgttcgtttagacttacgacctaccgtcccggacgaacggggtccctacgtacgaaacctaccgttaccccggaacggtcccgtaacggttacgaagggtcgggtacgttaggggtttacggggttacggaacctaacgtaacccttccgaacgtccgttaaacccaaccgtacgttaccgaacgtaccgtaacggtacccgtaaggaccgtaccgttaaggtaacgttaacgtttttcgacgtttaagttttaccgttacgtacgtaaacgaaccgtaacgtaccgtaaccgtacgtaacggttaccttaccgttacccgttccggaccggtacgggtaaccgaaggtaccggtaaggaaacgttaacgaaaccggaaacgttaacgttcggtaccgttacgaccgtaacccgtaaccttacgttcccgtttaacgttccgtttaccctacccg

SEQ ID NO: 224908 - DNA, 175 bp, Homo sapiens
  misc_feature: GYAE6OF01E4EN4.49.33.C11.1.454.CMB.1.raw
  modified_base (173)..(175): a, c, t, g, unknown or other
  misc_feature (173)..(175): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctcgtagcactctgagcgggctggcaaggcgcatagnnn

SEQ ID NO: 224909 - DNA, 788 bp, Homo sapiens
  misc_feature: GYAE6OF01AH90N.49.33.C11.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
tcagagtcgagagacacgaccggtgctcgatttagagtgagctcgttgggttgggggaggaactgctcagttaggacccagacggaaccatggaagccccagcgcagcttctcttcctcctgctactctggcctcccagataccactggagaaatagtgatgacgcagtctccagccacctgtctgtgtctccgaggggaancgtccacctctccgngacgacgggctagtcagtgtcgtagganctaagttcgccttggtactcagaccgaagaaccgtgggaccctagggccctacccggaggtcctacctactacgtcgtaagtcgggtacgtaccaaccgtcccgaaccggacgggtccccctaggtttaccgggttaaaccctccccgtaacggtaccccggttacggggtttaccgagggggttcggaccggttaacgggggttccgggggttacggtaacggggaactaacgggttcccgtttacgtacccgtaccgttaaccaaccccggttagttacccggaagtacccggtacgtcccgtacgggaccgtaaggttaccgtaacggttaaaggtttcgttttacggtaacgtttacggttttaacttacggttcgttaacgtagtaacgtttaacgttaacgttacggtccgggtaccgggtcccgttaacggtaccgttaccgggttacgggaccgggtagggtaacccggaggttacggaacgtacgtaacgaacggtaccgttggtacgtcgtacgacaccctggttcccgtacg

SEQ ID NO: 224910 - DNA, 698 bp, Homo sapiens
  misc_feature: GYAE6OF01BGLJG.49.33.C11.1.454.CMB.1.raw
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
  modified_base (524)..(524): a, c, t, g, unknown or other
  misc_feature (524)..(524): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaagcgtccaccctctccgtgcgagggccagtcagagtgttaggancaacttagcctggtatcagcagaaacctggccaggcctcccaggcctcctcatctagtggtcncactccaccgagggccacgtcggtactccccagccctagggttcaggttcgggactaggtcggggtcgtggggaactaggtacgtttccaaccgttcctacccaaccgtacttccgaacgtccgaaccggtcccttgggaccctaggtaccgttaggtaaacgtacgtttttaggactttaagttttaactttaacgttcgttacgtaacggngttaacgtttaattaacggtttccgggtaccccggggtaccgttacccgggtaaccgttaccggttttccggggacgggtaaccggggaaccgtaaggggttacgggaacggtaacgttacggaaaacggtacgttagggtcggacgttacgggaccaccgtgttccgtttacg

SEQ ID NO: 224911 - DNA, 839 bp, Homo sapiens
  misc_feature: GYAE6OF01CXX43.49.33.C11.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (823)..(823): a, c, t, g, unknown or other
  misc_feature (823)..(823): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtcctccgaggggaaancgtccacccgtctcctgcgagggccagtcagagtgttaggnactaactgcctggtactcgagacacgaaaccgtggaccacggcctcccgaaggccttacccctactatttccgttagtcggttcgcctaacgttcccgaaccggtaccgggtaccctaacggtttacgggtaaccctacccccggaacgtacccggtaacggtttcgaacggggttcgggacggttacggggttgggggttacccgttacgggggaaccctaaggggttaccgttttaccgaacccctttcgtaacccgtaacccgtagtaaccccgtaacggcccgtaacgttccctaacgggaccttagggttaccttaaaggtaacgttttacgttttacgtacggtttttaaagttttacgtttaaccgtcggtaaccgtaggtaacccgtttaagttaacgttaacgggttcccgggtacccgggttaccgttaccggttacccggtttacgggtttcccggggaaaccggggttaaccgggaaccgggttaaggggtacggtaaacgggttaccgtaaacgtaaaaccccggttggtaagggtcccggttaacgtaccgtaccgtttaaccngtttaccggtttaccg

SEQ ID NO: 224912 - DNA, 720 bp, Homo sapiens
  misc_feature: GYAE6OF01DI54D.49.33.C11.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (281)..(281): a, c, t, g, unknown or other
  misc_feature (281)..(281): n is a, c, g, or t
  modified_base (489)..(489): a, c, t, g, unknown or other
  misc_feature (489)..(489): n is a, c, g, or t
  modified_base (512)..(512): a, c, t, g, unknown or other
  misc_feature (512)..(512): n is a, c, g, or t
  modified_base (688)..(688): a, c, t, g, unknown or other
  misc_feature (688)..(688): n is a, c, g, or t
tcagagtcgagagacacgaccggtgctcgatttagagtgagctcggttgggtttgggggaggaactgctcagttaggacccagacggaaccatggaacgcccagcgcagcttctcttcctcctgctactctggcctccagactaaccataggaagaaatagtgatgacgcagtctccagcctacctgtctagtcgtctaccgaagggaaancgtccaccctctcgngcgacggcctagtcaaggtagtaggtaaggatactaacgttacgccgtaggtacncgaagacaacgaaaccggtcgaccgaccggtacctacccgaaggtccttcctactagttacgtaggtcggtacgacctacctacccgaaccgaccggtaccgtaacgttaccgggtacctaaccccgacgtacccggtaggttacgaagggtcggtacgtaagggttcgggtacgtcgggaacgtacgtgtaccacgtcctacgaacngtacgacgtacgacgtcctagtntacgtaagttacgtaaggtttacttggttacttaaaggttttactagttacggactaagtacgtaagttacgttacgggtaccgtccggttacccggtaacgtttaccggtaacggttcggggaaacggtaagggaaacgttagggaggttaaacaacggtaacgaaccggttagnggtaccgtacgtaacgacttactgtcgttaac

SEQ ID NO: 224913 - DNA, 796 bp, Homo sapiens
  misc_feature: GYAE6OF01BI8W7.49.33.C11.1.454.CMB.1.raw
  modified_base (208)..(208): a, c, t, g, unknown or other
  misc_feature (208)..(208): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggaagaaatagtgatgacgcagtctccagccacctgtctgtgtcctacgaaggggtaaancgtccaccctctcctagcgagggccagtcagagtgttagagctaacgtgctggtatcagcaagaacctggaccaggcctccgacggctaccgtacacttccgtaagttcggtacgacctaacgtacccgaaccgtacgggacccctacgttaaggtacccttaccccgaacggtacccgtagggttacccgagggttcggacgtaggttcggggtacgtacgggaacgtacggtacgtttaccgaccgttcctaccgaaccgaacttaccgacgtaccgtacgtaccgtacgaccgtaacgttaccgtaaggtaaggtttacgttttacggtaccgtttaagtttttaaacttaccgtttacggttacctaacgtaacgttaaacggttaacgtttaaccggtccggggttacccgggtacccggttaacccggtacccgtttacccgggttacccggggtaacgggtaacccgggggttaaacggtaacggggttaacgggtaaacgttaacggttaaaccggaaaaccgggtaaccggtacggtacggtaccgtaccgaacccgtaacgttaccgtcgtttacccg

SEQ ID NO: 224914 - DNA, 726 bp, Homo sapiens
  misc_feature: GYAE6OF01CO52D.49.33.C11.1.454.CMB.1.raw
  modified_base (175)..(175): a, c, t, g, unknown or other
  misc_feature (175)..(175): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (349)..(349): a, c, t, g, unknown or other
  misc_feature (349)..(349): n is a, c, g, or t
tcagagtcgagagacacgaccggtgctcgatttagagtgagctcggttggggtttgggggaggaactgctcagttaggacccagacggaaccatggaacgccccagcgcagcttctcttcctcctgctactctggcctcccagataccactggagaaatagtgatgacgcagtcnccagcccacctgtctgtcgtctcgaagggaangtccaccctctccgngcgacgggccagtcgagtagttggtaggacgcaaacgttcgccgttaggtactacgagaccgaacgtaaaccgtcggacccacggccctacccgacggtccttcctctacgtacgttacgtggtacncaccgtacccgaccggacggaccctacggttacggtaccctacccgacggtaccgttacggttcgaggtcgggacggtagggttcgggtcggtaggggacttacggtacgttaccgacgttccaaccgacctacgtaccgaccgtccgacgtccgtcgtaccgtaggttactaagggtaacttttgtttacgttacgtttaattttaacgtccgttgtactagtacgttaataacgttacggtccggttcccggacgtccgtacgttcgggttacgggacggggacgtacgggtaagggtacggtacggtaacgtaaacgtaaacgggtacggtacggtacggtaccttacgtaacccttacgtacgttccggttac

SEQ ID NO: 224915 - DNA, 628 bp, Homo sapiens
  misc_feature: GYAE6OF01BKUP0.49.33.C11.1.454.CMB.1.raw
  modified_base (152)..(152): a, c, t, g, unknown or other
  misc_feature (152)..(152): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
  modified_base (319)..(319): a, c, t, g, unknown or other
  misc_feature (319)..(319): n is a, c, g, or t
  modified_base (347)..(347): a, c, t, g, unknown or other
  misc_feature (347)..(347): n is a, c, g, or t
  modified_base (391)..(391): a, c, t, g, unknown or other
  misc_feature (391)..(391): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactgganaaatagtgatgacgcagtctccagcccacctgtctgtgtctcagtagggaaagctccacccttntcctagccgagggccagtcgagtagtgttagganctaacttgcctggtancgagcaagaacctgaccgacggcctccaggtcctccgtatacgtctagtcggncacctccgacgacggccagtcggtaccncccgagtccgtaggtcaggtcggctagggttcggtcgaggaacngtacgtcacctcacacagtcacgcgagtccgtgacgtacgtcgtagtattactttgactttacgttttacgtacttagtacgtacgtagtaattacgtaacgtcggttccgggaccgttaccggtaccggttaaccggttcggggtaccgggaacgggtaaccgggtaggtacggtaacggtaacgtaaccgaaacggtccgttaggtacggtaccgtaggaccctacgtagttccg

SEQ ID NO: 224916 - DNA, 598 bp, Homo sapiens
  misc_feature: GYAE6OF01EYJ1C.49.33.C11.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctcgaggggaaangtccaccctctcctgcaggccagtcagagtgtagagcaacttagcctggtatcagcaagaaacctggccaggcctcccgaggcctcctcatctagtgggtncactcccaccgacgggccacgtggtactcccgagccgtaggttcaggtggacgaggtgggtcgtaggggactaggtacgttcacttctccaacgatcacgcncgtcctcgctagtctagtaagttgttttgacttagtttacttacgtgtactagactaagttaataacggtcgtccgggtccgttacccggtacgtaccggtttcggggacgggaacggggtaccgtaaggggtggtaacgtaagtaaccggaaacgtacgtggtcggtacgtcgacctacctagttcctacgg

SEQ ID NO: 224917 - DNA, 736 bp, Homo sapiens
  misc_feature: GYAE6OF01CI84U.49.33.C11.1.454.CMB.1.raw
  modified_base (159)..(159): a, c, t, g, unknown or other
  misc_feature (159)..(159): n is a, c, g, or t
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
  modified_base (511)..(511): a, c, t, g, unknown or other
  misc_feature (511)..(511): n is a, c, g, or t
  modified_base (718)..(718): a, c, t, g, unknown or other
  misc_feature (718)..(718): n is a, c, g, or t
tcagagtcgagagacacgaccggtgctcgatttagagtgagctcgttggggtttgggggaggaactgctcagttaggacccagacggaaccatggaacgccccagcgcagcttctcttcctcctgctactctggcctcccaagactaccagtagggaanaaataggtgatggacgcagtctcagcccacctgtctgtcgtcaccggaagggaaanctccaccctctccgtgcgacgggtccagtcaggtagtgttaggaacnctaacgttacgcgtaggttacacgaggacaaacgtaaccgcgggaccgacggtccctacccgacggttcctcctacgttacttcctagggttcgtacgaccctacgttaccccggaaacggtcgggacccttaacggttcggtaaccctaccccggaacggttccggtaaacggttcaaggggtccgtacggtggggttacgggtcgaacggggataacggtccgtttacaccttcgaaccaccgttanccgacgtacgtcgtaccgttacgcgttaacgtccgttaaaaggttgtttaagttccggtttaacttagttttttaaaccggttgacgtaacgtacggtaacgtttaagtacgttaccggtggtaccccggtccgtacgtacgtacggtcgggaacgtacgggacgttaggacgaacgtataaaccggtagtccgtggacggttaccncgtacctcttgttctccg

SEQ ID NO: 224918 - DNA, 735 bp, Homo sapiens
  misc_feature: GYAE6OF01BOLTZ.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggttgggggaggaactgctcagttaggacccagacggaaccatggaagccccagcgcagcttctcttcctcctgctactctggcctcccagataccactggaagaaatagtgatgacgcagtctccagccaccctgtctgtgtctccgagggaaancgtccaccctctctgcgacggccagtacagagttgtagacgcgtaacttagcctaggtactgacgacgtaacgaaaccgtggaccacggcctacccgaggtccccttacctactacttaccgttagtcgggtcgaacccgtacgtaccccgaaccggtaccggggtaccctaacggttaccgggtaaccctaccccggtacggtacccgttacgggggtttacccaaggggttccggacggttaacggggttcggggtaccggttaggggaacccgtaaggggttaccttacccgaccgtttacccaccgaacctagtacccgaaggttccaacggtcctagtccgtaacgtcttaacgtacgttatttacgtacgttattttaacgtcttacgtgactagtaactactacggtcggtaccgtaccgtacgtaacgtcggttaccgggacgtaacgggtacgtaaggggcgtaagtacgtaacgaaaccggtagacggtacgggcttacggaccctacgtacgttccgtcg

SEQ ID NO: 224919 - DNA, 665 bp, Homo sapiens
  misc_feature: GYAE6OF01B2VL8.49.33.C11.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatgtgatgacgcagtctccagccacctgtctgtgtctcgaggggaaangtccacctctcctgcagggccagtcagagtgtaggancactgctggtatcagcaagaacctggccaggcctccgaggcctccncatctagtggtcncatccaccgngggccagtcggtactcccgagtccgtaaggttcgaggtcggacncgggttgggtccgtgggactagggtacgttaccgtacttaccgtacaaccgtaactaccgtagaccgtaaccggtcccgtacggaacccgtacggttccgttaaggtaaacggtttagtttttacgacgttttaacgttttaacttacgttcggttacgacgtaccgtaagttaacgttaacgtcgggttacccgggtccgtaccgggtaaccgtttaccgggttaccgggacggggtacggtaacccgtaaggggtacggtaagaacgtaacggaaacggtacgttggacggtactcggaccactgtcgttcg

SEQ ID NO: 224920 - DNA, 780 bp, Homo sapiens
  misc_feature: GYAE6OF01EI72I.49.33.C11.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
tcagagtcgagagacacgaccggtgctcgatttagagtgagctcggttgggtttgggggagaactgctcgagttaggacccagacggaaccatggaacgccccagcgcagcttctcttcctcctgctactctggcctcccagactaccacgtggaagaaatgtgatgacgcagtctaccagccctacctgtctgtacgtctaccggaagggaacncgttccaccctntccgtgaccgagggcccaagttcgaaggtacggtaggttagganacctaaacgttcgccgttaggtatccgagtaccaaggaaccctgggacccaaggtcctaccgaggtccctaccgtctaagtccttagtggtcaccctacgtacccgaaccggacgggtcccctacgggttagtttaaccccgccccgaaggtccgtttaacggttccgaagggttccgacgggttacggggttaggggtcgtaacgggggaacttaacgggttaaccggtttcaaccctttcgtacccgaaactttaccacgtaccgaccgtacgtcccgtagtaccgtacgtacgtaagtacgttagtttcgttacgtttacgttttacttacgttcgttactacgtacgttaagttaacgtacggttcgttacccgggggggtacccttaccgggtaccgttaccggttaccgggtaacgggacgggtaacggtaaggtacggtaacgtaacgtaaacgtaacggtacgtcggtacggtcggtactaccgacgttccgtcgttaccg

SEQ ID NO: 224921 - DNA, 849 bp, Homo sapiens
  misc_feature: GYAE6OF01DM1GT.49.33.C11.1.454.CMB.1.raw
  modified_base (210)..(210): a, c, t, g, unknown or other
  misc_feature (210)..(210): n is a, c, g, or t
  modified_base (253)..(253): a, c, t, g, unknown or other
  misc_feature (253)..(253): n is a, c, g, or t
  modified_base (384)..(384): a, c, t, g, unknown or other
  misc_feature (384)..(384): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagatacccactggaagaaatagtgatgacgcagtcctccagcccacccgtgtctgtcgtctcgaggggaaancgtccaccctcgtcctgccgagggccagtcagtagtggttagngactaacgttgcctaggtatcgagacaacgaaaccgtcggaccgacggcctccccgaggtcccttccgtactacgttacgtagttcggtacgcctacgtcccaaccggtcgggacctacggttggtacccncccgtaggcccgtaggttccgtaaggggtcggtacgtagggttcgggttacggacggggacgtacggtacgttacctacctaccgttaccgaacctaagtccgacgactaaccggtccgacgtaccggtagttacgtaaggttaaagtttacgttttacgtaacgtttaacggtttttacttaccggtttcgtaaccgttaaggtaacggttaacgttaaacgggtttaaccggtttccgggttccccgggggtaacccctttacccgggggtaaccgttttccccgggggtttaaccggggggtaaacccgggggttaaaccgggaaacccgggggttaaaggggttaaccggggtaaaacccggttaacggttaaaacccgggtaaaaccggttaccgggtttacgggaaccggttaccggtaccgtaaccccggttaaacgttccgtttccgggtttaaccg

SEQ ID NO: 224922 - DNA, 686 bp, Homo sapiens
  misc_feature: GYAE6OF01ANMJN.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaattgtgttgacacagtctccggccaccctgtctttgtctccgaggggacagtcgccaccctctcctgcagggccagtcagagttgttagtagtcttcttagcctggtaaccaacacgtaaacctggaccaggcctcccgaggcctcctcatctatgatcgcactaccgaacgcgggccacgtggccactcccagcctaggttcaggtcgcgaggtgggtctggtcgactagtaccttcactcctaccacctactcacgtaccgacgtacccgtagtaccgtacccgtaggtaaaccgttactttcgttacgttacgtttaaagttttaacgtttacgtcggtacgacggtaccgacgggtaccgttaacgacccgtaaccgttccggtcccttaccgttaccgtaccgggtttaccggggaccgggtaacgggaccgtaaaggggtacgggaacctaacgttaaccggaaaaccggttacgtacgggttaccggaccgttacgaacccgtacccttagtcccggttttacccg

SEQ ID NO: 224923 - DNA, 843 bp, Homo sapiens
  misc_feature: GYAE6OF01A5T1Q.49.33.C11.1.454.CMB.1.raw
tcagagtcgagagacacgaccggtgctcgatttagagtgagctcgttgggtttgggggaggaactgctcagttaggacccagacggaaccatggaacgccccagcgcagcttctcttcctcctgctactctggcctcccagataccacgtggaagaaatagtagatggacgcagtcctccacgcccaccgtgtctggtcgtccgtaccggaaggggaaacgtcgtccaccctctccgtgcgacggccagtcaggtagttggtaggacactaacgttacgcgttaggtactcgagaccgaacggaaccgtcggaccgacggccctaccggacggtccttacccgtacgtacgttcgttaggttcggggtacctaccgtaccgtacccggaacccggtacgggtcccgtaacggttaccgggtaccctacccccgtaacgggtacccggttaacgggttaccggacgggttacggggacgggttacggggttccggggttacgggtaacggggtaaccgtaacgggtttaccgttacccgtaccgtttaacccgaccgtaacccgtacgaccgaaccgtacccggaccgttccgtccggtaacttacggtacggttaaggttaacgttttcgtttactacgttttaacgttttacgtacgtttacggtaacgtaggttaacgttagggtaactttaccgggtcccggggttacccggttaccgaccgggttaccggtacggttaccggggacgggttaacggaacgggtaacggaaggttaacgaaacccggtacggtaaacgtcgggttcgacggtactaccggtcaaccgttcgtacggttac

SEQ ID NO: 224924 - DNA, 745 bp, Homo sapiens
  misc_feature: GYAE6OF01CSYHD.49.33.C11.1.454.CMB.1.raw
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (311)..(311): a, c, t, g, unknown or other
  misc_feature (311)..(311): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtcnccagcccacctgtctgtgtcctaccgaaggggaaancgtccaccctctccgtgcgagggccagtcagagtggttagnactaacgttgcctagtatcagacagaacctggccgagccnccgaggctccgcagtctatggtncactccgaacgcggacctacgtacggtactcccgagtccgtaggttcgagtcgggtatacggtgggtcgtacgggacgtaaggtcgttctaacccgttcctaaccaacccgtagtaccgtacgacccgtacgacccgttcggtaaccttaggttaccgttaagggtaaacgtttagttttaccggtaacgttttaacggttttaacgtttaaccgtacgttaccgttaacggtaacgtttaacgttaacgttaaacgggttcccgggttaacccgggtccgttaaccccggtaacggttcccgggtttaaccgggaccggggtaaccggggtaccggtaaaggggtaaccggtaacggtaacgtaaaccggtaaacgggtaccgttagggtacgtacccggtacgtaacccgtaccgtagttcggtttaacccg

SEQ ID NO: 224925 - DNA, 682 bp, Homo sapiens
  misc_feature: GYAE6OF01BL722.49.33.C11.1.454.CMB.1.raw
tcagagtcgagagacacgaccggtgctcgatttagagtgagctcgttggggtttgggggaggaactgctcagttaggacccagacggaaccatggaacgccccagcgcagcttctcttcctcctgctactctggcctccagactaccacgtggaagaaatagtgatgacgtcagtcctccacgcccaccctgtctgtcgtctaccgaaggggaatcgtccaccctctccgtgacgacgggccaagtcaaggtagtgttaggagtactaacttagccgtaggtatcgaagtacaacgtaaccgtggacccagggtccctaccggacggtcctcctacattcgtagtcggtcacactccgacgacggtacctagtcggtaacctcccgagtaccgtaggttacaggtcggacgtaggtcgggtacgtaggggacctaggtaccgttctaaccgtcctaccgaactacgtcgaacgcgtaaccgtccgtagcgtacgtctaagggttaattcgttttacgcgtttaagttttaactcgtagtcgaacgtagttaataacgttacggtcggtacccggtacttacggtactcggtacgggcggtaacggtaccgtaggggaccgtaagaccgtaaccggtaaacggcgttcgggactcccgtagtaacccgcttacgtcgttaacg

SEQ ID NO: 224926 - DNA, 896 bp, Homo sapiens
  misc_feature: GYAE6OF01B8CEY.49.33.C11.1.454.CMB.1.raw
tcagagtcgagagacacgaccggtgctcgatttagagtgagctcgttggggtttgggggaggaactgctcagttaggacccagacggaaccatggaacgccccagcgcagcttctcttcctcctgctactctcggcctcccagactacccagtaggaagaaataggtgagtgacgctagtcctccacgccctaccctgtctgtcgtcgtaccggaaggggaacacgtccctacccttctcccgtggaccgacggggtaccaggtacgaaggtggttaaggttacgggaactaccgtaaacgttcgtccgtaggtactacgaacgaccaacgtaaccgcgggacctacggccgtaccgcggtacctacctcgattcctagtcgactaccaccgtaccgaccggaccggacctacggtacgtacccgtaccgacgtaccgggttactacggaggtcggacggtaggttcgggacggtcggaacggtaagttccgtaccaccgtttcctaaccgactaagtccgaacgtaccgtacgtacccgttacggtaacgttacggttacgttaaacggggtttaatttaccggttttaacggttaacgtttaacggtttttaacgtttacgtccgggttaacaacggttaccgttaaaaggtttaaccgggtttaacccgggtacggggtttaacccccggttacccggtaaaccgggggtttaccccgttaacgggttaccccgggggggtaccggggtaaaacggggttaaaccccggggttagggggttaaaaccgaaccgggttaaaaccgaaaaccggggtaccgggttaaaccggttaggggcccgttaaacccggataaacccccgggttaactttaaggttcccccggtttaaacg

SEQ ID NO: 224927 - DNA, 850 bp, Homo sapiens
  misc_feature: GYAE6OF01AHGBR.49.33.C11.1.454.CMB.1.raw
  modified_base (213)..(213): a, c, t, g, unknown or other
  misc_feature (213)..(213): n is a, c, g, or t
  modified_base (280)..(280): a, c, t, g, unknown or other
  misc_feature (280)..(280): n is a, c, g, or t
  modified_base (437)..(437): a, c, t, g, unknown or other
  misc_feature (437)..(437): n is a, c, g, or t
tcagagtcgagagacacgaccggtgctcgatttagagtgagctcgttggggtttgggggaggaactgctcagttaggacccagacggaaccatggaacgccccagcgcagcttctcttcctcctgctactctggcctccagatacccactggaagaaattagtgatgacgcagtcctccacgcccacctgtctgtcgtcctcggaaggggaancgtccaccctctcgtgcgaggccagtcagtagtaggtaggactacctaacgttgccgttaggttacnctaacggacaacggaaaccgtggacccgacggccctaccggacggtccctaccgtactacttaccgttaggttcggtacgtacctaccgtaccccgaccggtaccgggtcccctacggttacgtacccgtcccgtaaggtcccggtacggtttacgnggtaccgggtggtacggggtcgggtaccgtacggggtaacgtacggttaccgtaccgtacccgtccgtacccctacgtaaccgttaccgaccgtacggtacccgtaccgttcgaacggttacgttacggtaagttaaggtttcgttttaccgtttaagtttaacgtttacttccggttacgttaacgtacgttaacgttaaggttaacgttaccgggttaccgggtacccgggttacccgttacccgggtttaaccgttaccgggggttacccggggttaacggggaaccgggtaaaccgggttacgggggaacggttaaacggtaacccgggttaaaccggaaaccgttccggggttaacggtaccggttaaccgtccggttaaccctcggtttaccgttacgtttacccgg

SEQ ID NO: 224928 - DNA, 201 bp, Homo sapiens
  misc_feature: GYAE6OF01AV9EJ.49.33.C11.1.454.CMB.1.raw
  modified_base (175)..(175): a, c, t, g, unknown or other
  misc_feature (175)..(175): n is a, c, g, or t
  modified_base (180)..(201): a, c, t, g, unknown or other
  misc_feature (180)..(201): n is a, c, g, or t
tcagagtcgagagacacgaccggtgctcgatttagagtgagctcgttggggtttgggggaagaggaagactgaccggtcccccgaggagttcaggtgctgggcacagcggcccgtggctgcctggtcaaggtactacttcctctctcgactctgaggcgggctggacaaggcganatagnnnnnnnnnnnnnnnnnnnnnn

SEQ ID NO: 224929 - DNA, 807 bp, Homo sapiens
  misc_feature: GYAE6OF01B87E4.49.33.C11.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtcgtctccgaggggaancgtccaccctctcctgcacgggccagtcagagtgttagganctaacgtagccttaggtatcgagacgaaggaaaccctggaccgacggacctccccgagggcccttaccccgtctaactttccgtagttaggtcggacctaaccgtaccccgaacccgacgggaccctacgtaccggtaactccccgacgtacccggtacggttcgaagggttcgggtacgtagggttcggggtttacggtagggtaccgtaagggtacgtttacccgaccgttcccgtacctaaccgtacgtaccgacggtccgtaccggtaccgtcggtaccgtacggttaccgtaaggtaaacgtttgttttacgtacgtttaacgtttttaacttacgttacgttacggtaaccgtacgttaaagtttaacgttaccggtttaccggggtaccccgggttaccgtaccccgggttaaccggttcgggttacccgggggtaccggggtaaccggggttaaaccggtaacgggggtaacggtaccggtaacgtaaaccggtaaaacggttacgtcggggttacgtacggtacggacccctaacggttcttcggtttacccg

SEQ ID NO: 224930 - DNA, 632 bp, Homo sapiens
  misc_feature: GYAE6OF01B2WDH.49.33.C11.1.454.CMB.1.raw
  modified_base (203)..(203): a, c, t, g, unknown or other
  misc_feature (203)..(203): n is a, c, g, or t
  modified_base (320)..(320): a, c, t, g, unknown or other
  misc_feature (320)..(320): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangtcaccctctcctgcgaggccagtcagagtggttaggagactaacgttagccttaggtatcgagcaacgaaaccgtcggccaggcctacccgaggcctcctcactcctagtggtacncctactcccgacgacggccacgtggtacctccgagtccgtaggttcaggtcggcgtaggtcggtcgtacgggacgtagtacgttaccacgtcctaccgtaacctcgtacgacgcctaacgtccttcggaccttaggtacgtagtaacgttgttttacgtacgtttatttactacgtgtcgaagtactagttaacgtacgtccgggttccggtctaccggtacgttaccggttcggacgggtacggtacggtacggtagacgttagaccgtaaacgtcgtaggcgtacgttacgaccgtactcgttcgttacg

SEQ ID NO: 224931 - DNA, 760 bp, Homo sapiens
  misc_feature: GYAE6OF01AYHXW.49.33.C11.1.454.CMB.1.raw
  modified_base (161)..(161): a, c, t, g, unknown or other
  misc_feature (161)..(161): n is a, c, g, or t
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (748)..(748): a, c, t, g, unknown or other
  misc_feature (748)..(748): n is a, c, g, or t
tcagagtcgagagacacgaccggtgctcgatttagagtgagctcgttgggtttgggggaggaactgctcagttaggacccagacggaaccatggaacgccccagcgcagcttctcttcctcctgctactctggcctcccagataccactggagaaatagtnatgacgcagtctccagccacctgtctgtgtcacgagggaancgtcaccctctccngcacgggccagtcagngtgtaggacncaacgttgcctagtactcagacaacgaaccgtggaccacggccctacccgaggtccttccctacctaacgttccgtaacgttcggggtacctacctaccgttcccgaacccggaccggggtacccctaaacggttcgggttaaccctcccggtaacggtacccgtaacggggtttacgaacgggttcgggtacgtaacggggttcgggtaccgttacggggaaccgtaacgggttacgttacccgaaccttcccgtaaccgtaacccggtaatccgaacggaccgtaaccgtcccggttaggacccgttacggtaccgtaaaggttaacggttacgtttttacgacgttttaaaggttttacttaccgtaggttacgaacgtacgttaagttaacgttacggtccgggtacccgggtaccgtacccgggtaaccgttaccggttacgggaccggggtacgggaactaggggacgtagtacgaacgaacgtcgtagtcgctacgacnctagtccgtacg

SEQ ID NO: 224932 - DNA, 750 bp, Homo sapiens
  misc_feature: GYAE6OF01EYLRZ.49.33.C11.1.454.CMB.1.raw
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
tcagagtcgagagacacgaccggtgctcgatttagagtgagctcggttggggttgggggagaactgctcagttacggacccagacggaaccatggaacgccccagcgcagtcttctcttcctcctgctactctggcctccgagactaccacgttgggaataaatgtcgatcggacgctagtcctaccagcccaccttgtctgtcgtctacggaaggggtaaacncgtccacccgtctaccgtgacggacgggcctagtcgaggtacgtggtaggactaccgtaagttacgccgttagtacncgacgacaacgtaacgtgacaggtcctccgtacgcctacgtacactacgtagtcggcactaccgtaccgacggacggtacctaggtacggtacaccccgaggtaccgaggttacgaacggtcgtacggtaggttcgggtagtacgggaacctagggttaccttcccaaaggtttccaactaccggtactaccggacgacccgtagtcccgtaagtaccgttaaggttacgtaagttaaacgttcgttttcggaacgtttaaccgtttagtacccaggttaccaagtacgtaagttacgtaccggtccggtaacgggtccctaacgggtaccgttacgggtaccgggaagggttaacggaaccggaaaggtaccgttaagaaaccggtttaaccgaaacggtacgtttgggaacccggtactcgaacccgtaacgttcttcggtaaaccg

SEQ ID NO: 224933 - DNA, 732 bp, Homo sapiens
  misc_feature: GYAE6OF01AJKI4.49.33.C11.1.454.CMB.1.raw
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
  modified_base (352)..(352): a, c, t, g, unknown or other
  misc_feature (352)..(352): n is a, c, g, or t
  modified_base (393)..(393): a, c, t, g, unknown or other
  misc_feature (393)..(393): n is a, c, g, or t
  modified_base (723)..(723): a, c, t, g, unknown or other
  misc_feature (723)..(723): n is a, c, g, or t
tcagagtcgagagacacgaccggtgctcgatttagagtgagctcgttgggtttgggggagaactgctcagttaggacccagacggaaccatggaacgccccagcgcagtcttctcttcctcctgcttactctcggctcccagactaccacgtggaagaaatagtgatcgacgcagtctccagcccacctgtctgtctccgtaccgagggaaancgtccaccctctccgtgcgacggccagtcagtagtgtagacnctaacgttcgcgttagtatccgtagaccaacgtaaccgtcggaccgacggtccctaccggacggtacctccctacgtacttacgttacgtcggtacncgtaacctacccgaccgtacgggcctacggtacggttaccncccgaagtaccgttacggtcgtaggtcggacgtagggttcgggtacgtacggggaacttacgggttaccgtttaccgtaccgttcccgtacccgtaacccgtaaacgttcccggaacggtaaccgtccgacccgttcggtaacccgtgttaaccggtaaggttaaagttttccgtttagttactttacgtttacgtttcgagtacagtacgtaagttacgtaccggtcggtacccgacgttacggtcccttagggtaccggacggcgggtaaccgtaagggtacgaagtaaccgaagtaaccgagtacggtcgtctaccggaacctacgngttcgtccg

SEQ ID NO: 224934 - DNA, 713 bp, Homo sapiens
  misc_feature: GYAE6OF01A9UUH.49.33.C11.1.454.CMB.1.raw
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
  modified_base (528)..(528): a, c, t, g, unknown or other
  misc_feature (528)..(528): n is a, c, g, or t
tcagagtcgagagacacgaccggtgctcgatttagagtgagctcggttggggtttgggggaggaactgctcagttacggacccagacggaaccatggaagccccagcgcagcttctcttcctcctgctactctggcctccagataccacgtggaagaaatagtgatgacgcagtctccgacgcctaccctgtctggtacgtcctacgaggggaaacncgtccaccctctccgtgccgaggcctagtcgagtaggttacggttaggacgtctaacgttcggcgttaggtactacgacgtaccaacgtaaccgnggccgaacggcctaccgacggcctcctcgtactcgtacgtcggtcactacctaccgacgtaccggacctaaccggtgtaccctaccgacgtaccggtgtccgtaaggcggtaacgcggtcggtacggtacggacgtggtactacctacgtcaccgtactactcgacgtcacgtcgtacggcctagtcgtagtgttcgttagcgttatttacgtacncttagagtacgttaatacgtagtaccggggtccgttcgtaacccgtccggtacggtttaccggggacgggtaacccgggttaacggggtacggttaagggaaccgttaacgtaaacccgggaaacgggtttacgacgggttccgtaccggtacgacccggttaaacttcccggtacttacccggg

SEQ ID NO: 224935 - DNA, 698 bp, Homo sapiens
  misc_feature: GYAE6OF01EE41V.49.33.C11.1.454.CMB.1.raw
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (658)..(658): a, c, t, g, unknown or other
  misc_feature (658)..(658): n is a, c, g, or t
tcagagtcgagagacacgaccggtgctcgatttagagtgagctcgttgggtttgggggaggaactgctcagttaggacccagacggaaccagtggaacgccccagcgcagcttctcttcctcctgctactctggcctcccagataccactggaagaaatagtgatgacgcagtctccagcccaccctgtctgtcgtctaccgagggaancgtccaccctctccgtgcgacgggcctagtcagagttgtagganactaagtgcctgtancgagcgaacgaaccgtggccgagcctccgagtcctcctcatctagtggtcgactactccgaccggacggtcctacgttagtacctcccgacgtccgtacgggttcgacggtcgggtacgtacgggttcgggtacgtacggggaactacgggtaccttaccgaccgttcccgtaccaaccgtacgtaccgtacgccctagtcccgtcggacgtagttacgtagtaacgtttacgttttcgacttttacggtttacttcgtacgtacgaacgtacgttaagttaacggttacgtccgggtaccccggttccgtacccgggtacttaccgggtccgggacgggtaaccgggtacggtaagggtacgtaacgaacggtaaccgaaacggttcgnggtaccggtacgaccgtaccgaaccgttcgttcgttaccg

SEQ ID NO: 224936 - DNA, 559 bp, Homo sapiens
  misc_feature: GYAE6OF01BBXZ4.49.33.C11.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaangtccaccctctcctgcagggccagtcagagtgttaggancaacttgcctggtatcgagcagaaacctgggccaggcctccaggcctccacatcctagtggncgatccacgacgggccacgtcggtactccccgagcccgtaggttccagtcggctaggtgggtcngggactagtacttcactctcaccatcagcncgtcngcacgtcagtagtatttagacttagtttatcgtgtacagtactatagtacgtcggtacggcctcggacctacggttcggcgggacggaccgaaggggtcgtaacgacgtaacgaaacgtacgtggtacgtccgtacgacctacctacgttcgtcg

SEQ ID NO: 224937 - DNA, 762 bp, Homo sapiens
  misc_feature: GYAE6OF01D4COM.49.33.C11.1.454.CMB.1.raw
  modified_base (176)..(176): a, c, t, g, unknown or other
  misc_feature (176)..(176): n is a, c, g, or t
  modified_base (741)..(741): a, c, t, g, unknown or other
  misc_feature (741)..(741): n is a, c, g, or t
tcagagtcgagagacacgaccggtgctcgatttagagtgagctcgttggggtttgggggaggaactgctcagttaggacccagacggaaccatggaacgccccagcgcagctttctctttcctcctgctactctggcctcccagataccactggaagaaatgtgatgacgcagtcncacgccacctgttctgtcgtactccgaaggggaaactcgtccaccctctccgtgccgagggcctagtcgagtagttacggttaggatacgtaaacgttcgccgttagtaactcgaacgtacgaaacgtaaccgttccgggaccgacggtacccgtaccgacggtcccctccgttactacgtttacgttacggtcggttacaccgtaaccgtacccgaaccgggtaacgggaccctacggtttacgtacccttccccggagtaccgtacggttcgagttcgggagttacggtgggtaccgtagggactaacggtcttaccgacttccacgtaactataccggacgtacgtcggtccgtacggtcgttacgttacgtaaggtttaagttttcgtttaacgttgtttaaacgtttttacgtacgtcgtaaacgtgtacttaacggttaatttccggtaccggttcccgggttacgttaacccggtacgttaccgggttggggtaaccgaagggtaaccgggagggtaagtacggtaaacgtacgtaaacgacggttcgacggttaccngaaccctgttaccttcgttcg

SEQ ID NO: 224938 - DNA, 858 bp, Homo sapiens
  misc_feature: GYAE6OF01B5BQX.49.33.C11.1.454.CMB.1.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgaccgcacgtctccacgccacctgtctgtcgtctcgaaggggaangtccaccctctcctgcgacggccagtcgagtagtgtaggngactaacttagccgtggtactcgacgacaacggaaaccgtggacccgacggcccttacccgacgggtccccttaccctcgtaaccgtttcgttaacggttcgggttacgacccgtaaccgttacccccgaaccggtaccggggtacccctaacggtttaccgggttaaccctacccccgtaacggtacccggttaacggggtttcaacggggttcggtacggtacgggttcggggtaacgtacgggtacgtaggttaccgttcctaacgttccgtaccaccgtacgtaccgacgtaccgaccggtccgtacgacccggttaagttaccggttaacggttaaacgttttacgttttacggttacgtttaaacgttttttaacgttacgtttacggtaaccgtagtaccgttaaaggttaacgttacggtccgggtttacccgggtccgtttaaacccgggcggtttacccggttcggggaacccggtaacggggtaacccgggtaaaggggttaccgggtaaacgtaaccgggttaaacgtaaaaccggggttcgttacgggtaccggtaccgttacgaaaccctacccggtttagtaacccgttttcccgg

SEQ ID NO: 224939 - DNA, 235 bp, Homo sapiens
  misc_feature: GYAE6OF01CY7IJ.49.33.C11.1.454.CMB.1.raw
  modified_base (181)..(235): a, c, t, g, unknown or other
  misc_feature (181)..(235): n is a, c, g, or t
tcagagtcgagagacacgaccggtgctcgatttagagtgagctcgttggggtttgggggggaagaggaagactgacggtccccccaggagttcaggtgctgggcacaggccggccctgggctgcctgggtcaaggctactcctctctgactctgacgcgggctgggcaaaggcgcaatagnnnnnnnnnnnnnnnnnnnnnnnnnnnnnnnnnnnnnnnnnnnnnnnnnnnnnnn

SEQ ID NO: 224940 - DNA, 689 bp, Homo sapiens
  misc_feature: GYAE6OF01EXNHQ.49.33.C11.1.454.CMB.1.raw
  modified_base (154)..(154): a, c, t, g, unknown or other
  misc_feature (154)..(154): n is a, c, g, or t
  modified_base (169)..(169): a, c, t, g, unknown or other
  misc_feature (169)..(169): n is a, c, g, or t
  modified_base (210)..(210): a, c, t, g, unknown or other
  misc_feature (210)..(210): n is a, c, g, or t
  modified_base (566)..(566): a, c, t, g, unknown or other
  misc_feature (566)..(566): n is a, c, g, or t
  modified_base (652)..(652): a, c, t, g, unknown or other
  misc_feature (652)..(652): n is a, c, g, or t
  modified_base (662)..(662): a, c, t, g, unknown or other
  misc_feature (662)..(662): n is a, c, g, or t
tcagagtcgagagacacgaccggtgctcgatttagagtgagctcgttggggttgggggaggaactgctcagttaggacccagacggaaccatgggaacgccccagcgcagcttctcttcctctgctactctggcctcccagacaccagtggaanaaatgtgatcggacncatctcacgcccacctgtctggtctcgtacggaaggggaanacgtccaccctctcctaggcgagggcctagtacgaaggtagttaggtaagacgtactaacgtacgcggtagtacacgagacgtaaccgaacggtccggccgtacggacccttccggacgtccctacccttagtactcgttacggtcggtccaccttaccgacccgacggtaccgtctacggttcgacccgtaccgcggttaccgtaggcgtcggcggtacggtagggtccggaggttaccggaatacgttcgtacctactccgactacgtactacggacgtacctccgtcggtactcgtacgttacggtaattaccggtttacgttcgtaacggttttactagttccgtgtaaccnggtaacttacggtattaccgggtcgggaccctacgggtaccgtccggtacgggtagggacggaccgttaggacggtagacggttanacggtacgtnacggtctcgactacctagtctcggtac

SEQ ID NO: 224941 - DNA, 197 bp, Homo sapiens
  misc_feature: GYAE6OF01BVDRH.49.33.C11.1.454.CMB.1.raw
  modified_base (182)..(197): a, c, t, g, unknown or other
  misc_feature (182)..(197): n is a, c, g, or t
tcagagtcgagagacacgaccggtgctcgatttagagtgagctcgttgggtttggggggaagaggaagactgaccggtccccccaggagttcaggtgctgggcacagccggccctgggctgcctggtcaaggactaccttcctctctcgactctggaggcgggctggacaaggcgacatagnnnnnnnnnnnnnnnn

SEQ ID NO: 224942 - DNA, 698 bp, Homo sapiens
  misc_feature: GYAE6OF01DJP47.49.33.C11.1.454.CMB.1.raw
  modified_base (98)..(98): a, c, t, g, unknown or other
  misc_feature (98)..(98): n is a, c, g, or t
  modified_base (148)..(148): a, c, t, g, unknown or other
  misc_feature (148)..(148): n is a, c, g, or t
  modified_base (341)..(341): a, c, t, g, unknown or other
  misc_feature (341)..(341): n is a, c, g, or t
  modified_base (413)..(413): a, c, t, g, unknown or other
  misc_feature (413)..(413): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
tcagagtcgagagacacgaccggtgctcgatttagagtgagctcgttgggtttgggggaagaactgctcagttaggacccagacggaaccatggaacnccccagcgcagcttctcttcctcctgctactctggcctccagtactaccncgtaggaagaaatagtgacgtcgacgcagtcctccacgcccacctgtctgttcgtcctacggaagggaaactcgtccacctctacgtcgcgacggcctagtcaggagttcggttaggactacctaacgttcgtccgtagtactcgaacgactaacgtaaccgtcgaccgtaccgcctccgacggtcctccgtntacttgtagtcggtacgcctaccgaccgaccggacggtcctacggtcgtaccgtccgacgtcgtaggtacgnggtcgcggtacggtggtacggtcggaacgtaggtcgtcctaacgtcctactaacntacgnaccgcgtacgtacgacgttgtaacggttaagtcgtttcgttacgtacttttaaggttcttacgtgtaccgtacgtgtaaacgttcgtacgggttcccggtcgtaacccgttcgtacgttccggttaagggccggttaacggacggttcggtaaacggactaaccggtaaccgttaaacggttcggtacggtcgtactacccgttagtccttgggttcttaccccg

SEQ ID NO: 224943 - DNA, 184 bp, Homo sapiens
  misc_feature: GYAE6OF01CK1YR.49.33.C11.1.454.CMB.1.raw
  modified_base (175)..(184): a, c, t, g, unknown or other
  misc_feature (175)..(184): n is a, c, g, or t
tcagagtcgagagacacgaccggtgctcgatttagagtgagctcgttgggtttgggggaagaggaagactgaccggtccccccaggagttcaggtgctgggcacagcggccctgggctgcctggtcaaggactacttcctctctcgactctgagcgggctggcaaggcgcatagnnnnnnnnnn

SEQ ID NO: 224944 - DNA, 801 bp, Homo sapiens
  misc_feature: GYAE6OF01BDBUQ.49.33.C11.1.454.CMB.1.raw
  modified_base (439)..(439): a, c, t, g, unknown or other
  misc_feature (439)..(439): n is a, c, g, or t
tcagagtcgagagacacgaccggtgctcgatttagagtgagctcgttgggtttgggggaggaactgctcagttaggacccagacggaaccatggaacgccccagcgcagcttctcttcctcctgctactctggcctcccagactaccactggaataaatagtgatgacgctacgtctccacgccctaccctgtctgtcgtcctaccggaaggggaaatcgtccaccctctccgtggcgacgggcctagtacgaggtagttacggtaaggacgtaccgttaacgttcggtccttaggtactacgaacggaccgtaaaccggtaaacccgtcggacccgacggtaccctaccccggacggtccccttaccctacgtacgttaccgttaggttcggtacgaccttaccgtacccgaaccggacgggacctacggtcgtaccncccgacgtccgtacggttcgaggtcggacgtacgggtcggtacgacgggtactacggtacgttacccgacttcccgtaaccaaccgtacgtaccgacgtaccgtaccgtacccgtgacccgttaacgttcgtaaaggttaacgtttcgtttacgttaacttttaacgtttacgttactcggtaactaggttactaacggtttaacgtacggttcccgggtacccggttccgttaacccggtacgtttaccggggttaccgggaacggggtaaccggtaacgggttaagggtacgtaaaccggtaacgtaacggaaaccggttcggtagtaccggtcaacccgtactaccgtcgttcgttacg

SEQ ID NO: 224945 - DNA, 889 bp, Homo sapiens
  misc_feature: GYAE6OF01DE4SI.49.33.C11.1.454.CMB.1.raw
  modified_base (126)..(126): a, c, t, g, unknown or other
  misc_feature (126)..(126): n is a, c, g, or t
  modified_base (157)..(157): a, c, t, g, unknown or other
  misc_feature (157)..(157): n is a, c, g, or t
  modified_base (214)..(214): a, c, t, g, unknown or other
  misc_feature (214)..(214): n is a, c, g, or t
  modified_base (436)..(436): a, c, t, g, unknown or other
  misc_feature (436)..(436): n is a, c, g, or t
tcagagtcgagagacacgaccggtgctcgatttagagtgagctcggttggggtttgggggaggaactgctcagttaggacccagacggaaccatggaacgccccagcgcagcttctcttcctcctncctactctggcctccagataccacgtggaanaaatgtgatgacgcagtcctccacgcccaccctgtctgtcgtccacggaagggaaancgtccacccgtctcctgccgacgggcctagtcgaagtgtaggttaacggactacgtaaccgttagtccgtaggttaactccgaacgtaccgaaacggtaaacccgtcggggacccgtaccggaccctacccggaacgtccttcctactacgtttacgtagttcggtacgacctaccgtacccggaaccggtaccggtaacccgtacggtcggttaaaccccncccgtacgtaccggtaaggtttccgaggtacgggtacgggtaggggttacgggtacgtacggggtaacgtaacggttaccgtttaccgaaccgtttacctacccgaaccttcgtaaccgaaccggtaccgtaaccgtaccgtcggtaacccgtacggttaaccggtttaagttaacggtttaattttaccgtaacgttttagttttaaacttccggttacgtactaacggttactaaaggtttaaacttttaccggtaccggttttcggtttaccggtttttacgggtttaaccggggtacccggggtaaacgttaaccgggtaccggtaaggttaccgggtaaacgtaaacgggtttacccgggaaaccggttacgggttaaacccgggttcggttaaaccgggttaccgacccggttaacccggtaaaccgtttcttacccggggtttacc

SEQ ID NO: 224946 - DNA, 722 bp, Homo sapiens
  misc_feature: GYAE6OF01DLAEK.49.33.C11.1.454.CMB.1.raw
  modified_base (363)..(363): a, c, t, g, unknown or other
  misc_feature (363)..(363): n is a, c, g, or t
  modified_base (473)..(473): a, c, t, g, unknown or other
  misc_feature (473)..(473): n is a, c, g, or t
  modified_base (562)..(562): a, c, t, g, unknown or other
  misc_feature (562)..(562): n is a, c, g, or t
tcagagtcgagagacacgaccggtgctcgatttagagtgagctcggttgggtttggggggaggaactgctcagttaggacccagacggaaccatggaacgccccagcgcagtcttctccttcctcctgctactctggcctccagactaccactggaagaaatagtgatgacgcagtctccagcccacctgtctgtgtctaccggaaggggaaatcgtccaccctctcctgcgacgggcctaggtcaggtagtgttaaggacgtacaacgttacgccgtaggttacacgtacggacaacggtaaaccgtcggacccgtacggaccctacccgagtcccttcctactacttcgtacgtcggtacnccgtactcccgaaccggcggacctacgtcggtacccccgacgccgtacggtacgtaggtcggcgtaggtcgggtaggtacggatacgtcgttaccactcctacgaacctnaccgagccgtacgtccgagtacgttaggtacctaaggtagtttactttcggtaacgtttaatttacgttactacgggtacacgggttanaacgttttaacgtacgggttcccgtacccggggactttacccggtaaccggttcggtccgggggaaacggtaccggggtaaacgaggggtacccgtaaggttaacgaacgtaaacggtcggttcggacgtaccgtacgaaccgtaattcttccggttacc

SEQ ID NO: 224947 - DNA, 888 bp, Homo sapiens
  misc_feature: GYAE6OF01BHFIE.49.33.C11.1.454.CMB.1.raw
  modified_base (501)..(501): a, c, t, g, unknown or other
  misc_feature (501)..(501): n is a, c, g, or t
tcagagtcgagagacacgaccggtgctcgatttagagtgagctcgttgggtttggggagaactgctcagttaggacccagacggaaccatggaacgccccagcgacagcctttctcttcctcctgctactcgtggcctacccagtactacccgacgttgggaataaaattagtgaattacggaaccggtcgtaactcccgtacgaaccgtccctacccgttcgtcttcggttacgttcccgaacggggaaaaggggtaaacgtccgttaccctacccccgttcgttacccgacgggacccggacgggtaccctaacggtagttaaacggaaggttttcgggttaaaccgggaaacgttaaccgttaaaacggtttaccgcccggtttaggtaacttaccggaacgtaaccgtaaaacggtaacccgtcggaaccgtccgggaccgttacccccgacgtccccgttaacctacgtatttccgtaggttccgtcaccgtaccnccccggtaacggcggaccctacggttaccgaccctaccgagtcccgttaggttccgaagggttcgagggtacggttcgggaccggtggaaaaccgttcgtaacgtcccttacgtaacccgtccaaactcccgtacgacctaaccgggtacccgttacggaccggtttaccgtaggtaaacgtttacggttaacgttttacgtttacccgtttaagtttacggtttaaacttttccgtacgtagtaccgttagtaacgtttacgtacggggttcccgtacccggtaccgttaccggttacccgttacgggttaacgggacgtaacggggtactacgggacgttaacgaggttaacaggttcgaggctcacgtaccctgtcctgtaccg

SEQ ID NO: 224948 - DNA, 183 bp, Homo sapiens
  misc_feature: GYAE6OF01B5DJA.49.33.C11.1.454.CMB.1.raw
  modified_base (177)..(183): a, c, t, g, unknown or other
  misc_feature (177)..(183): n is a, c, g, or t
tcagagtcgagagacacgaccggtgctcgatttagagtgagctcgttgggtttgggggaagaggaagactgaccggtcccccaggagttcaggtgctgggcacagccgccctgggctgcctggtcaaggacttacttcctctctcgactctgacggcgggctggacaaggcacatgnnnnnnn

SEQ ID NO: 224949 - DNA, 877 bp, Homo sapiens
  misc_feature: GYAE6OF01DRHJX.49.33.C11.1.454.CMB.1.raw
tcagagtcgagagacacgaccggtgctcgatttagagtgagctcggttgggtttgggggaggaactgctcagttaggacccagacggaaccatggaacgccccagcgcagtctttcctccttcctcctgccttactctggcctaccagactacccaagtagggaaacgtaaataggtagaagtacgacggtactaggttccctaccaacgcccctacccgttggttcctggtccgtaccgtaccggaaaggggaaactcgttacccacccttctccgtgaccgtacggggacctagagtaggtagttaggtaggactacgtaacgttcgcgttaggtacacgaacgacgaaacgtaacgtcggaccagtccgaccgagtccctactacgtaacttcgtaggttacggacctaccgtaacccgtaccggaaccggtaaccgggtaacccgtacggttacggtaaaccccaccccggaagtaaccgggttacggtaacggtagggttcggaaccggttggggtttaaccggggtaccggtaaaggggtaaccttaacggggttacccgtttaacccaaaccggttcctaacccggtaaaccgttagtaccgaaccgtaaccgtacggtaccgtacggtaaccgttacggtaacgttaacggttaaacgtttcggtttaacgttaacgttttaaccgtttaacgttacggttacttaacggtacgtaacgtttaaacgttaacggttaaccggttacgggtacccggtaccgttacggtaccggtacgggttaacgggacgggtacggaacgtaggtacggtaagtaacgtacgtaaacgtcggtaggaccggtacgtaccgaacgtactgtcgttaccg

SEQ ID NO: 224950 - DNA, 730 bp, Homo sapiens
  misc_feature: GYAE6OF01CZ7TF.49.33.C11.1.454.CMB.1.raw
  modified_base (129)..(129): a, c, t, g, unknown or other
  misc_feature (129)..(129): n is a, c, g, or t
  modified_base (159)..(159): a, c, t, g, unknown or other
  misc_feature (159)..(159): n is a, c, g, or t
  modified_base (204)..(204): a, c, t, g, unknown or other
  misc_feature (204)..(204): n is a, c, g, or t
  modified_base (712)..(712): a, c, t, g, unknown or other
  misc_feature (712)..(712): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctacnctggcctccagataccactggagaaatagngatgacgcagtctccagccacctgtctgtcgtctacgaggggaangtccacctctcctgcgacggccagtcagtagtagttaggacactaactgccgtagtatcaagcaagtaaaccgtggacctacggccaccgaaggtcctaccgtcaacttcgttagtggtacaccgtactcccgacgaccggacctacgtcggtacctaccgagtccgtaggttcaggtcgtacgtaggtcggtcgtacgggactaggtcgttacacttcacactacgtacagccgtaccgtcacgtacgtgtttaacgagttaacgtttagtttacaagttttatttaacgttaccgttgtaacccgtaaggtaacctttaaagttaccgttaaggttcccggggtacccggttacgttaaccccggttaagggttaccggtttacccgggggaacggggtaaaaccgaccggggtttaaagggacccgttaaacggaaagttaaccccgggtaaaacggtttaccgtaaggggttaccgttaaccgtccggtaaaaccccgttacgnggtttaaccccggtttcc

SEQ ID NO: 224951 - DNA, 908 bp, Homo sapiens
  misc_feature: GYAE6OF01A9IDF.49.33.C11.1.454.CMB.1.raw
tcagagtcgagagacacgaccggtgctcgatttagagtgagctcgttggggtttgggggaggaactgctcagttaggacccagacggaaccatggaacgccccagcgcagcttctcttcctcctgctactctggcctaccagactaccacgtaggaagtaaagttaggtagtacgtcggaaccgtcgtacgttacctacccgaccgtaccccgtacccgttcgttccgttcggttccgttacccggtaacgggtaaaggggtaaacgtaccgttacccctacccgttccgtccgtacggaccggaccgggtacctacgtacggtaggttacggttaaggttacggaactaccgttaacgttcgttacgtagttacgtacgaacgtacgtaacgtacgtccggaccgaccgccgtaccgccggtcctaccactcgttatggtcgactacacgtaccgaccggtacgtccgtacgtccgtacccaccgtaacgtccggtacgttcgacggtcggtacggtcgggtcggttacggacggtacgtaccggtaccgttacctaccgtacccgtaccgaccgttacgacgtaccgtacgtccgtcgtacgtacgtagtaacgtaagtttacggtttacgttaacgttacgtttacgttaacgttaccgtacggttaactacgggtttaacgttaaggttaacccggtttaccggggtacccggtttacccggggttacccggttaacccgggtttacccgggttaacgggtaacccggggtaacggggtaaccggggtaacgggttaaccgggtaaacggtaacccgggttaaacggtaaccggtaaacgggttccgttaccgggttacgtaacccgttacgaacccgggttaacttccggttaccgtttaccg

SEQ ID NO: 224952 - DNA, 786 bp, Homo sapiens
  misc_feature: GYAE6OF01D6AVI.49.33.C11.1.454.CMB.1.raw
  modified_base (188)..(188): a, c, t, g, unknown or other
  misc_feature (188)..(188): n is a, c, g, or t
  modified_base (302)..(302): a, c, t, g, unknown or other
  misc_feature (302)..(302): n is a, c, g, or t
  modified_base (421)..(421): a, c, t, g, unknown or other
  misc_feature (421)..(421): n is a, c, g, or t
tcagagtcgagagacacgaccggtgctcgatttagagtgagctcggttgggtttgggggaggaactgctcagttacggacccagacggaaccatggaacgccccagcgcagtcttctcttcctcctgctactcgtcgcctcccagactaccactaggaagaaattaggtagatcggacgctacgtccnccacgccctacctgtcctgtcgtaccgtacggaaggggaaacacgtccaccgtcctccgtgcgacggcctagacgagtaggttaggtaggactactacgtacgtccgtgtaacngacgacgaacgaacgtcggacgcgcccgtaccgcgtcctacctatagtctaggtcggcaccgaccgtaccgacggcgtacgtactagtcccgaccgtcgtccggttagtacggggtcgngttacgggtcggtaggcggtaatgtaacctctaccgtacctacgaacctctacgcgcgacctcgtacgtagtacggtacgttagttacctttagtttcgttacgttttaacgtttacgtttccgttatacccggtagtaaccgttaacgtttaacggttaccggttccccgggttacccggttaaccgggttccccgggttaacggttacccggggttaacggggacccggggttaaagggttaaacccggggtaacgggtaaccggtaaacgtaaacccggttaaaccggaaacgggttaccgttaggggttacccgggtaaccttacgtaaccggttaaccgttccgtttaacggtttcccgg

SEQ ID NO: 224953 - DNA, 173 bp, Homo sapiens
  misc_feature: GYAE6OF02HR2RJ.49.33.C11.1.454.CMB.1.raw
  modified_base (170)..(173): a, c, t, g, unknown or other
  misc_feature (170)..(173): n is a, c, g, or t
tcagagtcgagagacacgaccggtgctcgatttagagtgagctcgttggtttggggaagaggaagactgacggtccccaggagttcaggtgctgggcacagcggccctgggctgcctggtcaaggactacttcctctctcgactctgagcgggctggcaaggcgcatagnnnn

SEQ ID NO: 224954 - DNA, 171 bp, Homo sapiens; identical to SEQ ID NO: 224683
  misc_feature: GYAE6OF02I6696.49.33.C11.1.454.CMB.1.raw
  modified_base (171)..(171): a, c, t, g, unknown or other
  misc_feature (171)..(171): n is a, c, g, or t

SEQ ID NO: 224955 - DNA, 180 bp, Homo sapiens
  misc_feature: GYAE6OF02IYRA9.49.33.C11.1.454.CMB.1.raw
  modified_base (169)..(180): a, c, t, g, unknown or other
  misc_feature (169)..(180): n is a, c, g, or t
tcagagtcgagagacacgaccggtgctcgatttagagtgagctcgttgggttgggaagaggaagactgacggtccccaggagttcaggtgctgggcacagcggccctgggctgcctggtcaaggactacttcctctctcgactctgagcgggctggcaaggcgcatagnnnnnnnnnnnn

SEQ ID NO: 224956 - DNA, 171 bp, Homo sapiens; identical to SEQ ID NO: 224683
  misc_feature: GYAE6OF02FNQCE.49.33.C11.1.454.CMB.1.raw
  modified_base (171)..(171): a, c, t, g, unknown or other
  misc_feature (171)..(171): n is a, c, g, or t

SEQ ID NO: 224957 - DNA, 172 bp, Homo sapiens; identical to SEQ ID NO: 224703
  misc_feature: GYAE6OF02GQ6GO.49.33.C11.1.454.CMB.1.raw
  modified_base (171)..(172): a, c, t, g, unknown or other
  misc_feature (171)..(172): n is a, c, g, or t

SEQ ID NO: 224958 - DNA, 192 bp, Homo sapiens
  misc_feature: GYAE6OF02I90SD.49.33.C11.1.454.CMB.1.raw
  modified_base (138)..(138): a, c, t, g, unknown or other
  misc_feature (138)..(138): n is a, c, g, or t
  modified_base (172)..(192): a, c, t, g, unknown or other
  misc_feature (172)..(192): n is a, c, g, or t
tcagagtcgagagacacgaccggtgctcgatttagagtgagctcgttgggtttggggaagaggaagactgacggtccccaggagttcaggtgctgggcacagcggccctgggctgcctggtcaaggctacttcctctntcgactctggagcgggctgggcaaggcgcatagnnnnnnnnnnnnnnnnnnnnn

SEQ ID NO: 224959 - DNA, 172 bp, Homo sapiens
  misc_feature: GYAE6OF02H3OOK.49.33.C11.1.454.CMB.1.raw
  modified_base (172)..(172): a, c, t, g, unknown or other
  misc_feature (172)..(172): n is a, c, g, or t
tcagagtcgagagacacgaccggtgctcgatttagagtgagctcgttgggtttggggaagaggaagactgacggtcccccaggagttcaggtgctgggcacagcggccctgggctgcctggtcaaggactacttcctctctcgactctgagcgggctggcaaggcgcatagn

SEQ ID NO: 224960 - DNA, 173 bp, Homo sapiens; identical to SEQ ID NO: 224684
  misc_feature: GYAE6OF02H84N4.49.33.C11.1.454.CMB.1.raw
  modified_base (173)..(173): a, c, t, g, unknown or other
  misc_feature (173)..(173): n is a, c, g, or t

SEQ ID NO: 224961 - DNA, 173 bp, Homo sapiens; identical to SEQ ID NO: 224684
  misc_feature: GYAE6OF02ITKRV.49.33.C11.1.454.CMB.1.raw
  modified_base (173)..(173): a, c, t, g, unknown or other
  misc_feature (173)..(173): n is a, c, g, or t

SEQ ID NO: 224962 - DNA, 171 bp, Homo sapiens
  misc_feature: GYAE6OF02IID42.49.33.C11.1.454.CMB.1.raw
  modified_base (171)..(171): a, c, t, g, unknown or other
  misc_feature (171)..(171): n is a, c, g, or t
tcagagtcgagagacacgaccggtgctcgatttagagtgagctcgttgggttggggaagaggaagactgacggtcccccaggagttcaggtgctgggcacagcggccctgggctgcctggtcaaggactacttcctctctcgactctgagcgggctggcaaggcgcatagn

SEQ ID NO: 224963 - DNA, 172 bp, Homo sapiens
  misc_feature: GYAE6OF02HANQ3.49.33.C11.1.454.CMB.1.raw
tcagagtcgagagacacgaccggtgctcgatttagagtgagctcgttgggttggggaaggaggaagactgacggtcccccacggagttcaggtgctgggcacagcggccctgggctgcctggtcaaggactacttcctctctcgactctgagcgggctggcaaggcgcatag

SEQ ID NO: 224964 - DNA, 173 bp, Homo sapiens; identical to SEQ ID NO: 224691
  misc_feature: GYAE6OF02HIY3Z.49.33.C11.1.454.CMB.1.raw
  modified_base (173)..(173): a, c, t, g, unknown or other
  misc_feature (173)..(173): n is a, c, g, or t

SEQ ID NO: 224965 - DNA, 172 bp, Homo sapiens; identical to SEQ ID NO: 224959
  misc_feature: GYAE6OF02I5M4A.49.33.C11.1.454.CMB.1.raw
  modified_base (172)..(172): a, c, t, g, unknown or other
  misc_feature (172)..(172): n is a, c, g, or t

SEQ ID NO: 224966 - DNA, 224 bp, Homo sapiens
  misc_feature: GYAE6OF02HER2S.49.33.C11.1.454.CMB.1.raw
  modified_base (168)..(224): a, c, t, g, unknown or other
  misc_feature (168)..(224): n is a, c, g, or t
tcagagtcgagagacacgaccggtgctcgatttagagtgagctcgttgggttggggaagagggaagactgacggtccccaggagttcaggtgctgggcacagcggcctgggctgcctggtcaaggctacttcctctctcgactctgagcggctggcaaggcgcatagnnnnnnnnnnnnnnnnnnnnnnnnnnnnnnnnnnnnnnnnnnnnnnnnnnnnnnnnn

SEQ ID NO: 224967 - DNA, 173 bp, Homo sapiens; identical to SEQ ID NO: 224684
  misc_feature: GYAE6OF02HLVL1.49.33.C11.1.454.CMB.1.raw
  modified_base (173)..(173): a, c, t, g, unknown or other
  misc_feature (173)..(173): n is a, c, g, or t

SEQ ID NO: 224968 - DNA, 186 bp, Homo sapiens
  misc_feature: GYAE6OF02IGYEM.49.33.C11.1.454.CMB.1.raw
  modified_base (173)..(186): a, c, t, g, unknown or other
  misc_feature (173)..(186): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnn

SEQ ID NO: 224969 - DNA, 204 bp, Homo sapiens
  misc_feature: GYAE6OF02IETPJ.49.33.C11.1.454.CMB.1.raw
  modified_base (175)..(204): a, c, t, g, unknown or other
  misc_feature (175)..(204): n is a, c, g, or t
tcagagtcgagagacacgaccggtgctcgatttagagtgagctcgttgggttttgggggaagaggaagactgacggtcccccaggagttcaggtgctgggcacagcggccctgggctgcctggtcaacggactacttcctcgtacgcactctgagcgggctggcaggcgcatagnnnnnnnnnnnnnnnnnnnnnnnnnnnnnn

SEQ ID NO: 224970 - DNA, 211 bp, Homo sapiens
  misc_feature: GYAE6OF02IRG8K.49.33.C11.1.454.CMB.1.raw
  modified_base (179)..(211): a, c, t, g, unknown or other
  misc_feature (179)..(211): n is a, c, g, or t
tcagagtcgagagacacgaccggtgctcgatttagagtgagctcggttaggggtttgggggaagaggaacgactgacggtcccccaggagttcaggtgctgggcacgacgcggccctgggctgccgtggtcaaggctacttcctctctcgactctgagcgggctggcaaggcgcatagnnnnnnnnnnnnnnnnnnnnnnnnnnnnnnnnn

SEQ ID NO: 224971 - DNA, 173 bp, Homo sapiens; identical to SEQ ID NO: 224684
  misc_feature: GYAE6OF02HJ7PZ.49.33.C11.1.454.CMB.1.raw
  modified_base (173)..(173): a, c, t, g, unknown or other
  misc_feature (173)..(173): n is a, c, g, or t

SEQ ID NO: 224972 - DNA, 173 bp, Homo sapiens; identical to SEQ ID NO: 224691
  misc_feature: GYAE6OF02GU618.49.33.C11.1.454.CMB.1.raw
  modified_base (173)..(173): a, c, t, g, unknown or other
  misc_feature (173)..(173): n is a, c, g, or t

SEQ ID NO: 224973 - DNA, 172 bp, Homo sapiens; identical to SEQ ID NO: 224959
  misc_feature: GYAE6OF02HFPAB.49.33.C11.1.454.CMB.1.raw
  modified_base (172)..(172): a, c, t, g, unknown or other
  misc_feature (172)..(172): n is a, c, g, or t

SEQ ID NO: 224974 - DNA, 174 bp, Homo sapiens; identical to SEQ ID NO: 224712
  misc_feature: GYAE6OF02JGST1.49.33.C11.1.454.CMB.1.raw
  modified_base (173)..(174): a, c, t, g, unknown or other
  misc_feature (173)..(174): n is a, c, g, or t

SEQ ID NO: 224975 - DNA, 173 bp, Homo sapiens; identical to SEQ ID NO: 224684
  misc_feature: GYAE6OF02GDSQ2.49.33.C11.1.454.CMB.1.raw
  modified_base (173)..(173): a, c, t, g, unknown or other
  misc_feature (173)..(173): n is a, c, g, or t

SEQ ID NO: 224976 - DNA, 521 bp, Homo sapiens
  misc_feature: GYAE6OF02H8785.49.33.C11.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
  modified_base (465)..(465): a, c, t, g, unknown or other
  misc_feature (465)..(465): n is a, c, g, or t
tcagagtcgagagacacgaccggtgctcgatttagagtgagctcgttgggtttgggggagaacgtgacgtcagttaggacccagacggaacatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggancaacttgctggtatcagcagaaacctggccaggctcccgaggctcctcattctatggtncatccaccgagggccactggtactcccagccaggttcagtggcagtgggtctgggacnggattcactctcacctatcagcacgctgcagtctagaagttattttgcttagtttattacttgtctagcaagttataatcggtacggcttccgactacgttcggnggtacgggacgagggtaggagatacaaacgtaacgtgtcggctgacactactctcg

SEQ ID NO: 224977 - DNA, 174 bp, Homo sapiens; identical to SEQ ID NO: 224880
  misc_feature: GYAE6OF02INXEV.49.33.C11.1.454.CMB.1.raw
  modified_base (173)..(174): a, c, t, g, unknown or other
  misc_feature (173)..(174): n is a, c, g, or t

SEQ ID NO: 224978 - DNA, 173 bp, Homo sapiens; identical to SEQ ID NO: 224691
  misc_feature: GYAE6OF02G09BS.49.33.C11.1.454.CMB.1.raw
  modified_base (173)..(173): a, c, t, g, unknown or other
  misc_feature (173)..(173): n is a, c, g, or t

SEQ ID NO: 224979 - DNA, 173 bp, Homo sapiens; identical to SEQ ID NO: 224684
  misc_feature: GYAE6OF02IF6GZ.49.33.C11.1.454.CMB.1.raw
  modified_base (173)..(173): a, c, t, g, unknown or other
  misc_feature (173)..(173): n is a, c, g, or t

SEQ ID NO: 224980 - DNA, 173 bp, Homo sapiens; identical to SEQ ID NO: 224684
  misc_feature: GYAE6OF02G15AU.49.33.C11.1.454.CMB.1.raw
  modified_base (173)..(173): a, c, t, g, unknown or other
  misc_feature (173)..(173): n is a, c, g, or t

SEQ ID NO: 224981 - DNA, 176 bp, Homo sapiens; identical to SEQ ID NO: 224756
  misc_feature: GYAE6OF02G14I4.49.33.C11.1.454.CMB.1.raw
  modified_base (173)..(176): a, c, t, g, unknown or other
  misc_feature (173)..(176): n is a, c, g, or t

SEQ ID NO: 224982 - DNA, 185 bp, Homo sapiens
  misc_feature: GYAE6OF02G30W7.49.33.C11.1.454.CMB.1.raw
  modified_base (174)..(185): a, c, t, g, unknown or other
  misc_feature (174)..(185): n is a, c, g, or t
tcagagtcgagagacacgaccggtgctcgatttagagtgagctcgttgggtttggggggaagaggaagactgacggtcccccaggagttcaggtgctgggcacagcggccctgggctgcctggtcaaggactacttcctcgtagcactctgagcgggctggcaaggcgcatagnnnnnnnnnnnn

SEQ ID NO: 224983 - DNA, 512 bp, Homo sapiens
  misc_feature: GYAE6OF02HFAJE.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctcccaggctcctcatctatggtgcatccaccagggcccactggtactcccagccaggttcagtggcaggtgggtctgtgacagacttcactctcaccatcagcagcctagagcctagaagtattctgctagttttatactgtcagcagcgtagctaactggcctctctacgtttcggcggagggaccgaagggtcggagatacgaaacgtacgtggtacggctggaccactacg

SEQ ID NO: 224984 - DNA, 571 bp, Homo sapiens
  misc_feature: GYAE6OF02GKSS6.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngtcaccctctcctgcagggccagtcagagtgttaggagcaacttagcctggtatcagcagaaacctggccaggctccaggctcctcatctatggtgcatccacagggccactggtactcccagccaggttcagtggcaggtgggtctgggacagagttcactctcacctatcagcacgcctgcagtctagaagtatttgcttagtttattacttgtcagtctaagtaattaagtcggtccgggtaccgtaccgggtacctacggtttcgggacgggtaacggggaccgtaagggtacgggaaggtaacgtaacgtaaaacggtaacgttaggtcgggtacgtacggacctaccgtagttccgttacg

SEQ ID NO: 224985 - DNA, 509 bp, Homo sapiens
  misc_feature: GYAE6OF02HP0IE.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccaggggcccactggtactcccagccaggttcaggtggcaggtgggtctgggacaggagtttcactctcaccatcagcagcctgcagtctgaagtatttgctagtttattactgtcagtctagtatagtgtccggctccggactacgttcggcggagggacgaggtggagatacgaacgacgtggtcgcgtgcactatctcg

SEQ ID NO: 224986 - DNA, 176 bp, Homo sapiens
  misc_feature: GYAE6OF02GNEOY.49.33.C11.1.454.CMB.1.raw
  modified_base (174)..(176): a, c, t, g, unknown or other
  misc_feature (174)..(176): n is a, c, g, or t
tcagagtcgagagacacgaccggtgctcgatttagagtgagctcgttgggtttgggggaagaggaagactgacggtcccaccaggagttcaggtgctgggcacagcggccctgggctgcctggtcaaggactacttcctctctcgactctgagcgggctggcaaggcgcatagnnn

SEQ ID NO: 224987 - DNA, 231 bp, Homo sapiens
  misc_feature: GYAE6OF02G68G2.49.33.C11.1.454.CMB.1.raw
  modified_base (179)..(231): a, c, t, g, unknown or other
  misc_feature (179)..(231): n is a, c, g, or t
tcagagtcgagagacacgaccggtgctcgatttagagtgagctcgttagggtttgggggaagaggaagactgacggttcccccagggagttcgaggtgctgggcacgagcggccctgggctagcctggtcaaggactacttcctctctcgactctgagcgggctggcaaggcgcatagnnnnnnnnnnnnnnnnnnnnnnnnnnnnnnnnnnnnnnnnnnnnnnnnnnnnn

SEQ ID NO: 224988 - DNA, 177 bp, Homo sapiens; identical to SEQ ID NO: 224820
  misc_feature: GYAE6OF02GP243.49.33.C11.1.454.CMB.1.raw
  modified_base (173)..(177): a, c, t, g, unknown or other
  misc_feature (173)..(177): n is a, c, g, or t

SEQ ID NO: 224989 - DNA, 178 bp, Homo sapiens
  misc_feature: GYAE6OF02IOUEN.49.33.C11.1.454.CMB.1.raw
  modified_base (173)..(178): a, c, t, g, unknown or other
  misc_feature (173)..(178): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 224990 - DNA, 502 bp, Homo sapiens
  misc_feature: GYAE6OF02GNTC7.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagtatttgctagtttattactgtcagcagtataatgtccggctccggactacgttcggcggaggaccgaaggtggagatacgaaacgtacgtgtggctgcactatcgtcg

SEQ ID NO: 224991 - DNA, 194 bp, Homo sapiens
  misc_feature: GYAE6OF02IBP5K.49.33.C11.1.454.CMB.1.raw
  modified_base (175)..(194): a, c, t, g, unknown or other
  misc_feature (175)..(194): n is a, c, g, or t
tcagagtcgagagacacgaccggtgctcgatttagagtgagctcgttgggtttgggggaaggaggaagactgacggtcccccaggagttcaggtgctgggcaccagcggccctgggctgcctggtcaaggactacttcctctctcgactctgagcgggctggcaaggcgcatagnnnnnnnnnnnnnnnnnnnn

SEQ ID NO: 224992 - DNA, 173 bp, Homo sapiens; identical to SEQ ID NO: 224684
  misc_feature: GYAE6OF02HF2MB.49.33.C11.1.454.CMB.1.raw
  modified_base (173)..(173): a, c, t, g, unknown or other
  misc_feature (173)..(173): n is a, c, g, or t

SEQ ID NO: 224993 - DNA, 173 bp, Homo sapiens; identical to SEQ ID NO: 224684
  misc_feature: GYAE6OF02GHCFL.49.33.C11.1.454.CMB.1.raw
  modified_base (173)..(173): a, c, t, g, unknown or other
  misc_feature (173)..(173): n is a, c, g, or t

SEQ ID NO: 224994 - DNA, 515 bp, Homo sapiens
  misc_feature: GYAE6OF02GTWK7.49.33.C11.1.454.CMB.1.raw
tcagagtcgagagacacgaccggtgctcgatttagagtgagctcgttgggtttgggggagggtaactgctcagttaggacccagacggaaccatggaagccccagcgcagcttctcttcctcctgctactctggctcccagataccactggagaaatagtgatgacgcagtctccagccaccctgtctgtgtctccagggggaaagagtcaccctctcctgcagggccaggtcagagtgttaggagcaacttagcctggtatcagcagaaacctggccaggctccaggctcctcatctatggtgcatccaccagggccactggtatcccagccagttcagtgcagtggtctgggacagagttcactctcacatcagcacgcctgcagtctagaagtatttgctagtttattctgtacagcagtataatgtccggctccggactacgtttcggcggaggaccgtaagggtggagaactacgaaacggacgtggtcggcgtcgacacctagtcttcg

SEQ ID NO: 224995 - DNA, 499 bp, Homo sapiens
  misc_feature: GYAE6OF02HFHEH.49.33.C11.1.454.CMB.1.raw
  modified_base (301)..(301): a, c, t, g, unknown or other
  misc_feature (301)..(301): n is a, c, g, or t
  modified_base (494)..(494): a, c, t, g, unknown or other
  misc_feature (494)..(494): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagtcaccctctcctgcagggccagtcagagtgttaggagcaacttagcctggtatcagcagaacctggccaggctcccaggctcctcatctatggtncatccaccagggccactggtactcccagccaggttcagtggcaggtgggtctgggacagagttcactctcacatcagcagcctgcagtctagaagtatttgctagtttattactgtcagcagtatatgtccgggctccggactacgttcggcggaggacaggtggagtatacgaacgactggtcggctgcacntctcg

SEQ ID NO: 224996 - DNA, 174 bp, Homo sapiens; identical to SEQ ID NO: 224712
  misc_feature: GYAE6OF02FYQIS.49.33.C11.1.454.CMB.1.raw
  modified_base (173)..(174): a, c, t, g, unknown or other
  misc_feature (173)..(174): n is a, c, g, or t

SEQ ID NO: 224997 - DNA, 499 bp, Homo sapiens
  misc_feature: GYAE6OF02GTDN2.49.33.C11.1.454.CMB.1.raw
  modified_base (440)..(440): a, c, t, g, unknown or other
  misc_feature (440)..(440): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagtatttgctagtttattactgtcagcagtatatcgtcggctccgacncttcggcggaggacgaaggtcggagatacgaaacgtactgtacggctgacgacatctcg

SEQ ID NO: 224998 - DNA, 177 bp, Homo sapiens; identical to SEQ ID NO: 224820
  misc_feature: GYAE6OF02I2V91.49.33.C11.1.454.CMB.1.raw
  modified_base (173)..(177): a, c, t, g, unknown or other
  misc_feature (173)..(177): n is a, c, g, or t

SEQ ID NO: 224999 - DNA, 755 bp, Homo sapiens
  misc_feature: GYAE6OF02J3930.49.33.C11.1.454.CMB.1.raw
  modified_base (452)..(452): a, c, t, g, unknown or other
  misc_feature (452)..(452): n is a, c, g, or t
tcagagtcgagagacacgaccggtgctcgatttagagtgagctcgttgggtttgggggagaactgctcagttaggacccagacggaaccatggaagccccagcgcagcttctcttcctcctgctactctggcctcccaagataccactggagaaatgtgatcgacgctacgtcctcccacgcctacctgtctgtacgtctaccggaagggtaactctccaccctctccgtgcgacggcctagtcgaggtagtagtacggactctaacgttcgccgttaggtactacgacgaccaacggtaacccgtcggacccgtacggtcccttaccccgacggtacccttccgtacgtacttcgtaacggtcggtaccaccgtacccgtacccgaaccggtaaccgggtccctaacggttaccggtaaccctaccccggaggtccggttaaggttaccgngggtaccggtacggtacgggtttccgggtacgtaacgggggtaacctacgggtaccttacccgtaccttcccgtaccgaccgtacgtaccgcgtaccgtacgtcgtacgtaccgtagttacgtaagttaaacgttcgtttacgtacgttttaacgttacgttacgtacgtacgtagtaacgttagttacgttaccggtccggtaccgtacgtaccggtactaccgggtacggacggtaagtacgtaggacgaacgtacgtacgtaacgtcgtacgtcgtccgtaccgctacgttctcgttacc

SEQ ID NO: 225000 - DNA, 185 bp, Homo sapiens
  misc_feature: GYAE6OF02J24YY.49.33.C11.1.454.CMB.1.raw
  modified_base (171)..(185): a, c, t, g, unknown or other
  misc_feature (171)..(185): n is a, c, g, or t
tcagagtcgagagacacgaccggtgctcgatttagagtgagctcgttggtttgggggaagaggaagactgacggtccccaggagttcaggtgctgggcacagcggccctgggctgcctggtcaaggactacttcctctctcgactctgagcgggctggcaaggcgcatagnnnnnnnnnnnnnnn

SEQ ID NO: 225001 - DNA, 175 bp, Homo sapiens; identical to SEQ ID NO: 224707
  misc_feature: GYAE6OF02GLMPX.49.33.C11.1.454.CMB.1.raw
  modified_base (173)..(175): a, c, t, g, unknown or other
  misc_feature (173)..(175): n is a, c, g, or t

SEQ ID NO: 225002 - DNA, 492 bp, Homo sapiens
  misc_feature: GYAE6OF02IQKQH.49.33.C11.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctcccaggctcctcatctatggtncatccaccagggccactggtatcccagccaggttcagtgcagtgggtctgggacagagttcactctcaccatcagcagcctgcagtctagaagatttgctagtttatctgtcagcagtataatgtccggctccgactacgtttcggcgaggaccaggtggaacgatcaaacgactgngctgcacatntacg

SEQ ID NO: 225003 - DNA, 173 bp, Homo sapiens; identical to SEQ ID NO: 224684
  misc_feature: GYAE6OF02GI13E.49.33.C11.1.454.CMB.1.raw
  modified_base (173)..(173): a, c, t, g, unknown or other
  misc_feature (173)..(173): n is a, c, g, or t

SEQ ID NO: 225004 - DNA, 567 bp, Homo sapiens
  misc_feature: GYAE6OF02F3QE3.49.33.C11.1.454.CMB.1.raw
  modified_base (203)..(203): a, c, t, g, unknown or other
  misc_feature (203)..(203): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaaacctggccaggctcccaggcctcctcatctatggtgcactccaccgaggggcccacgttggtactccccgagcccgtaggttcaggtcggcagggtgggtcgtggggacaggtagttcactctcaccatcagcagcctgcagtcngtaagtntttgctagtttattactgtcagctagtataagtggtcccggtcgttacccggactaccggtttcgggacgggtacgggtaccgtaagggtggtaaggacttaccgaaacgtaacttgggtacggcgtacgaccgtacctacgttcttacg

SEQ ID NO: 225005 - DNA, 509 bp, Homo sapiens
  misc_feature: GYAE6OF02GXC25.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctcccaggctcctcatctatggtgcatccaccagggccactggtactcccagccaggttcagtggcaggtgggtctgggacagagttcactctcaccatcagcacgcctgcagtctgaagtattttgactagtttattacttgtcagtctagtatagtgtccggtctccggactacgttcggcggaggacgaggtggaagatacgaacgtacgtggtgctgacactatctcg

SEQ ID NO: 225006 - DNA, 176 bp, Homo sapiens; identical to SEQ ID NO: 224756
  misc_feature: GYAE6OF02GG8QQ.49.33.C11.1.454.CMB.1.raw
  modified_base (173)..(176): a, c, t, g, unknown or other
  misc_feature (173)..(176): n is a, c, g, or t

SEQ ID NO: 225007 - DNA, 191 bp, Homo sapiens
  misc_feature: GYAE6OF02FS5PP.49.33.C11.1.454.CMB.1.raw
  modified_base (171)..(191): a, c, t, g, unknown or other
  misc_feature (171)..(191): n is a, c, g, or t
tcagagtcgagagacacgaccggtgctcgatttagagtgagctcgtgggttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnn

SEQ ID NO: 225008 - DNA, 500 bp, Homo sapiens
  misc_feature: GYAE6OF02IVCXJ.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatgatgcatccaccagggccactggtatcccagccaggttcagtggcagtggtctgggacagagttcactctcaccatcagcagcctgcagtctgaagtattttgctagttttattacttgtcagcagcgtagcaactggcctctcactttcggcgagggaccgaagggtggagatacgaacgtaacgtggtggctgccactacg

SEQ ID NO: 225009 - DNA, 517 bp, Homo sapiens
  misc_feature: GYAE6OF02HBV3D.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatgttgcatccaccgagggccactggtactccccagccaggttcaggtggcaggtgggtctggggacagagttcactctcaccatcagcagcctgcagtctgaagtatttgctagtttattactgtcagctagttataattactggtctttcgttttggccgtagggtacaagcgtaggagagtacgaagacgaacttggtggctcgaccacgtatcgttcg

SEQ ID NO: 225010 - DNA, 530 bp, Homo sapiens
  misc_feature: GYAE6OF02IIYGD.49.33.C11.1.454.CMB.1.raw
  modified_base (203)..(203): a, c, t, g, unknown or other
  misc_feature (203)..(203): n is a, c, g, or t
  modified_base (396)..(396): a, c, t, g, unknown or other
  misc_feature (396)..(396): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcaagaacctggccaggctcccaggctcctcatctatggtgcatccacagggccatggtactccagccaggttcagtgcaggtgggtctgtgacagacttcactctcacatcagcagtcctagacgcctagaagtnttctgacttagtttaacttacgtgtctagcaaggcgtacgactaacgtcgtccttactcctacgtttcgggacggtacgggaccgtaagggtggagtaactacgaaacgtacgtggtacggctggaccactacg

SEQ ID NO: 225011 - DNA, 499 bp, Homo sapiens
  misc_feature: GYAE6OF02GTOCL.49.33.C11.1.454.CMB.1.raw
  modified_base (397)..(397): a, c, t, g, unknown or other
  misc_feature (397)..(397): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtactcccagccaggttcagtggcaggtgggtctgggacagagttcactctcacatcagcagcctgcagtctgaagtntttgctagtttattactgtcagctagtatatgtccggctccggactacgttcggcggaggaccgaggtggagatacgaacgtatggtgcgtgacacatctcg

SEQ ID NO: 225012 - DNA, 174 bp, Homo sapiens
  misc_feature: GYAE6OF02HJLZ2.49.33.C11.1.454.CMB.1.raw
  modified_base (173)..(174): a, c, t, g, unknown or other
  misc_feature (173)..(174): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactcgagcgggcgtggcaaggcgcatagnn

SEQ ID NO: 225013 - DNA, 524 bp, Homo sapiens
  misc_feature: GYAE6OF02FF6YQ.49.33.C11.1.454.CMB.1.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgccagggccagtcagagtgttaggagcaacttagcctggtatcagcagaacctggccaggctccaggctccncatctatggtncatccaccgagggccacgtggtactcccagcctaggttcaggtggcaggtgggtctgggacaggacgtttcactctacacatcagcacgcctgcagtctagaagtattttgctagttttatactgtacagtctagtataagtcgtccgggtctccggactacgttcgggcggacggacgaaggtggaagatacgaaacgacgtggtcgcgtcgacacctatctcg

SEQ ID NO: 225014 - DNA, 821 bp, Homo sapiens
  misc_feature: GYAE6OF02F20BR.49.33.C11.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggcctccgagcctctcatctagtggtcnctactccaaccgacgggcccacgtggtactcccgagccctaggttcaggtggacgtaggttcgggtcgtacggggaacaggtacggtttaccaaccgttccgtaccaacccgtacttacccgaacggtaccaacggtccccgttaggacccgtaacggttacccgttaagggtaaacggtttacgttttttacggtaaccgtttaacgggtttttttaaactttaaccgtttacggttaccgtaacggtaccgttaaaggtttaaacgtttaaacggttttaccggggttaccccggggttacccggtttaccccggggtaaacccgtttaacccgggttttttacccgggggaacccgggggttaaccgggggtaacccggtaaagggggttaccggggtaaacgggtaaaccgttaaaccccgggaaaaacccggttaaccggtttaacggggttaccgggtaacccggtttaccgggaacccctaaacccggttacgtttacccggtttacccgg

SEQ ID NO: 225015 - DNA, 174 bp, Homo sapiens; identical to SEQ ID NO: 224880
  misc_feature: GYAE6OF02F6Z0K.49.33.C11.1.454.CMB.1.raw
  modified_base (173)..(174): a, c, t, g, unknown or other
  misc_feature (173)..(174): n is a, c, g, or t

SEQ ID NO: 225016 - DNA, 518 bp, Homo sapiens
  misc_feature: GYAE6OF02HSW2R.49.33.C11.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngtcaccctctcctgcagggccagtcagagtgttaggancaacttagcctggtatcagcagaacctggccaggctccaggctccncatctatggtncatccaccngggccactggtactcccagccaggttcagtggcaggtgggtctgggacagagttcacgtctcacccatcagcagcctgcagtctgaagtatttgacttagtttattactgtcagtctagtataagtcgtccgggctaccggtactacgttcgggcggagggaccgtaagggtggaagatacgaaacgtaacgtggtggctgcactatctg

SEQ ID NO: 225017 - DNA, 647 bp, Homo sapiens
  misc_feature: GYAE6OF02HQ39K.49.33.C11.1.454.CMB.1.raw
  modified_base (304)..(304): a, c, t, g, unknown or other
  misc_feature (304)..(304): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagaaatagtgatgacgcagtctccagccaccctgtctgtgtctccgaagggggaaagagtcacccctctcctgcagggccagtcagagtgttaggagcaacttagcctggtatcagacagaacctggccagctcccaggctcctacatctatggtncatcccacgacgggccaacgtggtactccccgagccgtaaggttcaggtcggcgaggtgggggtcaggggaacagaagtttcacgtcctacaccatacgacgacgacgcctagcacgtactaggtaagtagttttcgacgttaagtttattaccgttagtacgaaggtcgtaacgttaattaacgtcgggtacccgggtccgttaccggtaaccgtacggttttaccgggacgggaaccgggaccggtaagggttacgggaacgggtaacttaaaccgggaaaaccgttaaaccgggtcggttagggaccgttaccggaacctaccgtacgttccgtttacgg

SEQ ID NO: 225018 - DNA, 174 bp, Homo sapiens; identical to SEQ ID NO: 224712
  misc_feature: GYAE6OF02F55HR.49.33.C11.1.454.CMB.1.raw
  modified_base (173)..(174): a, c, t, g, unknown or other
  misc_feature (173)..(174): n is a, c, g, or t

SEQ ID NO: 225019 - DNA, 174 bp, Homo sapiens; identical to SEQ ID NO: 224880
  misc_feature: GYAE6OF02I7AIU.49.33.C11.1.454.CMB.1.raw
  modified_base (173)..(174): a, c, t, g, unknown or other
  misc_feature (173)..(174): n is a, c, g, or t

SEQ ID NO: 225020 - DNA, 526 bp, Homo sapiens
  misc_feature: GYAE6OF02HLDGF.49.33.C11.1.454.CMB.1.raw
  modified_base (359)..(359): a, c, t, g, unknown or other
  misc_feature (359)..(359): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtccaccctctcctgcagggccagtcagagtgttaggagcaacttagcctggtatcagcagaacctggccaggctcccaggctcctcatctatggtgcatccacagggccacgtggtatccccagccaggttcagtgcagtgggtctgggacagngttcactctcaccatcagcagcctgcagtctgaagtatttgactagtttattactgtcagctagttataagtcgtaccgggcgttaccggactacgttcgggacgggacgggtaccgaagggtcggaagactacgaaacgtacgtggtaggcgtgacacctatctcg

SEQ ID NO: 225021 - DNA, 173 bp, Homo sapiens; identical to SEQ ID NO: 224691
  misc_feature: GYAE6OF02HQV8Y.49.33.C11.1.454.CMB.1.raw
  modified_base (173)..(173): a, c, t, g, unknown or other
  misc_feature (173)..(173): n is a, c, g, or t

SEQ ID NO: 225022 - DNA, 174 bp, Homo sapiens; identical to SEQ ID NO: 224712
  misc_feature: GYAE6OF02IKBVU.49.33.C11.1.454.CMB.1.raw
  modified_base (173)..(174): a, c, t, g, unknown or other
  misc_feature (173)..(174): n is a, c, g, or t

SEQ ID NO: 225023 - DNA, 173 bp, Homo sapiens
  misc_feature: GYAE6OF02IWN1O.49.33.C11.1.454.CMB.1.raw
  modified_base (172)..(173): a, c, t, g, unknown or other
  misc_feature (172)..(173): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactactcctctctcgactctgagcgggctggcaaggcgcatagnn

SEQ ID NO: 225024 - DNA, 595 bp, Homo sapiens
  misc_feature: GYAE6OF02GH4F2.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggctcccaggctcctcatctatggtgcatccaccaggggccactggtactccccagccgaggttcaggtggcaggtcgggtcgtgggacaggtagttcacttctccaccatcagcacgcctgcagtctagaagttatttggcttaagttttacttacgttgtacagtactagttaattaagtcgtaccgtaggtccgtacccggtacttaccggtttccgggacgggtacgggtaccgtaaggggtgggaacggtaacgtaaccgtaaaccggtaacgttacggtacgggtaccgtacggacccgtaccgtagttaccgg

SEQ ID NO: 225025 - DNA, 514 bp, Homo sapiens
  misc_feature: GYAE6OF02GM53L.49.33.C11.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngtcaccctctcctgcagggccagtcagagtgttaggagcaacttagcctggtatcagcagaaacctggccaggctcccaggctcctcatctatggtncatccaccagggccactggtactcccagccaggttcagtgcagtgggtctgggacagagttcactctcaccatcagcagcctgcagtctagaagtattttgctagtttattactgtcagcagtatatgtccggtctcggactacgttcggacggtacgggacgtaaggtggagtagtacgaaacgtacgtagtcggtcgtgcacctatcttcg

SEQ ID NO: 225026 - DNA, 173 bp, Homo sapiens; identical to SEQ ID NO: 224684
  misc_feature: GYAE6OF02F0UKI.49.33.C11.1.454.CMB.1.raw
  modified_base (173)..(173): a, c, t, g, unknown or other
  misc_feature (173)..(173): n is a, c, g, or t

SEQ ID NO: 225027 - DNA, 567 bp, Homo sapiens
  misc_feature: GYAE6OF02GPI8X.49.33.C11.1.454.CMB.1.raw
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
tcagagtcgagagacacgaccggtgctcgatttagagtgagctcgttgggtttgggggtagggaacgtgctcagttaggacccagacggaaccatggaagccccagcgcagcttctcttcctcctgctactctggctcccagataccactggagaaatagtgatgacgcagtctccagccaccctgtctgtgtctccaggggaaagngtcaccctctcctgcagggccagtcagagtgttaggagcaacttagcctggtatcagcagaaacctggccaggctcccaggctcncatctatgtgcatccacaggccatggtactccagccaggttcagtcgggcaggtcggtctggggacagatttcactcgtcaacctntacagcgancctgcagtctagtaagttagtttgcttagtttacttacgtagtactacgtctagtattagtcggtaccggtcgtaccggtaactaccgttcggaccgggtacgggtacgtaacgggtacgggtaagtacgtaaccgaaacgtaacgtcggtacggtacgtacgacctaccgtacgtgtcg

SEQ ID NO: 225028 - DNA, 220 bp, Homo sapiens
  misc_feature: GYAE6OF02GVH7X.49.33.C11.1.454.CMB.1.raw
  modified_base (184)..(220): a, c, t, g, unknown or other
  misc_feature (184)..(220): n is a, c, g, or t
tcagagtcgagagacacgaccggtgctcgatttagagtgagctcgttcgggtttgggggaagaggaagactggacggtccccccaggagttcaggtgtctggggcacagcggccctgggcgtgccgtggtccaagggactacttcctctctccgactctgagcgggctggcaaggcgcactagnnnnnnnnnnnnnnnnnnnnnnnnnnnnnnnnnnnnn

SEQ ID NO: 225029 - DNA, 539 bp, Homo sapiens
  misc_feature: GYAE6OF02IZ5VA.49.33.C11.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (300)..(300): a, c, t, g, unknown or other
  misc_feature (300)..(300): n is a, c, g, or t
  modified_base (406)..(406): a, c, t, g, unknown or other
  misc_feature (406)..(406): n is a, c, g, or t
  modified_base (535)..(535): a, c, t, g, unknown or other
  misc_feature (535)..(535): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccaggggaaangtcaccctntcctgcagggccagtcagagtgttaggagcaacttagcctggtatcgagcagaacctggccaggctccgaggcctcctcatctatggtncatccacgagggccacgtggtactcccagcctaggttcagtcggcaggtgggtctgggacaggtgttcactctcactatcgagcagcctgcacgtctagtaacgtntttgacttagtttacttacgtgtcagtcgtagtcgtagctaacgtcggaccttcgtactacgtttcggaccggtaggaccgtaagggtggacgtagtaacgaacgtacgtgtacggctcggactacctntccg

SEQ ID NO: 225030 - DNA, 563 bp, Homo sapiens
  misc_feature: GYAE6OF02F8811.49.33.C11.1.454.CMB.1.raw
  modified_base (204)..(204): a, c, t, g, unknown or other
  misc_feature (204)..(204): n is a, c, g, or t
  modified_base (411)..(411): a, c, t, g, unknown or other
  misc_feature (411)..(411): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacttagcctggtatcagcaagaaacctggccaggcctcccaggcctcctcatctatggtgcactccaccgagggccacgtggtactcccgagccaggttcagtggcaggtgggtctgggacagtagttcactctacacctatcagcacgcctgcagtctagtaagtntttgactagtttacttacttgtcagtactagttataagtcggtccggtccgttccggactacggtttcgggacggtacgggtaccgtaagggtcggaacgtacgtacgaaacgtacgtaggtacggtcgtacgacctaccgtagtcgttacg

SEQ ID NO: 225031 - DNA, 175 bp, Homo sapiens; identical to SEQ ID NO: 224707
  misc_feature: GYAE6OF02GYBDU.49.33.C11.1.454.CMB.1.raw
  modified_base (173)..(175): a, c, t, g, unknown or other
  misc_feature (173)..(175): n is a, c, g, or t

SEQ ID NO: 225032 - DNA, 530 bp, Homo sapiens
  misc_feature: GYAE6OF02GYFLI.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttaggagcaacttagcctggtatcagcagaaacctggccaggctcccaggcctcctcatctatggtgcatccacgagggccactggtactccccagccaggttcaggtggctaggtgggtctggggactaggtagttccactcctacaacctatcagcacgcctgcagtctagtaagtatttcgcttagtttattactgtactagctagtaatagtcgtccggcttccgactacgttcggcggaggacgtaggtgaggtatacgaaacgtacgtggtcggctgacactatctcg

SEQ ID NO: 225033 - DNA, 227 bp, Homo sapiens
  misc_feature: GYAE6OF02F1MLY.49.33.C11.1.454.CMB.1.raw
  modified_base (178)..(184): a, c, t, g, unknown or other
  misc_feature (178)..(184): n is a, c, g, or t
  modified_base (186)..(227): a, c, t, g, unknown or other
  misc_feature (186)..(227): n is a, c, g, or t
tcagagtcgagagacacgaccggtgctcgatttagagtgagctcggtttggggtttgggggaagaggaagactgacggtccccccaggagttcaggtgacctgggcacagcggccctgggctgcctggtcaaggctacttcctctctcgactctgagcgggctggcaaggcgcatagnnnnnnngnnnnnnnnnnnnnnnnnnnnnnnnnnnnnnnnnnnnnnnnnn

SEQ ID NO: 225034 - DNA, 174 bp, Homo sapiens; identical to SEQ ID NO: 224712
  misc_feature: GYAE6OF02IOBOF.49.33.C11.1.454.CMB.1.raw
  modified_base (173)..(174): a, c, t, g, unknown or other
  misc_feature (173)..(174): n is a, c, g, or t

SEQ ID NO: 225035 - DNA, 592 bp, Homo sapiens
  misc_feature: GYAE6OF02JCSX7.49.33.C11.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (310)..(310): a, c, t, g, unknown or other
  misc_feature (310)..(310): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggancaacttagcctggtatcagcagaaacctggccaggctcccaggcctcctcatctatggtgcatccaccngggccactggtactcccagccaggttcagtggcaggtcgggtctggggacaggtacgttcacttctcactatcgacgcgacgtcctcgctacgttctaggtaagttcttttgacgttagttttacttactgtacagtcgtaagttattaacgtcgtcccgggcttcccggaacttcgtttccgggacgggtaacgggtaccgaaggggtacggaaggtactaaccgtaaaacggtacgttagggtacgggcttacggacctaacccggtagttcccgttacg

SEQ ID NO: 225036 - DNA, 570 bp, Homo sapiens
  misc_feature: GYAE6OF02I0SIE.49.33.C11.1.454.CMB.1.raw
  modified_base (203)..(203): a, c, t, g, unknown or other
  misc_feature (203)..(203): n is a, c, g, or t
  modified_base (387)..(387): a, c, t, g, unknown or other
  misc_feature (387)..(387): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaaacctggccaggctcccaggcctcctcatctatggtgcatccaccgagggcccagtggtaactccccagccaggttcaggtcggcaggtcgggtctggggacaggtagttccactctacaccntcagcagcctgcagtctagaagtattttgacttagttttacttacttgtacagtacaagttaattaagtcggtaccgggtctaccggtactacgtttcgggacggtacggacgtaagggtggaacgtacgtaacgaaacgtaacgtcggtacggaccgttagacctaacgtagttccgttacg

SEQ ID NO: 225037 - DNA, 513 bp, Homo sapiens
  misc_feature: GYAE6OF02G20PU.49.33.C11.1.454.CMB.1.raw
  modified_base (203)..(203): a, c, t, g, unknown or other
  misc_feature (203)..(203): n is a, c, g, or t
  modified_base (396)..(396): a, c, t, g, unknown or other
  misc_feature (396)..(396): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaaacctggccaggctccaggctcctcatctatggtgcatccacgagggccacgtggtactcccagccaggttcagtggcagtgggtctgggacagagttcactctcacatcagcagcctgcagtctagaagtntttgctagtttatactgtcagcgtagttataagtcggtccggctccggactacgttcgggcggaggaccgtaggtcggaagatacgaaacgtacgtgtggctcgacacctatctacg

SEQ ID NO: 225038 - DNA, 596 bp, Homo sapiens
  misc_feature: GYAE6OF02GG4TA.49.33.C11.1.454.CMB.1.raw
  modified_base (204)..(204): a, c, t, g, unknown or other
  misc_feature (204)..(204): n is a, c, g, or t
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttaggagcaacttgcctggtatcagcaagaaacctggccaggcctcccaggcctcctcatctatggtgcactcccacgacgggccacgttggtactccccgagccctaggttcaggtcggctaggtgggtcgtagggacaggtacgttccacttctaccaccatccaagccacgcctggctagtctagaagtntttgcttagtttactactgtnagtntagtaattagtcggtccggtctaccggtactaccggttcgggcgggtaacgggtaccgtaaggggtacggtaaggtaccgttaaccgaaaaccggtacgttagggtcggaccttccggaacctacccgtagttaccgttcgg

SEQ ID NO: 225039 - DNA, 525 bp, Homo sapiens
  misc_feature: GYAE6OF02HD9F6.49.33.C11.1.454.CMB.1.raw
  modified_base (203)..(203): a, c, t, g, unknown or other
  misc_feature (203)..(203): n is a, c, g, or t
  modified_base (354)..(354): a, c, t, g, unknown or other
  misc_feature (354)..(354): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttgcctggtatcagcagaaacctggccaggctcccaggctcctcatctatggtgcatccaccaggggccactggtactcccagccaggttcaggtggcaggtgggtcngggacagtagttcactctcacatcagcagcctgcagtctagaagtattttgacttagtttatacttgtacagcagttatagtcggtccgggctccggactcgttcgggcggacgggacgagggtggagtactacgaaacgtacgtggtacggtcgtcgacacctagtctcg

SEQ ID NO: 225040 - DNA, 173 bp, Homo sapiens; identical to SEQ ID NO: 224684
  misc_feature: GYAE6OF02JDMZ6.49.33.C11.1.454.CMB.1.raw
  modified_base (173)..(173): a, c, t, g, unknown or other
  misc_feature (173)..(173): n is a, c, g, or t

SEQ ID NO: 225041 - DNA, 178 bp, Homo sapiens
  misc_feature: GYAE6OF02HN7PF.49.33.C11.1.454.CMB.1.raw
  modified_base (170)..(178): a, c, t, g, unknown or other
  misc_feature (170)..(178): n is a, c, g, or t
tcagagtcgagagacacgaccggtgctcgatttagagtgagctcgttgggttgggggaagaggaagactgacggtcccccaggagttcaggtgctggcacagcggcctgggctgcctggtcaaggactacttcctctctcgactctgagcgggctggcaaggcgcatagnnnnnnnnn

SEQ ID NO: 225042 - DNA, 595 bp, Homo sapiens
  misc_feature: GYAE6OF02IXNZ5.49.33.C11.1.454.CMB.1.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgtaggagcaacttagcctggtatcagcagaaacctggaccaggcctccaggcctcctcatctatggtgcatccaccagggccacgtggtactcccgagccgaggttcaggtggcgtaggtcgggtctggggacagngttccactctcaccntcagcagcctgcagtctagaagtattttagcttagtttacttacgttgtctacggtctaagttattaacgttcggttccgggtaccttcccgggtaaccgttacggttttccggggaccggggtaagggacccggtaaacgggtgggtaaggtaacgtaaccgtaaaacggtaacgttggtacggtacgtggacccaccgtatccgttcg

SEQ ID NO: 225043 - DNA, 519 bp, Homo sapiens
  misc_feature: GYAE6OF02FWUYI.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggcctcctcatctatggtgcatccacagggccatggtactcccagccaggttcaggtgctaggtgggtctgggacagagttcactctacaccatcagcagcctgcagtctagaagtagttttgacttagtttattactgtactagctagtataagtcgtccgggtcgtccgactacgttcggacggacgggacgaaggtggagtatacgaacgagtagtcggcgtgcacactagtc

SEQ ID NO: 225044 - DNA, 548 bp, Homo sapiens
  misc_feature: GYAE6OF02I01VZ.49.33.C11.1.454.CMB.1.raw
  modified_base (204)..(204): a, c, t, g, unknown or other
  misc_feature (204)..(204): n is a, c, g, or t
  modified_base (400)..(400): a, c, t, g, unknown or other
  misc_feature (400)..(400): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacttagcctggtatcagcagaacctggccaggctccaggctcctcatctatggtgcatccaccagggcccagtggtactcccagccaggttcagtggctaggtggtctggggacagagttcacgtctccacatcagcagcctgcagtcgtgaagtnttttgcttagtttattactgtcagtactaagttataagtcggtccggtcgttccggtactacgttcgggcggacgggtaccgaagggtcggaaggtacgtaacgaaacggtacgttaggtacggctacggacctaccgtagtcttacg

SEQ ID NO: 225045 - DNA, 673 bp, Homo sapiens
  misc_feature: GYAE6OF02H6ND7.49.33.C11.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
tcagagtcgagagacacgaccggtgctcgatttagagtgagctcgttgggtttgggggtaggaacgtgctcagttaggacccagacggaaccatggaagcccagcgcagcttctcttcctcctgctactctggctcccagataccactggagaaatagtgatgacgcagtctccagcccaccctgtctgtgtcctaccgaggggaaancgtcaccctctcctgcagggccagtcagagtgtaggnctaatagctggtatcagcaagaacctggccaggtcctcccgaggcctcctcagttctagtggtnccattccaccgagggcccagtggtactcccgagacctaggtccaggtcggacctaggttcgggctaggggaactggacgtttccaacgttccgtacaccgtattccgacgccgtaacggtcctacgtacgtaacgttcgttaacgtaaaggttactttttaggaacgtttaacggttttaaacttaccgttcgttaacgtacgtaaccgtaggttaactaacgttcgggtcccggtaccgttaccgtaccgttaacggttccgggtacgggtaccgggtaccggtaagggtcggaacgttaacgtaccgtaaaacgggtaaccgttggtacggacgttcgtaccggtacctaggttccttacgg

SEQ ID NO: 225046 - DNA, 531 bp, Homo sapiens
  misc_feature: GYAE6OF02G41AM.49.33.C11.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgaggggaaanagtcaccctctcctgcagggccagtcagagtgtaggagcaacttgcctggtatcagcagaacctggccaggctcccaggcctcctnatctatggtncatccaccngggccagtggtactcccagccaggttcaggtgcaggtgggtctggggacagagttcactctacaccatcagcagcctgctagtctaggaagttactttacgtagttttattacgttgtactagctaagtataagtcgtccggtctccggtactacgttcggacggtacggaccgagggtgagataacgaacgtagtcggtgtactcgaccacgtatctgttac

SEQ ID NO: 225047 - DNA, 608 bp, Homo sapiens
  misc_feature: GYAE6OF02FZOPY.49.33.C11.1.454.CMB.1.raw
  modified_base (139)..(139): a, c, t, g, unknown or other
  misc_feature (139)..(139): n is a, c, g, or t
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (181)..(183): a, c, t, g, unknown or other
  misc_feature (181)..(183): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
tcagagtcgagagacacgaccggtgctcgatttagagtgagctcgttggggtttgggggaagaggaagactgacggtcccccaggagttcaggtgctgggcacaggcggcctgggctgcctggtccaaggctacttccnctctcgacttctggacgcgggctggccaaggccncaatgntnnngncngangtcatncatncngnctncatncngntctgatagtatacgtnctgtgactcaacacggcngataacnccagtcngtatagttcagcagtcagatccgggntacggagtctaggagtaccgtctcgttcgtaacgtcgtaacgtacggacgtctacgtacgtacgtaccgtaccgtaccgtacgtacgtacgtacgtacgtacgtaccgtacgtacgtacgaacggacggtacgtacgtacgtacgttacgttacgtacgtacgtacgtacgtacgtacgtacgtaacgtacgtacgtacgtacgtacgtacgtacgtacgtacgtaacggtacggtacggtacggtacggtaccggtaccggtaccggtaccgtacgtaccgtaccggtacccgtacccggtaccgtacgtacgtaccg

SEQ ID NO: 225048 - DNA, 196 bp, Homo sapiens
  misc_feature: GYAE6OF02IT2Z7.49.33.C11.1.454.CMB.1.raw
  modified_base (176)..(196): a, c, t, g, unknown or other
  misc_feature (176)..(196): n is a, c, g, or t
tcagagtcgagagacacgaccggtgctcgatttagagtgagctcggttgggtttgggggaaggaggaagactgacggtcccccaggagttcaggtgctgggcacgagcggccctgggctgcctggtcaaggactacttcctctctcgactctgagcgggctggcaaggcgcatagnnnnnnnnnnnnnnnnnnnnn

SEQ ID NO: 225049 - DNA, 593 bp, Homo sapiens
  misc_feature: GYAE6OF02H9ADC.49.33.C11.1.454.CMB.1.raw
  modified_base (206)..(206): a, c, t, g, unknown or other
  misc_feature (206)..(206): n is a, c, g, or t
  modified_base (243)..(243): a, c, t, g, unknown or other
  misc_feature (243)..(243): n is a, c, g, or t
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
tcagagtcgagagacacgaccggtgctcgatttagagtgagctcgttgggtttgggggaggaacgtgctcagttaggacccagacggaaccatggaagccccagcgcagcttctcttcctcctgctactctggctcccagataccactggagaaatagtgatgacgcagtctccagccaccctgtctgtgtctaccgaggggaaangtcaccctctcctgcagggccagtcagagtgtaggancaattgcctggtatcagacagaacctggccaggctcccgaggctccctacatctagtggtnctactccaaccgagggccacttggtaccncccgagccaggttccgagtcggactagggtgtcgngggaacnggtacttcacttccacaccgtatcgagcacgtcctggactacgtacgtacgtaagttacgtttcgacgttagttttacttactgtcagtacgtagttaatagtcggtccggtacttaccgggtacctaggttccgggacgggacgggtaccgtagggtcggaagtaacctacggaaaccggtactgggtacgtcgtacgaccgtacgtcgttactcgg

SEQ ID NO: 225050 - DNA, 563 bp, Homo sapiens
  misc_feature: GYAE6OF02HXVFX.49.33.C11.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (429)..(429): a, c, t, g, unknown or other
  misc_feature (429)..(429): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagctaattagcctggtaccaacagaacctggccaggctcccaggctcctnactctatgatgcactccaacgagggcccatggcactcccgagccaggttcagtggcaggtcgggtctggtgactagtacgtctacnctacacatcagcagtcctagcnctagaagtnttcgtgctaagtttacttagtntcagctagacgtagcctaacgtcgcctcttaccgtacgtttccgggaccggtaacgggtaaccgtaaggggttcggaagtaacgttaacccgaaaggtaccgttggtcggtaaccgtcggaccctaccgtaacg

SEQ ID NO: 225051 - DNA, 207 bp, Homo sapiens
  misc_feature: GYAE6OF02H60G4.49.33.C11.1.454.CMB.1.raw
  modified_base (175)..(207): a, c, t, g, unknown or other
  misc_feature (175)..(207): n is a, c, g, or t
tcagagtcgagagacacgaccggtgctcgatttagagtgagctcggttgggtttgggggaagaggaagactgacggtccccaggagttcaggtgctgggcacagcggcctgggctgcctggtcaaggactacttcctctctcgtactctgagccgggactggcaaggcgcatagnnnnnnnnnnnnnnnnnnnnnnnnnnnnnnnnn

SEQ ID NO: 225052 - DNA, 518 bp, Homo sapiens
  misc_feature: GYAE6OF02GFH3C.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccaggggccactggtactcccagccaggttcaggtggcagtgggtctggggacagagttcactctcaccatcagcagcctgcagtctagaagtatttgctagtttattactgtcagtctagtatagtcgtccggtctccggactcgttcggcggagggacgaggtggagtactacgaaacgtacgtggtacggcgtcgactactagtctcg

SEQ ID NO: 225053 - DNA, 520 bp, Homo sapiens
  misc_feature: GYAE6OF02IDYV8.49.33.C11.1.454.CMB.1.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (383)..(383): a, c, t, g, unknown or other
  misc_feature (383)..(383): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagtcaccctctcctgcagggccagtcagagtgttaaggagcaacttagcctggtatcagcagaacctggccaggctccaggctcctnatctatggtncactccacgagggccagtggtactcccagccaggttcagtggcaggtgggctgggacagagttcactctcacatcagcagcngcagtctagaatatttgctagtttattactgtcagctagtatagtcgtccggctccgactacgttcggacggtacggaccgaaggtcggaagtactaacgaaacgtacgtggtacggctagaccaacctgtcttcgg

SEQ ID NO: 225054 - DNA, 732 bp, Homo sapiens
  misc_feature: GYAE6OF02JNK9S.49.33.C11.1.454.CMB.1.raw
  modified_base (206)..(206): a, c, t, g, unknown or other
  misc_feature (206)..(206): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgacgcagtctccagcccaccctgtctgtgtctccgaggggaaangtccaccctctcctgcagggccagtcagagtgtagagcaacgttgcctggtatcagcaacgaacctggaccaggcctacccgaggcctcctacatcctagtggtcactactcccgaaccgagggccacgtggtactccccgagcctaggttcaggtcggactagggttgggtctaggggactaggtacgtttccaaccgttcctaccgaacctagttaccgacggtacctacggtcccgtagaccgtacggttacgtaaggtaacgttttacgttttcggaactttaaggtttttaacgtttacgtcggttaccgtaacggttacgttaaacggtttaacgttaacggtccggggttacccgggtacccgttacccgggtaccgtttaacccgggtttcggggaaccgggttaaccgggacccgtaaggggttacgggaaacggttaaccgttaacggaaaaccggttaccggttgggtaccggtaccgtaccggtaacctaacccgttacggttacgtttaccgg

SEQ ID NO: 225055 - DNA, 552 bp, Homo sapiens
  misc_feature: GYAE6OF02HCEIN.49.33.C11.1.454.CMB.1.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaaacctggccaggctcccaggcctcctcatctatggtgcatccaccgagggcccacgtggtactcccagccaggttcaggtgcaggtgggtctgggacagtagttcactctcacatcagcagcctgcagtctagaagtntttgctagtttatactgtctagctagttataagtcggtccgggtctaccgggtactaccggtttcgggacgggtacgggaccgaagggtcgggaagtacgtaacgaaaacggtacgttggtacggactcggacctaccgtagtacgttcg

SEQ ID NO: 225056 - DNA, 532 bp, Homo sapiens
  misc_feature: GYAE6OF02GANWW.49.33.C11.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctntcctgcagggccagtcagagtgttaggagcaacttagcctggtatcagcagaaacctggccaggctcccaggctcctcatctatggtgcatccaccaggggccactggtactcccagccaggttcaggtggctaggtgggtctggggacaggagttcacttctccaccatcagcagcctgcagtctaggtaagtattttgctagtttattactgtcagtctagtataagtcgtccgggctccggtactacgtttcgggacgggacgggacgaagggtacggagactacgaaacgtagtgtggctacgacacctatctcg

SEQ ID NO: 225057 - DNA, 568 bp, Homo sapiens
  misc_feature: GYAE6OF02HUM46.49.33.C11.1.454.CMB.1.raw
  modified_base (204)..(204): a, c, t, g, unknown or other
  misc_feature (204)..(204): n is a, c, g, or t
  modified_base (242)..(243): a, c, t, g, unknown or other
  misc_feature (242)..(243): n is a, c, g, or t
  modified_base (407)..(407): a, c, t, g, unknown or other
  misc_feature (407)..(407): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggannaacttgcctggtatcagcagaaacctggccaggctcccaggctcctcatctatggtgcatccaccacggggccacgtgtactcccgagccaggttcaggtgacaggtgggtctgggacaggtagttcacttcgacaccatcgcgcagcctgcagtctagaagtntttgctagtttacttactgtcacgtcaagttaagtaatcgggtccggtccgtaccggtacctacggtttccgggacgggtaccgggaccgtaagggtaggaacgtacgtaccgaaacggacgttagggtacggtccgtagaccgtaacgtcgttcgttacg

SEQ ID NO: 225058 - DNA, 173 bp, Homo sapiens; identical to SEQ ID NO: 224684
  misc_feature: GYAE6OF02GWSNZ.49.33.C11.1.454.CMB.1.raw
  modified_base (173)..(173): a, c, t, g, unknown or other
  misc_feature (173)..(173): n is a, c, g, or t

SEQ ID NO: 225059 - DNA, 172 bp, Homo sapiens
  misc_feature: GYAE6OF02FEN22.49.33.C11.1.454.CMB.1.raw
  modified_base (103)..(103): a, c, t, g, unknown or other
  misc_feature (103)..(103): n is a, c, g, or t
  modified_base (166)..(166): a, c, t, g, unknown or other
  misc_feature (166)..(166): n is a, c, g, or t
  modified_base (172)..(172): a, c, t, g, unknown or other
  misc_feature (172)..(172): n is a, c, g, or t
tcagagtcgagagacacgaccggtgctcgatttagagtgagctcgttgggtttgggggaagaggaagactgacggtcccccaggagttcaggtgctgggcacngcggccctggctgcctggtcaaggactacttcctctctcgactctgagcgggctggcaaggcncaatgn

SEQ ID NO: 225060 - DNA, 739 bp, Homo sapiens
  misc_feature: GYAE6OF02IBJM5.49.33.C11.1.454.CMB.1.raw
  modified_base (205)..(205): a, c, t, g, unknown or other
  misc_feature (205)..(205): n is a, c, g, or t
  modified_base (295)..(295): a, c, t, g, unknown or other
  misc_feature (295)..(295): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngtcaccctctcctgcagggccagtcagagtgttaggagcaacttagcctggtatcagcaagaaacctggccaggcctcccaggcctcctnactctagtggtgcactccaccgagggccacgtggtactcccagccaggttcagtggcaggtgggtcgtagggactaggtacgtttcaccgttcctaccgtaaccctataccgacgaccgtacggcccgtacggtaccgttaacggttccggttaacggtaaacggttttacgttttttacggtacgttttaagttttttaacgtttaaaccgtttcgggttaccgtaacggttaccgttaaacggtttaaatttaaacggtttccgggttacccggggtaccggttaccccgggttaaccggttaccggttttaccgggggaccggggttaaccgggggtacccggtaaagggggttcgggtaaacggtaacgttaaccggtaaaaaccggtaacgttacgggttcggacgttccggacccgtaacccgttacgttcgttaccg

SEQ ID NO: 225061 - DNA, 685 bp, Homo sapiens
  misc_feature: GYAE6OF02GTKPE.49.33.C11.1.454.CMB.1.raw
  modified_base (268)..(268): a, c, t, g, unknown or other
  misc_feature (268)..(268): n is a, c, g, or t
tcagagtcgagagacacgaccggtgctcgatttagagtgagctcgttgggtttggggaggaactgcttcagttaggacccagacggaaccatggaagccccagcgcagcttcttcttcctcctgtctactctggctcccagtataccgacgttcggagaaactagtgactggaccgcgagtactccaagcccaccgtgtctgtcgtctccgagggtaaagcttccaccctctcccgtgctacggccaagtcagtacgtcgttaggacncgtaacgttaggcccttagggtactcgagtcgaacgaaccgtggaccaggcctccgagtcctcctcatccgtagtcggtcgcctaacgtcccacgcgggtaccctaggtcgtacctcccgagacccgtaggttccaggtcggcctagggttcggtcgtggggaacaggtaacttccactctacgacctatcgacgcacgctcgctagtacgtagtaagttctttggtacttaagtttacttacgttcgtacgtacgtacgtagtaacttacggttcgtccggtaccgttaccggtaccgttacggtttaccgggacgggtaacgggaccgtaagggtacggtaacgtaaccgtaaccggtaaaccgttacggttaggacggttaccgacgtacccgtaaccgtcgttaaccgttccg

SEQ ID NO: 225062 - DNA, 174 bp, Homo sapiens; identical to SEQ ID NO: 224712
  misc_feature: GYAE6OF02HI6SA.49.33.C11.1.454.CMB.1.raw
  modified_base (173)..(174): a, c, t, g, unknown or other
  misc_feature (173)..(174): n is a, c, g, or t

SEQ ID NO: 225063 - DNA, 558 bp, Homo sapiens
  misc_feature: GYAE6OF02HVMRE.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaacctggccaggctcccaggctcctcatctatggtgcatccaccgagggccacgtggtactcccgagccaggttcaggtggcaggtgggtctggggacaggtagttcactctacacctatcagcagcctgcagtctagaagtatttgctagtttattactgtactaactagtaccgtaccacgtaggtacttacgtactttccggccctacgggaccaggtacgtggtaacgtacgtaaccgaaacggtaacgtaggttacggactacggaccacccgtagttccgtgttaccg

SEQ ID NO: 225064 - DNA, 569 bp, Homo sapiens
  misc_feature: GYAE6OF02HNMEO.49.33.C11.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
  modified_base (409)..(409): a, c, t, g, unknown or other
  misc_feature (409)..(409): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaacctggccaggctccaggctctcatctatggtncatccacagggccacgtggtactccccgagcctaggttcaggtcggcaggtcgggtctgggactaggtagttccactctcaccatcagcacgcctgacagtctagtaagtnttttgacttagtttacttacgtgtacagtacaagttaatacgtcggtccggcttaccggtactacgttcgggacgggtacgggaccgaagggtacggaagtacgtaaccgaaacgtaacgttcggtacggacgtacggtaccaaccgtacttacgttacg

SEQ ID NO: 225065 - DNA, 634 bp, Homo sapiens
  misc_feature: GYAE6OF02IJ6JH.49.33.C11.1.454.CMB.1.raw
  modified_base (352)..(352): a, c, t, g, unknown or other
  misc_feature (352)..(352): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagtccacctctcctgcagggccagtcagagtggttaggagactaacttacgctaggtatcagcaagaaacctggccacggctaccccgaggcctccctcatccttagtgggtcgactactcccaccggacggccacgtgtaccacccncgaccgtaggtcaggtggcgtaggtgggtacgtgggacaggtagttcacttcgtaccacgatcgacgcacggtctaggctagtacctaggaagtttagtttcgtacgttaagtttttactacttgactagtactaagttattacggtcggtaccggtccgttaccgggtaccgttacggttaccggggacgggtaacgggacgtaaggggtaggtaacggtacgtaaacgtaaacggtacgtagggtacggtccgtaggacccgtactacgtttccgttacg

SEQ ID NO: 225066 - DNA, 530 bp, Homo sapiens
  misc_feature: GYAE6OF02I2484.49.33.C11.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (408)..(408): a, c, t, g, unknown or other
  misc_feature (408)..(408): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaaacctggccaggcctcccgaggcctcctcatctatggtncatccaccgagggccacgtggtactcccagccaggttcaggtgcaggtgggtctgggacagtacgttcactctcacctatcgagcagcctgctagtctagaagtntttgactagttttacttacgtgtcagtctagtataagtcggtaccggctaccggtactacgttcgggacggtacggacagggtggagtactacgaaacggtactggtcgctgcactatctcg

SEQ ID NO: 225067 - DNA, 599 bp, Homo sapiens
  misc_feature: GYAE6OF02JOG3M.49.33.C11.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgacgcagtctccagccaccctgtctgtgtctccaggggaaancgtccaccctctcctgcacgggccagtcagagtgtagancaactgctgtatcagcaagaacctggccaggcctcccaggcctccgctatctagtcggtcactactccgaccgaggccctaggttcggtaccaccccgagcccgttagggttccaggtcgggacgtagggtcggttcgacggggactaggtaccttccgacctcgtaccaacnctnacgtcactccgtgcagtctagtaagttntttacgactttatttacgtacttntacgagttactagttaactacggtcgtaccggtctaccggtctacggtcgggacgggtaaccgacggtaggtaggaacgtacgtaacaaggacgttgacggtccgtggaccctaacgtcgtccttacg

SEQ ID NO: 225068 - DNA, 631 bp, Homo sapiens
  misc_feature: GYAE6OF02GMDY8.49.33.C11.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctctcctgcagggccagtcagagtgtagganctaacttgcctggtatcagcaagaaacctggaccaggcctcccgaggcctccctcatctagtggtcncactccaccgngggcccagtggtactcccagcctaggttcaggtcggctagggtcgggtctaggggactaaggtcgttccaacgttcctaccaacccgtatcgacgcacgtcctgcgtagtacgtagtaagttagtttgtacgttaagttttaacttacgttgttacgtagtactaagttaatttaacgtttacgttgggttaccgttttcggttttacgggaccggtaacggggtaacctaaggtcgtaggtacgtaagtaccgtaaggtaccgtaacgttggtacggtcgtacggaccctaaccgtacgttccgttacgg

SEQ ID NO: 225069 - DNA, 583 bp, Homo sapiens
  misc_feature: GYAE6OF02IEO4I.49.33.C11.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngtcaccctctcctgcagggccagtcagagtgttaggagcaacttgcctggtatcagcagaaacctggccaggctcccaggcctcctcatctatggtgcatccaccngggccacgtggtactcccagccgaggttcagtggcaggtgggtcgtgggacagtagttcactctacaccatcgagcagcctgctagtctagaagtatttgacttagtttattactgtacagctaagtataagtcggtaccgggtccttaccggtaactacggtttacgggaccgggtaacgggaccgtaaagggtcgggaacgtaagtaaccgtaaaacggtaaccgttacggttacgggtacctacggacccaccgttaccgttcttaccgg

SEQ ID NO: 225070 - DNA, 193 bp, Homo sapiens
  misc_feature: GYAE6OF02GZGX9.49.33.C11.1.454.CMB.1.raw
  modified_base (175)..(193): a, c, t, g, unknown or other
  misc_feature (175)..(193): n is a, c, g, or t
tcagagtcgagagacacgaccggtgctcgatttagagtgagctcgttgggtttgggggaagaggaagactgacggtcccccaggagttcaggtgctgggctacagtcggccctgggctgcctggtcaaggactacttcctctctcgactctgagcgggctggcaaggcgcatagnnnnnnnnnnnnnnnnnnn

SEQ ID NO: 225071 - DNA, 176 bp, Homo sapiens
  misc_feature: GYAE6OF02FVPF2.49.33.C11.1.454.CMB.1.raw
  modified_base (174)..(176): a, c, t, g, unknown or other
  misc_feature (174)..(176): n is a, c, g, or t
tcagagtcgagagacacgaccggtgctcgatttagagtgagctcgttgggtttgggggaagaggaagactgacggtccccccaggagttcaggtgctgggcacagcggccctgggctgcctggtcaaggactacttcctctctcgactctgagcgggctggcaaggcgcatagnnn

SEQ ID NO: 225072 - DNA, 596 bp, Homo sapiens
  misc_feature: GYAE6OF02GWRAJ.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaattgtgttgacacagtctccggccaccctgtctttgtctccaggggacagtgccaccctctcctgcagggccagtcagagtgttagtagcttcttagcctggtaccaacagaaacctggccaggcctcccgaggcctcctcatctatgatgcactaccaacgagggccacgtcggcactccccagcctaggttcaggtggcgaggtgggtctggtgacagtacttcacttcacctaccatcacgcacgtccgtaaggacgccgttagaacgtacttcgtgacttaagttttacttacttggtacagtcgagtcgtagaccgacttcggtaccttcgttccgtaccgtttcggggacgggtaacgggtaccgaaggggtcggaacggtaacgtaccgtaaacggacgttggtacggtacgttaccgacctacgtactcgttacg

SEQ ID NO: 225073 - DNA, 572 bp, Homo sapiens
  misc_feature: GYAE6OF02JAPQQ.49.33.C11.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacgttagcctggtatcagcagaaacctggccaggctcccaggcctcctcatctatggtncatccacgacgggccacgtggtactcccgagcccaggttcaggtcggctaggtgggtctggggactaggtagttcacttctaccaccatcagcacgcctgctagtctagaagtattttgcttagttttacttactgttacagtctagtataagtcggtccggtaccgttaccggtactacgtttcgggcgggtaacgggtaccgaagggtacggaaggtacgtaacgaaaccgtacgtaggtacggcgtacgaccaaccgtatcgttcg

SEQ ID NO: 225074 - DNA, 542 bp, Homo sapiens
  misc_feature: GYAE6OF02H3Z0M.49.33.C11.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctccagataccactggagaaatagtgatgacgcagtctccagccaccctgtctgtgtctccaggggaaangtcaccctctcctgcagggccagtcagagtgttaggagcaacttagcctggtatcagcagaacctggccaggctccccgaggcctcctnatctagtggtncatccaccgagggccacgtggtactcccagccaggttcaggtgcnggtggtcgngggacaggnttcactctaccacatcagcagcctgctgtctagtagtatttgacttagtttattactgtcagtctaagtatatcggtccggtcgtccgtacgtcgttcgggacggtaggaccgtagggtcggaagtactacgtaaacgtacgttggtacggtacgtcgacctacgtactcttaccg

SEQ ID NO: 225075 - DNA, 617 bp, Homo sapiens
  misc_feature: GYAE6OF02IHX5M.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaacctgccaggctccagctctcatctatgtgcatccaccagggccactggtactcccgagccaggttcagtggcaggtggtctgggacagagttcactctcaccatcagcagcctgctagtctagaacgtattttagctagttttattacgttcgtactaaactagccgttaaccacgtaagggtattttacccgaaccgtttttccggggacccccgttacgggggtacccaacggtacgggttacggggtaattaacggttaccaaaaaccgggtaaacccgttcgggttaacgggttcccttacgggaacccgtaaccccgtaagttttacccgttacggtttaaccccg

SEQ ID NO: 225076 - DNA, 550 bp, Homo sapiens
  misc_feature: GYAE6OF02H1RUY.49.33.C11.1.454.CMB.1.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagaaatagtgatgacgcagtctccagccacctgtctgtgtctcgaggggaaangtcaccctctcctgcagggccagtcagagtgttaggancaacttagcctggtatcagcaagaacctggccaggctccaggcctcctcatctatggtgcatccaccaggggccacgtggtactcccagcctaggttccaggtggcaggtgggtctggggacagtagttcactcgtacaccatcacgcacgctggcagtctgaagttatttgacttagttttattacgttgtcaagctaagttataagtcgtccgggctaccggacgtacgtttcgggacgggacgggtaccgaagggtcggaagacgtaacgaaaccgtacgtaggtggccgtcgacctactgtcttacg

SEQ ID NO: 225077 - DNA, 566 bp, Homo sapiens
  misc_feature: GYAE6OF02H7JUL.49.33.C11.1.454.CMB.1.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagagtcgagagacacgaccggtgctcgatttagagtgagctcgttgggtttgggggaggaactgctcagttaggacccagacggaacatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaattagctggtatcagcaagaactggccaggctccaggctcctnatctatgggtncactcccaccgagggcccacgtcggtactccccgagccaggttccaggtggcaggtgggtctggggactaggtacttcacgttctacacctatcagcacgtctcgcagtctagagttatttgactttagtttacttactgtacagtactagttatacgtcggtccgggtcgtccggtactacggttcgggacgggtacgggaccgtaagggtggaagtaacgtacgaaaccgttacgtggtacggtacgtcgacctacgtactcgtacg

SEQ ID NO: 225078 - DNA, 551 bp, Homo sapiens
  misc_feature: GYAE6OF02I0LG7.49.33.C11.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgtaggncaattgcctgtatcagcagaactggaccaggcctccgaggctcctacatctatggtcgcatcccacgacgggcctacgtgtactcccagccgtagtcaggtgcaggtgggtcagggacaggtagtcactcacacntcagacncgacctgcagtctagaacgtatttacgctatttacgttacttgtcaagtctaagtatagtggtccgtacgtccgtacgtacttcggacggtacggtaccgaaggtcggaagtacgtaacgaaacggtacgtacggttacggcgtaacgacctaccgttataccgttacg

SEQ ID NO: 225079 - DNA, 557 bp, Homo sapiens
  misc_feature: GYAE6OF02IP4ED.49.33.C11.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaanagtcaccctctctgcagggccagtcagagtgttaggancaacttgcctggtatcagcaagaacctggccaggcctccgagctccncatctagtggtnacatcccaccgagggacccacgtggtactcccagccaggttcaggtgcaggttggctgggacaggtgttcacgtcctcaccntcagccagcctgacgtacgtcgtagaagtntttgacgttattttagttactgtacagactaggttaatagtcggtacggtccttaccggactaccggtttcgggacggaggtaccgagggtagaaggtaactaacgaaacggtacgtggtacggctagaccctacgtatctacg

SEQ ID NO: 225080 - DNA, 840 bp, Homo sapiens
  misc_feature: GYAE6OF02IXGYO.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggagaactgctcagttaggacccagacggaaccatggaaagccccagcgcagcttctcttcctcctgctactctggctcccagataccactggagaaatagtgatgacgcagtctccagccacctgtctgtgtctccgagggaaagngtccaccctctcctgcgagggccagtacgacggtaaggttgttagggacgcctaaacgttagccgttggtatcagacagaaaccctcggccgacggtcctcccaggctccctcatctatcgatcgcaactccgaacgacggggccctaacgtcgggcctaaccgtccccgacggacccgtaggggttaccttacggcggggtacgttacgggttcggggttcctggtacgggaacccgaggtaacccttttcctaacccttccgtaccctaaccctaacgttaccgaacggacccgtaaccgtccggtaaacgggtaacccggtaccctaacggtaaacggtacgttttaactttccgggtactttaaccggttttttaatttaaaccccggttagggttttacccgaaaggttcccgtaaaccggggtaccgggttaaaaccgcccgtttaaaccggttacccgggttccccgtttacccgttaacccgggtttacccggttttaacccggggggtacccgggggtaaaacggggtaaaccccgggttaaggggggtacgggttaaaaccggacgttaaaacccgggtaaacccggttaacgggtacgggttacgggtacccgttaccggaacccg

SEQ ID NO: 225081 - DNA, 510 bp, Homo sapiens
  misc_feature: GYAE6OF02GARCL.49.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagagtgttaggagcaacttgcctggtatcagcagaaacctggccaggctcccaggctcctcatctatggtgcatccaccagggccactggtatcccagccaggttcagtggcagtgggtctgggacagagttcactctcaccatcagcagcctgcagtctgaagtatttgctagtttattacgtgtcagctagtataagtcgtccggctccggactcgtttcggcggtagggaccaaggtggaagataccgaaacgacgtgtacggctggaccactatctcg

SEQ ID NO: 225082 - DNA, 177 bp, Homo sapiens; identical to SEQ ID NO: 224820
  misc_feature: GYAE6OF02GLUML.49.33.C11.1.454.CMB.1.raw
  modified_base (173)..(177): a, c, t, g, unknown or other
  misc_feature (173)..(177): n is a, c, g, or t

SEQ ID NO: 225083 - DNA, 583 bp, Homo sapiens
  misc_feature: GYAE6OF02FQ3EH.49.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagagtgttaggancaacttagcctggtatcagcaagaaacctggaccaggcctcccaggcctcctcatctatggtgctactcccaccgacgggccacgtggtactccccgagtccgaggttcaggtggctagggttcgggtctggggacaggtacgttcacttctacacctatcagcacgcctgctagtctagaatgtttgacttagtttacttactgtacagtactaagtacttaagtcggtccgggtcctccgggtacttaccggttcgggacgggtacgggtacgaagggttggaacgtacgtaacggaaaccgtagttggacggtacgtacgacctaacgtcttcgttacg

SEQ ID NO: 225084 - DNA, 589 bp, Homo sapiens
  misc_feature: GYAE6OF02H35DK.49.33.C11.1.454.CMB.1.raw
  modified_base (203)..(203): a, c, t, g, unknown or other
  misc_feature (203)..(203): n is a, c, g, or t
  modified_base (581)..(581): a, c, t, g, unknown or other
  misc_feature (581)..(581): n is a, c, g, or t
tcagagtcgagagacacgaccggtgctcgatttagagtgagctcggttggggtttgggggaggaactgctcagttaggacccagacggaaccatggaagccccagcgcagcttctcttcctcctgctactctggctccagataccactggagaaatagtgatgacgcagtctccagccacctgtctgtgtctcgaggggaaangtcaccctctcctgcagggccagtcagagtgttaggagcaacttagcctggtatcagcagaacctggccaggctccaggtcctcctcattctatggtgcatccaccgaggggccacgtggtactcccaggcctaggttcaggtggcgtaggtcgggtcgtggggaacaggtacgttccacttccgtaccaccgtatcgacgcacgtcctgcgtagtcgtagtaagtattttgactttagtttacttacttgtacagtcgtaagtaattaagtcggttaccgggcgttacccggtactacggtttaccgggacgggtacgggtacgtaagggtaggaacgtacgtaacgaaacgtacgtggtacggcgtcgaccacgtntccgttcg

SEQ ID NO: 225085 - DNA, 677 bp, Homo sapiens
  misc_feature: GYAE6OF02JW2K1.49.33.C11.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccacctctcctgcagggccagtcagagtgttaggagcaacttagcctggtatcagcagaacctggccaggctcccgaggcctcctnactctatggtnctactccaccgaggcctacgtcggtactcccgagcctaggttcaggtcggctaggtcgggtcgtgggaactaggtacgttccgaacgttcctaccacgtacgtccgacgccacggtcccgtagaccgtagttcgtaggtaaacgtttagttttacggacctttaaaggttttactttaacgttcgtaacctacggtaactaagtttagttaacggtttccgggtcccgggtaccgttacccgggtaccgttaccgggtttccgggaccgggtaacgggtaccggtaaggggttacggaacggtaactaacggtaaaaccgtacggtttagggacggttcgtaaccgtaaccgtacccgtacgttcgtttaccgg

SEQ ID NO: 225086 - DNA, 604 bp, Homo sapiens
  misc_feature: GYAE6OF02I5PNE.49.33.C11.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaangtccaccctctcctgcagggccagtcagagtgtaggncaacttgcctggtatcagcagaaacctggccaggcctcccgaggcctcctctacttctagttggtcgcactccaccgacggccacgtggtactcccgagccgacggttcagtggctaggtcgggtctcggggactaggtacgttcactcgtaccgaactatcgagcacgcctgctacgtcgtagtaagtagtttcgacttagtttacttacgttgtctagtactagttaatagttcggtccgggtcctaccggtactacggttcgggacgggtacgggtaccgagggttacggtaaggtacgtaaccggaaacggtaacgttacggtacggttcgtaccggtaccgaaccttacgtcgttaccg

SEQ ID NO: 225087 - DNA, 686 bp, Homo sapiens
  misc_feature: GYAE6OF02HI1XO.49.33.C11.1.454.CMB.1.raw
  modified_base (205)..(205): a, c, t, g, unknown or other
  misc_feature (205)..(205): n is a, c, g, or t
  modified_base (259)..(259): a, c, t, g, unknown or other
  misc_feature (259)..(259): n is a, c, g, or t
  modified_base (337)..(337): a, c, t, g, unknown or other
  misc_feature (337)..(337): n is a, c, g, or t
  modified_base (418)..(418): a, c, t, g, unknown or other
  misc_feature (418)..(418): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagtccaccctctcctgcgagggccagtcagagtggttaggagcaattgctgtancagcagaacctggaccaggcctccaggcctcctcatctagtggtgccactaccgaccgagggcccacgtcggttaccncccgagccgtaggttcgaggtcggacgtagggtcggggtcgtagggaactaggtacgtttaccaccttcccaccaaccgtntaccgacgctaacggtcctggctacggttacgtaggtaacgttagttttcggaacgtttaacgttttaactttacggtcgttacgtaacggtacgtaagttaattaacgtccggggttacccgggtacgttacccggtaacggtttaccggtttaccggggaaccggggtacgggtaccggtaaggggtacgggtaacggtacgtaaccggtaaacggtacggtacgggttacgtaccggtacgacccgtacttcgttacgttaccgg

SEQ ID NO: 225088 - DNA, 203 bp, Homo sapiens
  misc_feature: GYAE6OF02GKIHM.49.33.C11.1.454.CMB.1.raw
  modified_base (173)..(203): a, c, t, g, unknown or other
  misc_feature (173)..(203): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnnnnnnnnnnnn

SEQ ID NO: 225089 - DNA, 523 bp, Homo sapiens
  misc_feature: GYAE6OF02GCV96.49.33.C11.1.454.CMB.1.raw
  modified_base (303)..(303): a, c, t, g, unknown or other
  misc_feature (303)..(303): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaaacttagcctggtatcagcagaaacctggccaggctcccaggctcctcatctatggtncatccaccagggccactggtatcccagccaggttcagtgcagtgggtctgggacagagttcactctcaccatcagcagcctgcagtctagaagtattttgctagttttattactgtcagctagtaataatgtccgggctccggactacgtttcgggcggtacgggaccgaagggtacggaagaatacgaaacgtaactggtaggctagcaacctatctcg

SEQ ID NO: 225090 - DNA, 609 bp, Homo sapiens
  misc_feature: GYAE6OF02G2XZH.49.33.C11.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctctcctgcagggccagtcagagtgtaggngcaacttgcctggtatcagcaagaaacctggccaggctcccaggctcctcatctatggtgcactccaccgaggggcccacgtggtactccccagcccaggttcaggtcggctaggtgggtctgggacaggagttcactctcactatcagcagcctgctagtcgtagtacgtattttgacttagttttacttcgttgtactaggtactaagttactaacgttcggtccggggccgttacccgggtacctaccggttttcgggacggggtaacgggaccgtaaggggtacggaacggtaacgttaaccggaaaaccggtacggttaggtaaccggtccgtaacggtaccctaccgtacgttccgttaccg

SEQ ID NO: 225091 - DNA, 610 bp, Homo sapiens
  misc_feature: GYAE6OF02F9Y49.49.33.C11.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (601)..(601): a, c, t, g, unknown or other
  misc_feature (601)..(601): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgagggaaancgtcaccctctcctgcagggccagtcagagtgttaggancaacttagcctggtatcagcagaacctggcaggctccgagcctctnatctatgtgcatccacgnggccacgtggtactccagctaggttcaggtcgactaggtgggtctggggactagtacgttcacgttctacaccgtatcacggcacgtccgtgactacgtacgtagtaagttacgttttgacgtttagttttactaccgttgtaccgaacgtcgttaaacgttaacgttaacgtttcgggtacccgggtccgttaccgtaaccgtttaccggttcggggaccggtacgggaccgtaagggtacgtaacgtactaacggtaaacgtacgttacggtcggtactaccggcctaaccgtnttcgtaccg

SEQ ID NO: 225092 - DNA, 766 bp, Homo sapiens
  misc_feature: GYAE6OF02HZU4W.49.33.C11.1.454.CMB.1.raw
  modified_base (201)..(201): a, c, t, g, unknown or other
  misc_feature (201)..(201): n is a, c, g, or t
  modified_base (328)..(328): a, c, t, g, unknown or other
  misc_feature (328)..(328): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccaggggaanagtcaccctctcctgcagggccagtcagagtgttaggagcaacttagcctggtatccagaccaagaaaccgtggaccaacggcctaccccgaggtccttaccctacacttccgtaagttcggggtanacctactaccccgaaccggtaacggggccctacgttacggtacctcccccgtaaggacccgtagggtttaccgagggttacgggacgtaacggggtttcggggtacgtacgggggaacctaagggtacgttttacccgacttcccgtaccaacccgtaattacccgaacgtacccgtaacggccccgttaggccgttaacgttaccgtaaggtaaagtttacgttttagtccgtttaagttttaacgtttaccttacggtactaacgggtactaaagttaacgttaagttccgggtaccgggtaccttcccggtaacgttaccggttcggggaccgggtacgggaccgtaaggggtacggtaacgtaccgtaaccggtaaaaccggtaacgtgggttaaccggccgtacggtacccgtaaccgttacgtccgtttacg

SEQ ID NO: 225093 - DNA, 565 bp, Homo sapiens
  misc_feature: GYAE6OF02IQQYX.49.33.C11.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (367)..(367): a, c, t, g, unknown or other
  misc_feature (367)..(367): n is a, c, g, or t
  modified_base (558)..(558): a, c, t, g, unknown or other
  misc_feature (558)..(558): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatgtgatgacgcagtctccagccaccctgtctgtgtcctaccgaggggaaangtcaccctctcctgcagggcctagtcagagtgtaggancaattgcctgtatnagcanaaacctgccaggctccaggctcctacatntanggtncatccaccagggcaactggtactccgagctacggttcaagtgccgagttcgggtactagggacaagtnttaccgattcctacaccgtatcaagcgaacgccctgctacgtctagaagtaatttggacttacggtttaattcctagttcagtactaagtactaagttcgccggtactccggacgttacgttccgggcggtaggacccgtaagggtcgaaggtacgttacaaaacggtagttggtggacctgaccacgtanccgttag

SEQ ID NO: 225094 - DNA, 527 bp, Homo sapiens
  misc_feature: GYAE6OF02II124.49.33.C11.1.454.CMB.1.raw
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccgagggaaagagtcaccctctcctgcagggccagtcagagtgttaggagcaacttagcctggtatcagcagaacctggccaggctcccaggctcctcatctatggtgcatccaccgagggccactggtactcccagccaggttcagtgcagtgggtctgggacaggagttcactctcaccatcagcagcctgctagctagaagtatttgctagtttattactgtacagacagtataatcggtccggctccggactacgtttccgggacggagggaccgaaggtggaagtactacgaaacgtacgtaggtcggcgtcgactaacgtactctacg

SEQ ID NO: 225095 - DNA, 674 bp, Homo sapiens
  misc_feature: GYAE6OF02JIN13.49.33.C11.1.454.CMB.1.raw
  modified_base (219)..(219): a, c, t, g, unknown or other
  misc_feature (219)..(219): n is a, c, g, or t
  modified_base (423)..(423): a, c, t, g, unknown or other
  misc_feature (423)..(423): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtcgtctccgaggggaaagagtccaccctctccngcgagggccagtcagagtgttaggagcaacttgcctggtatcagcaagaacctggaccaggcctaccgaggcctcctcaattccgtagtcggtgacctacgtcccgacgacgggccctaagtcggtaactcccgagcctaggttcgaggtcggctagggtcgggtcgtaggggactagggtactttacgacttcgtccaacctntacgacgctacgccgtgtactacggtctaggtaaagttcgtttagacgtttagtttacttacgtcgtacaagttctaagtttacgtaacggttccggtaccggtccgttacccgggaacttaccgggtttacgggaaccggggtaacgggtacccggttaacgggacggggttaaactaaccggtaaacggtaaaaccggtacggttaggggtcgtacgttaccggtaccctacgttacgttaccgtacgg

SEQ ID NO: 225096 - DNA, 562 bp, Homo sapiens
  misc_feature: GYAE6OF02HVAD5.49.33.C11.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (302)..(302): a, c, t, g, unknown or other
  misc_feature (302)..(302): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagtcaccctctcctgcagggccagtcaggagtgttaggancaacttagcctggtatcagcaagaacctggccaggctcccaggcctcctcatctatggtncatccaccgagggcccacgtggtactcccgagccaggttcagttggcaggtgggtctgggacaggtacgttccacttcctacaaccctatccagcacgtcctgctagtctagtaagtatttgacttagtttacttactgtctagtcgtagttaatacgtggtccggtctccgtactacgtttcgggacggtacgggacgtaaggtacggaagtacgtaacgaaacgtacgtggtacggacgtcgacctacctagtcgtcg

SEQ ID NO: 225097 - DNA, 695 bp, Homo sapiens
  misc_feature: GYAE6OF02G9ET8.49.33.C11.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (303)..(303): a, c, t, g, unknown or other
  misc_feature (303)..(303): n is a, c, g, or t
  modified_base (373)..(373): a, c, t, g, unknown or other
  misc_feature (373)..(373): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccaggggaaangtcaccctctcctgcagggccagtcagagtgttaggngcaacttgcctggtatcagcagaaacctggaccaggcctccaggcctccgtcatctagtggtcncactccaccgacgggcccacgtcggtactccccgaagccgtaggttccaggtcggcgtaggtcgggtcgnggggactagtagttcacgttctaccacatacgacgcgacgccctgaccgaggttaccgtaggtaacgttacgtttttacgaccgttttacgttttaattaccgttagttaccggtaacgttacgtaaacggtttaacttaagtttccggggttacccgggtacccgtttacccgggtaaccggtttacccggtttaaccggggacggggtaaccgggttaccggtaaaggggtttacgggaacgtaaccgttaacggtaaaaccggttaacggttcgggttcggtacgttccggaaccctaaccgttagtttcccgttacgg

SEQ ID NO: 225098 - DNA, 632 bp, Homo sapiens
  misc_feature: GYAE6OF02H3H0J.49.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (293)..(293): a, c, t, g, unknown or other
  misc_feature (293)..(293): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagagtgtagncaattgctgtatcagcagaaacctggccaggctcccaggctcctcatctatggtncactccaccgacgggccacgtggtacctcccaggcctagggttccaggttcggcgtaggtcggggtactagggggaaccaggtaacgttcgaccttccgtcaacccgtatcacgtccacgtccctgactaggtctagaagttatttcggctttaagtttactacttgtacacgtactaagttaacttaagtccggttcccgggtaccttacccgggtaaccttacgtttacccgggggaccgggtaaccgggtaaccggaagggttcgggaacgtacgtaaccgaaacggtaaccgtgggtacggtcgtacgtacccgtaacttaccgttacgttaccg

SEQ ID NO: 225099 - DNA, 172 bp, Homo sapiens; identical to SEQ ID NO: 224749
  misc_feature: GYAE6OF02F054F.49.33.C11.1.454.CMB.1.raw

SEQ ID NO: 225100 - DNA, 552 bp, Homo sapiens
  misc_feature: GYAE6OF02FPXXY.49.33.C11.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (415)..(415): a, c, t, g, unknown or other
  misc_feature (415)..(415): n is a, c, g, or t
  modified_base (546)..(546): a, c, t, g, unknown or other
  misc_feature (546)..(546): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggancaacttgcctggtatcagcagaaacctggccaggcctcccgaggcctcctcatctatggtncactccaccgagggccacgtggtactcccgagcctaggttcagtcggctaggtgggtctgggacaggtacgttcactctccacatccagcagcctgcctagtctagaacgtnttttgacttagttttattaccgtgtacagtctaagtatagtcggttccggctaccggaactccggttacggacgggtacgggaccgtagggtcggaacgataacgaacgtacgtggtcggctagccacgtntcgtcg

SEQ ID NO: 225101 - DNA, 588 bp, Homo sapiens
  misc_feature: GYAE6OF02F06KL.49.33.C11.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangtcaccctntcctgcagggccagtcagagtgttaggagcaaacttgcctggtatcagcaagaaacctggccaggctcccaggcctcctcatctatggtncatccacgngggccagtcggtactcccagcctaggttcaggtggcaggtgggtctgggacaggtgttcacttctcaccatcacgcacgcctgacagtcgtaggtaagttattttgactttagttttacttacgttgtacagtctaagtaagttacgtcgggtccggtccgtacccgggtacttaccggtttccgggacgggtacgggaccgtaagggtcggaacggtactaacggaaacggtacgttgggtacgtacgttacggaccctacgtagtccttacgg

SEQ ID NO: 225102 - DNA, 704 bp, Homo sapiens
  misc_feature: GYAE6OF02JLKRB.49.33.C11.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgagggaaangtcaccctctcctgcagggccagtcagagtgttaggngctaacgttagcctggtancgagcagaaacctggaccaggcctaccaggcctccgtctagtccttagtcggtcactactcccgaccgacgggccctaacgttcgtactaccccgagccgtagggttccaggttcggactgggttggtcgtacgggacctaagtcgtttaccactccgttacaaccgtacgtccgaacgccgtaacgtcccgttacgaccgttacgtccgttaaggaaacgtttactttcggaccgttttaagtttaacgtttacgtcgttacgaagttacgttaagttaacgttaacgtttccgggtacccggtacgttaccgtaaccgtaccgtttaccgggggacggtaaccggggtacgtaaacggggtcggtaacgttagtaacccggtaaaaccgtcggtttaggtacgggacccttaggaacccgtaaccgttaggtccgttaccgg

SEQ ID NO: 225103 - DNA, 625 bp, Homo sapiens
  misc_feature: GYAE6OF02GMN4U.49.33.C11.1.454.CMB.1.raw
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagtcaccctctcctgcagggccagtcagagtgttaggagcaacttagcctggtatcagcagaaacctggccaggcctccaggcctcctcatctatggtgcatccaccgagggccacgtggtactccccgagccaggttcaggtggcaggtgggtcgtggggacaggtacgttcacttcctaccacctatcacgccagccctggacctaggttctaaggaacgttgttttacggactttaaggtttttaattaccgttagtacctaaggtctaagttaacgttaagttccggtacccggggttccttacccgggtacttaccggtttccgggacgggacggggtaccgtaggggtacggaaggaactaaccggaaaacgtacgtggtacggtcgttacggacctacctagttccgttacgg

SEQ ID NO: 225104 - DNA, 532 bp, Homo sapiens
  misc_feature: GYAE6OF02GDRCW.49.33.C11.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttaggagcaacttagcctggtatcagcagaacctggcaggctcccaggcctcctnatctatggtncatccgacagggccacgtggactcccagccaggttcagtggcagtgggtcnggacagagttcactcncacatcagcngcctgcagtctagaacgtattttgctagtttattactgtcagtctagtaatagtcgtccgggtctaccggtactacgtttcgggacggtacgggaccgtaagggtggaagactacgaaacgtacgtaggtcgtacgtcgacctacgtactcgtacg

SEQ ID NO: 225105 - DNA, 610 bp, Homo sapiens
  misc_feature: GYAE6OF02FHNH8.49.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagagtgttaggagcaacttagcctggtatcagcagaaacctggccaggctcccaggcctcctcatctatggtgcatccaccaggggcccagtggtactcccagccaggttcagtgcagttgggtctgggacagagttcactctacaccatcagcagcctgcagtctagaagtattttgacttagttttaattactgttacagtactaagttaataacgttcggttacccggggtaccttcccgggtaaccttaccggtttccggggaccggggtaacggggtacccgtaaaggggttcgggaaacggtacgttaaccggaaaaccggtaaccgttaggtacgggtccgttacggaccctaacccgtacgttaccgttaccgg

SEQ ID NO: 225106 - DNA, 553 bp, Homo sapiens
  misc_feature: GYAE6OF02F20ZK.49.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagagtgttaggagcaacttagcctggtatcagcaagaaacctggaccaggcctcccgaggcctcctcatctatggtgcatccaccgacgggccacgtggtactcccgagccgaggttcagtggctaggtgggtcnggggaanggtattcacgtctccaacntacacgcncgctgctagtctagaagtntttgacttagtttattactgtacagtactagttatacgttcggtccggtcctaccgtactacggttacgggaggacggacgtaagggtcgagactacgaaacgtacgtaggtcgtactcggacaccgtatcgttacg

SEQ ID NO: 225107 - DNA, 544 bp, Homo sapiens
  misc_feature: GYAE6OF02I3OI7.49.33.C11.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcaagaaacctggccaggctcccaggctcctnatctatggtncactccaccagggcccagtggtactcccgagccgaggttcaggtggctaggtgggtcgtggggacagtagttcactctccacatcagcagcctgcagtctagtaagtatttgcttagtttatactgtcagtctaagtataagtcggtccgggtctaccggactacggttcgggacgggacgggtacgaagggtggaacggtactaacgaaacgacgtggtacgcgtgacctacgtatctacg

SEQ ID NO: 225108 - DNA, 730 bp, Homo sapiens
  misc_feature: GYAE6OF02HZ15E.49.33.C11.1.454.CMB.1.raw
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
tcagagtcgagagacacgaccggtgctcgatttagagtgagctcgttgggtttgggggaggaactgctcagttaggacccagacggaaccagtggaacgccccagcgcagcttctctcctcctgctactctggcctccatataccacgtgggaataaatagtgaactggaacgtcagtcctcacgccctacctgtcngtgtctacgaaggggaaangtccacctcncctagcaggtccagtcagtagttgtaggagactaaacgttcgctaggttaacaccgaagaccaaaggtaaaaccctggccaacgggacccttcccggaaggtcctacctacgacttaacttaagtcggtacacactacccgaaccggcgggtcctaaagtcggttaacctcccgaggaacgtacggttacgacggtgacgtacgggtcggggttacaacggggaaactcggtaacgttcaaccttcaaccgaccttaataccgacgttaccgaacgccgttaggactaaacgttcgtaagtaaaggtttacttaaggtaccgttaagtttaacttactcgtacaagtacccgtaaaggttaaactcggtcggttaccgggtacccttacggttaccgtaacgtttacccggggagaacgggtaaccggtaaaggtcgaacggtaacgtaaacgaaacggttaactgggttacggcctagaaccggtactaccgttaggttaccg

SEQ ID NO: 225109 - DNA, 567 bp, Homo sapiens
  misc_feature: GYAE6OF02F8VCW.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgtaggagcaacttgcctggtatcagcagaaacctggccaggcctcccgaggcctcctcatctagtggtgcactccaccgacgggcccacgtcggtactccccgagccgtaggttcaggtcgggctaggtcggggtctggggaactaggtagttccactctaccaccatcagcagcctgcagtctagaagtatttgactagtttacttactgtacagactagtatacgtcggtacccgggtcttaccggactacggtttcgggacgggtacgggtaccgagggtacggagtactacgaaacgtagtggtacggctacgactaccgtatcgtacg

SEQ ID NO: 225110 - DNA, 593 bp, Homo sapiens
  misc_feature: GYAE6OF02FM21R.49.33.C11.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (443)..(443): a, c, t, g, unknown or other
  misc_feature (443)..(443): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagagtaccactggagaaatgtgatgacgcagtctccagccaccctgtctgtntctccgaggggaaangtccaccctctcctgcaggccagtcagngtgtaggnctaacgttgcctggtatcagcgaacgaaccgtggccagggcctcccgaggcctcctatagtctagtggtcncctactccaccgnggtcccagttcggtactcccgacgccgtaggttcgaggtcggacgtaggtcgggtctggggactaggtacttcacctctaccactatcgacgcacgtcctaggctagtctagtacgttntttgacttagtttactacgtgtacgtacgtactagttatacgtacggtccggtctaccgacgttacggttcggacggacggtaccgtagggcgaagtacgtaacgtaacgtaacgtggtagtacgtacgtaccgtacgtcgtacgttacg

SEQ ID NO: 225111 - DNA, 543 bp, Homo sapiens
  misc_feature: GYAE6OF02HSZZD.49.33.C11.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaacttagcctggtatcagcagaaacctggccaggcctcccaggcctcctcatctatggtncatccaccgagggccacgtggtactcccagccaggttcaggtgcaggtcgggtctggggacaggtagtttcactctacaccatcagcacgcctgcagtctagaagtagtttgacttagtttattactgtcagctagtatagtcgtccggctccgtactcgttcgggcggtacggaccgtaagggtggaacgtacgtaacgaaacgtacgttggacggtctcgaccaccgtagtcgttacg

SEQ ID NO: 225112 - DNA, 796 bp, Homo sapiens
  misc_feature: GYAE6OF02H1GCP.49.33.C11.1.454.CMB.1.raw
  modified_base (238)..(238): a, c, t, g, unknown or other
  misc_feature (238)..(238): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggaagaaatagtgatgacgcagtctccgagccaccctgtctgtgtcctaccgaggggaaagacgtccaccctctcctgcacgggccacgtnagagttcgttaggagtacaacgttacgcgttaggtactcagacaagaaaccgtcggaccaacggccctacccgacggtccttcccgtactaacttcgttaagtcgggtacgacctactccgaaccggtacgggaccctaacggtcggtacctaccccgaacggccgttaacggttaccgtaggtccgggtacgtacgggttcggggtaccgtggggaacctaagggttaaccgttccgtaacccgtttaccgtaacccgtaacccgtacgtaccgaaccggtacccgtaccggtacccgttacggtaacccggttaacgttaccggttaaggttaacggtttacgtttttacggtaacgttttaacgttttacgtttaacgttcggttacaacggttacgttaaagttactttaacggtccggggtaccggtcccggttaaccgggttaccgttaccgggtttacgggaaccgggtacgggtaccggaaggtaggtaacgtaacgtaaccggtaaacgtacgtaggtacgcgtacgaccgttacgtacttcgttaccg

SEQ ID NO: 225113 - DNA, 542 bp, Homo sapiens
  misc_feature: GYAE6OF02FO9Z7.49.33.C11.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (342)..(342): a, c, t, g, unknown or other
  misc_feature (342)..(342): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctntcctgcagggccagtcagagtgttaggagcaacttagcctggtatcagcagaaacctggccaggctcccaggcctcncatctatggtncatccacagggccactggtactcccagccaggttcagtcgnagtgggtctgggacaggtagttcactcgtcaccatcagcagcctgcagtctagaagtattttgactagttttattactgtcagtactagtattagtcgtccggtcttaccggactacgtttcgggacggtagggaccaagggtcggaagtactacgtaaacgtaacctgggtacgacgttcggactaccgtacgtcttcg

SEQ ID NO: 225114 - DNA, 751 bp, Homo sapiens
  misc_feature: GYAE6OF02F7VTE.49.33.C11.1.454.CMB.1.raw
  modified_base (205)..(205): a, c, t, g, unknown or other
  misc_feature (205)..(205): n is a, c, g, or t
  modified_base (515)..(515): a, c, t, g, unknown or other
  misc_feature (515)..(515): n is a, c, g, or t
  modified_base (709)..(709): a, c, t, g, unknown or other
  misc_feature (709)..(709): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccacttggagaaatagtgatgacgcagtctccagccacctgtctgtcgtctccgagggaaangtccaccctctcctgccagggccagtcgagtagtggtagacactactcgtcgtagtctgacacaacgtaacgtcggaacgtacgtccctacggacgtcccttacctacgtaacttacgtggttaccggtcgaacctaccgtaccgaaccggtaccggtaccttaacggttaccgtacctacccggaccgtaaccggttaacggttacgaggggtaccggtcggacggggtttacggtccgggaacgggtaacgttaaccgttcgtaaccctccgttaccgacctaacgtcctaggacctcgaccggttcncgttaacgtacgttctaaagggtcttttagttcggttaaacttttggtttaacctttacggcttaaccgtaaccgtaaggtttaaatacggttttaccgtccgggacgttccccggaacgttacgttcgggtaacccgggtaggggaaccgtacggtaggtacggtaaacgtaactaaccggaaaccgggtttncgggtacgttcccaagttacccgaacgttcgttaccttacgg

SEQ ID NO: 225115 - DNA, 622 bp, Homo sapiens
  misc_feature: GYAE6OF02IH5QA.49.33.C11.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (290)..(290): a, c, t, g, unknown or other
  misc_feature (290)..(290): n is a, c, g, or t
  modified_base (316)..(316): a, c, t, g, unknown or other
  misc_feature (316)..(316): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgcctactctggctcccagataccactggagaaatgtgatgacgcagtctcagccaccctgtctgtgtctccgaggggaaangtcaccctctcctgcagggccagtcagagtgtaggncactagctgtatcagcagaacctgccaggctccagctcctcatctagtggncactccaccgacggccaagtgtaccnccagccgtaggttcaggtcggcgaggttcgggtcgtagggaacctaggtacgtttccaacgttccgtacaaccctagttaccgaacgtccgaacggtccctaggtccgtaacgttacgtagtaaacgtttattttcggaacttttagttttaacttacgtgtacagtcttaagttaattacgtcggtcccgggacgttacccggacttacggttccgggacgggtaacgggaccgtaagggtcggaagtaccgtaacgaaacggtacgtgggtacggcgttaccgacctaacctcgttacgttacg

SEQ ID NO: 225116 - DNA, 670 bp, Homo sapiens
  misc_feature: GYAE6OF02JFI3G.49.33.C11.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtcaccctctcctgcaggccagtcagagtgttaggagcaacttgcctggtatcagcagaacctggaccaggctcccgagcctcctcatctatggtacncactccaaccgtcgggcccacgtcggtacctaccccgagacccgtaggttccgaaggtcggacgtaggttcggggtacgttaggggaactaggtacgtttccgaccgttcctaccgaacctacgtaccgacgtccgaacgtcccgtaggcctaggtacctaggtaacgttagttttacgacttaagttttacgttacgtgtacgagtaccgttagttaactacgtccggtaccgggtcctaccggtaaccgttacggttacgggaccgggtaacgggtacgtaacggggtggtaacggtaacgttaaccgaaaccggtaacgttacggtacggtaccgtacggtacctaaccgttagtccgttaccg

SEQ ID NO: 225117 - DNA, 520 bp, Homo sapiens
  misc_feature: GYAE6OF02ITPZI.49.33.C11.1.454.CMB.1.raw
  modified_base (201)..(201): a, c, t, g, unknown or other
  misc_feature (201)..(201): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagaaatagtgatgacgcagtctccagccacctgtctgtgtctccaggggaaanagtcaccctctcctgcagggccagtcaggagtgtaggagcaaacttagcctggtatcagcagaaacctgccaggctcccaggctcctcgatctatgtagcatccacagggtccactggtatcccagccagttcagtgcagtgggtctgggacagagttcactctcacatcagcagctgcagctgaagatttgactagttatactgtcagcagtataatgtccggctcggtactacgtttcgggcggtagggacctaaggtcgggagaagttcgaaaacgtaacctaggttacgggacttcggacacccgataccgttgg

SEQ ID NO: 225118 - DNA, 199 bp, Homo sapiens
  misc_feature: GYAE6OF02H73U0.49.33.C11.1.454.CMB.1.raw
  modified_base (169)..(169): a, c, t, g, unknown or other
  misc_feature (169)..(169): n is a, c, g, or t
  modified_base (175)..(199): a, c, t, g, unknown or other
  misc_feature (175)..(199): n is a, c, g, or t
tcagagtcgagagacacgaccggtgctcgatttagagtgagctcgttggggtttggggggaagaggaagactgacggtcccccaggagttcaggtgctgggcacagcggccctgggctgcctggtcaaggactacttcctctctcgactctgagcgggctggcaaggcncatagnnnnnnnnnnnnnnnnnnnnnnnnn

SEQ ID NO: 225119 - DNA, 650 bp, Homo sapiens
  misc_feature: GYAE6OF02HLYGV.49.33.C11.1.454.CMB.1.raw
  modified_base (243)..(243): a, c, t, g, unknown or other
  misc_feature (243)..(243): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtccaccctctcctgcagggccagtcagagttgtaggancaacttagcctggtatcagcaagaaacctggccaggctcccgaggcctcctcaatctagtggtgactactccaccgagggcccacgttcggtaactccccgaagccgtaaggttccaggtggcgaggttcggggtactaggggaactaaggtacgtttcaacgttcctaccaacctataccaaggtccaacgtcccttgactagtctaaggaaacgttattttgacttagttttaacttacgtagtactaacgtactaaaggttataaacgttcggtacccgggtctacccggtaacgttacgtttacggggaccgggtacgggaccgtaagggtacggaaggtaacttaacgaaaacggtaacgtcgggtacggtacgaccgtaccgtaaacgtattccgttacgg

SEQ ID NO: 225120 - DNA, 695 bp, Homo sapiens
  misc_feature: GYAE6OF02GY87R.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagngtcaccctctcctgcacgggccagtcagagttgttaggagctaacgttagcctggtatcagcaagaaacctggaccaggcctcccgaggcctcctcatctagtggtcgcactcccgacgacgggccctacgtggtacctcccgacgccgtaggttcaggtcggactagggttgggtacgtgggaacctaggtacgttaccacgttctaccacctatcacgcacgtcctagaccgtacgttccgtaaggtaacgttgtttttcgactttaaggttttacttacgttcgtacgagtacgtaaggttaacgttaacgttcggtacccgggtccgttacccggtaaccgttaccggtttaccgggggaccgggtaacggggtaccggtaaggggtcgggtaaacggtaacgttaaaccggtaaaacggttaaccgttacggggttacgggtaccgttaccggaacccgtaacccgttacggttaccgtttaccgg

SEQ ID NO: 225121 - DNA, 674 bp, Homo sapiens
  misc_feature: GYAE6OF02IPV2Q.49.33.C11.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtccaccctctcctgcgagggccagtcagtagtgttaggagcaacttagcctggtactcagcaagaaccgtggccaggcctacccgaggcctccctnacttctagtcggtgcctactccccaacgcgggacccacgttcggtacctcccgagccgtagggttcaggtcggcgtacgggttgggtacgtacggataggtaccgttctacgttccgtaacctaccgtactaccgacgtaccgaccgtccgtacgacgtaccggttacgtaacgttaaggtttacgtttaggtaacgttttaagttttactttaacccgttgttaacgtagtacgtaagtttaacgtacggttccggtaccggtaccgttaccggtaccgttacgggttaccgggacgggtaacgggtacgaagggtcggaatacgaaccggaacgtacgtggtacgtactaccgtaccacgttagtctccg

SEQ ID NO: 225122 - DNA, 566 bp, Homo sapiens
  misc_feature: GYAE6OF02IJIDC.49.33.C11.1.454.CMB.1.raw
  modified_base (205)..(205): a, c, t, g, unknown or other
  misc_feature (205)..(205): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcaggagtgttaggagcaacttagcctggtatcagcagaacctggccaggctcccaggctcctcatctatggtgcatccacacggggccacgtggtactcccagccaggttcagtggcaggtggtctgggacaggtacgttcactctacaccatcagcacgcctgctacgtctgtaagtatttgacttagttttattacttgtacagctaagttaatagtcggtccgggtccgtaccgtacgtaccggtttccgggacgggtacgggaccgaagggtcggaacggtactacggaaaccgtacgtaggtacggtcgtagaccgtacctacgtacgttcg

SEQ ID NO: 225123 - DNA, 790 bp, Homo sapiens
  misc_feature: GYAE6OF02GL07K.49.33.C11.1.454.CMB.1.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgagggaaagngtccaccctctcctgcgagggccagtcagtagtgttaganctacttgcctggtatcagacacgaaacctggaccaggcctacccgaggcctcctcactctagtggtcgcactccacccgagggtccacgtcggtactccccaggccgtaagggttccaagggtcggaccgtaagggttcgggttcgtacggggtaacgtacggtacgttccaaccgttcctacctaaccgtattccgaacggacctaaccggtcccttacggaccgttaggttaccgtaacgggttaaacgtttacgtttttacggaacgttttaaggtttttaacctttacggttacgttaccgaagggttaccgttaaaggtttaacgttttaacgggtccggggttacccccgggttaccgtaaccccgggttaaccgtttacccgggttttacgggggacccgggggtaaaccgggttacgggttaaccgggggttaagggtaaccgttaaaggttaacccgggaaaaccggttaaaccggttgggttaacccggtcggttaacccggtaaccctaacccggttcgttacccggtttaaccg

SEQ ID NO: 225124 - DNA, 734 bp, Homo sapiens
  misc_feature: GYAE6OF02JAGDC.49.33.C11.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
  modified_base (312)..(312): a, c, t, g, unknown or other
  misc_feature (312)..(312): n is a, c, g, or t
tcagagtcgagagacacgaccggtgctcgatttagagtgagctcgttgggtttgggggaggaactgctcagttaggacccagacggaaccatgggaagccccagcgcagcttctcttcctcctgctactctggcctcccagataccactggagaaatagtgatgacgcagtctccagccaccctgtctgtgtctccgaggggaaagngtcaccctctcctgcgagggccagtcagagtggttagngcaacttagcctggtatcagcaacgaaacctggaccaggcctcccgaggcctcctcatctagtggtncactcccgaccgacgggcccacgtggtacctcccgacggtcctaggttccaggtcgggcgtaggttcggggttcgtaggggaactagggtacgtttacccaccgttcctaccgacctataccgcgtaccagtcccgttagaccgtacgttacgtaagggttaaagtttagtttttaccggtactttaaggtttttaactttaccggttcgttaccgacgtaacgttaaggttaagttaaccggttcgggttaacccgggttcccggtaacccggttacccgtttaacccgggtttaccgggggacgggttaaccggggaccggttaaggggtacgggtaaaccgtacgttaaaccgggtaaacgtacggttgggtaaccggtaccgtacggtaccctaccggttacgttcccgtttaccggg

SEQ ID NO: 225125 - DNA, 671 bp, Homo sapiens
  misc_feature: GYAE6OF02ITQJX.49.33.C11.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
  modified_base (473)..(473): a, c, t, g, unknown or other
  misc_feature (473)..(473): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgtcaccctctcctgcagggccagtcagagtgtaggancaacttagcctggtatcgagacagaaacctgggccaggcctcccgaggtctacctcgatccgtagtggtcnctaactcccaacgtacgggaccctaacgtcggtaacctcccgaacggtcctaggttaccaggtcgggtaccaggttcgggtcgtgggaacgtagtcgttacacgtcctaccgactactaccgagcacgtccgcgtacacgttacgtacgaaaacggtttnttttcggacttttaagggttttaacttacgtacgttacagggttacctaaggttaactaacgttccgggaccgggtaccgttaccggaccgttaacggttccgggacgggttaaggaccggtaggtaggtaacggaacgtaccggaaacggtacgtacggtacggacgtaccgaaccgtacgtacgttaccgttaccg

SEQ ID NO: 225126 - DNA, 636 bp, Homo sapiens
  misc_feature: GYAE6OF02FXQ27.49.33.C11.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctntcctgcagggccagtcagagtgtaggncaacttgccgtggtatcagcagaaacctggccaggcctccgaggcctccnactctagtggtncactccacgacgggcctacgttcggtacctccgacgtcccgtaggttaccgagggttcggacgtagggttgggtaccgtggggaacctagtacgttccacgtctaccaacgtatcgacgcacgctgacctaggtctaggtaagttcgtttagacttagtttaactagttacgtcctaagtacctaggttaacgttaagtccgggttaccgggtcttaccgggtaccttcggtttaccgggacgggtaaccggtacgtaagggtacggaagtaacgttaccgaaacggtacgttggtacggtacgttacggaccttacgtacgttacttcccgg

SEQ ID NO: 225127 - DNA, 550 bp, Homo sapiens
  misc_feature: GYAE6OF02IJKTQ.49.33.C11.1.454.CMB.1.raw
  modified_base (203)..(203): a, c, t, g, unknown or other
  misc_feature (203)..(203): n is a, c, g, or t
  modified_base (404)..(404): a, c, t, g, unknown or other
  misc_feature (404)..(404): n is a, c, g, or t
tcagagtcgagagacacgaccggtgctcgatttagagtgagctcgttggggtttgggggaggaactgctcagttaggacccagacggaccatggaagccccagcgcagcttctcttcctcctgctactctggctcccagataccactggagaaatagtgatgacgcagtctccagccaccctgtctgtgtctcgagggaaagngtcaccctctcctgcagggccagtcagagtgttaggagcaattgcctggtatcagcagaaacctggccaggctcccaggctcctcatctatgatgcatccacagggccacgtggtactcccagccaggttcagtgggcaggtgggtcgtggggacagtagttcacttctcaccatcagcacgcctgccagtcgtgaagttntttgacagtttttatactgtcagctaagttataagtcggtccgggtcctccgggtatacccggtttgggaccgggtacgggaccgtagggtgggaacgtacgttaacgaaacgtacgttggacggtcctaggcctacctagttccg

SEQ ID NO: 225128 - DNA, 634 bp, Homo sapiens
  misc_feature: GYAE6OF02F2CA7.49.33.C11.1.454.CMB.1.raw
  modified_base (205)..(205): a, c, t, g, unknown or other
  misc_feature (205)..(205): n is a, c, g, or t
  modified_base (314)..(314): a, c, t, g, unknown or other
  misc_feature (314)..(314): n is a, c, g, or t
  modified_base (573)..(573): a, c, t, g, unknown or other
  misc_feature (573)..(573): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngtcaccctctcctgcgagggccagtcagagtgttaggagcaacttagcctggtatcagcaacgaaacctggccaggccctcccgaggtcctcctcacttctatgggtcncactcccgaccgacgggccctacgttcggtaactccccgacgccgtaagggttcagggtcggactagggtcgggtcgtaggggaacctaggtacttccacgttctaccgacctagtacgaacgtccgacgtaccgtgcctagttcgtaggtaacgttattttgacttaagttttactacgtcgtactagtacgtaagttatagtcggtaccgggtcctaccggtacgttacggttcgggacgggtacggaccgtagggnggtaacggaactaacgaaacgtacgttggtacggtcgtacggaccacgtacgttcgtacgg

SEQ ID NO: 225129 - DNA, 816 bp, Homo sapiens
  misc_feature: GYAE6OF02G6K66.49.33.C11.1.454.CMB.1.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagtcaccctctccngcagggccagtcagagtgtagagnaacttagctggtatcagcaagaacctggaccaggcctcccgaggtcctccgtacacttctagtggtcgacctactcccgaaccgaggggaccctacgttagggtacctaccccgaggtccgaaggtttcgaacggttcggacgtagggttcggggttacgtaggggaaccgtaaggtacgtttacccacggtaccttacccgaaccgttacgttaccgaaacgtacccgtaacgggtccccgttaggtaccgtaaacgggtttaccgtaagggtaaaacgtttttacgttttacgggtaaaccttttaacgggttttttaacctttaacccggttacggtaacgtaaaccggttaaacgttaacggtttaaacggtttaccgggttacccggggttaacccggttacccggggtacttaaacccgggtttaccggggttaccggggaacgggggtaaccggtaaacggggttacgggtaacggtaaccggtaaaccttaaaacgggtaaaccggtaacgggttacggaccggttaccgaacgtaaccccgtaacgttaccgttacgtttacccg

SEQ ID NO: 225130 - DNA, 632 bp, Homo sapiens
  misc_feature: GYAE6OF02G7ZVT.49.33.C11.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (304)..(304): a, c, t, g, unknown or other
  misc_feature (304)..(304): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangtccaccctctcctgcagggccagtcagagtgtaggancaacttagcctggtatcagcaagaaacctggccaggcctcccgaggctcctcatcagtggncatccacgaggccagtgtactcccgagcctaggttcagtgctaggttgggtctagggacctaggtacgtttaccacttccgtaccgaacctacgtacgacgtacacggtccctaggaccgtacgtcgtacggtaagttacgtttacgaaccttaactttacttagttacgtactacgtacgacgtaccttaacgtacgtttacccgttaacgttacgttttacgggaccgtaacggggtaacctaaggtcgtacggaacgtaacgtaaccgaaacggtacgtacggtacgacgttacggacctaaccgtacgttccgttacgttaccg

SEQ ID NO: 225131 - DNA, 636 bp, Homo sapiens
  misc_feature: GYAE6OF02IL64D.49.33.C11.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (348)..(348): a, c, t, g, unknown or other
  misc_feature (348)..(348): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggcctcccagataccactggagaaatagtgatgacgcagtctccagccacctgtctgtgtctccgaggggaaagngtccaccctctcctgcagggccagtcagagtgtaggancaattgcctggtatcgagcaagaacctggccaggctcccgaggcctccctcatctagtggtcacctactacccgaccgacggggtccctacgttcgggtaaccnccccgagtacccgtaggtttcgagggttcggacgttagggttcgggtacgtacggggactagggtacgttccacgttcctaccaccgtatcgacgcgacgtcctagcctaggttcgtagtaagttcgtttagacgttagtttacttacgtgttacacgtataacgtaagttagtcggtaccggtccgtaccgtacgttacggtcgggacgggtaacgggacgtaagggtggaacggtacgtaacgaaacgtcgttaggtcgacgtccgtaaccgtctacgtcgttacg

SEQ ID NO: 225132 - DNA, 580 bp, Homo sapiens
  misc_feature: GYAE6OF02FNHX2.49.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagagtgttaggancaacttagcctggtatcagcagaaacctggccaggctcccaggctcctcatctatggtgcatccaccgagggccacgtggtactccccagcctaggttcagtggcaggtgggtctggggacaggtagttcacttctcaccatcagcagcctgctagtctagaagtattttgacttagttttattacgttgtacgagtactaagttaattaagtcggttccgggtccttacccgggtactaccggtttcgggacgggtacgggaccgtaaggggtagggaacgtacgtacgaaacggtaacgttaggtacggccgttacggccaaccgtattccgttacg

SEQ ID NO: 225133 - DNA, 648 bp, Homo sapiens
  misc_feature: GYAE6OF02GFQ8Q.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaattagcctggtatcagcaagaaacctggaccaggcctcccgaggcctcctcatctagtggtgcactccaccgacgggccacgtggtactcccgagcctaggttcaggtggcgtaggtgggtctggggaacaggtacgttcacgttcctaccaccatcgaacgcctacgtccctgcctaggttcgtaggtaaacgttgttttcgactttaaggtttttacttaccgttgtaccaaggtacttaaaggttattaacggttccgggttacccgggtaccgttacccgggtaacttcccgggtttacggggacgggtacgggtaaccgtaaggggtcggaacgtaaccgtaaccgaaacggttacgttgggtcggacgttacggacccaacgttacgttccgttaccg

SEQ ID NO: 225134 - DNA, 562 bp, Homo sapiens
  misc_feature: GYAE6OF02F6A55.49.33.C11.1.454.CMB.1.raw
  modified_base (203)..(203): a, c, t, g, unknown or other
  misc_feature (203)..(203): n is a, c, g, or t
  modified_base (380)..(380): a, c, t, g, unknown or other
  misc_feature (380)..(380): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaangtcaccctctcctgcagggccagtcagagtgttaggagcaactttagcctggtatcagcagaaacctggccaggctcccaggcctcctcatctagtggtgcatccaccagggccacgtggtactcccagccaggttcagtggcaggtgggtctgggacagtacgttcactctacacntcagcagcctgctagtctagtagtatttgactagtttattactgtactagtctaagtatacgtcgtccgggtccgtacgtaaccgtacgtttcgggacgggtaacgggtaccaacggggtggtaacgaacgtaacgaaacgtaacgttaggtacggtcgtacgacctaactacgtcttacgg

SEQ ID NO: 225135 - DNA, 633 bp, Homo sapiens
  misc_feature: GYAE6OF02INSK0.49.33.C11.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (609)..(609): a, c, t, g, unknown or other
  misc_feature (609)..(609): n is a, c, g, or t
  modified_base (629)..(629): a, c, t, g, unknown or other
  misc_feature (629)..(629): n is a, c, g, or t
tcagagtcgagagacacgaccggtgctcgatttagagtgagctcgttggggtttggggggaggaactgctcagttacggacccagacggaaccatggaagccccagcgcagcttctcttcctcctgctactctggctccagataccactggagaaataggtgagtgacgcagtctcagccacctgtctgtgtctcgaaggggaaanacgtcaccctntcctgcagggccagtcagagtgtaggancaattgcctgtatcagcaagaaacctggaccaggcctacccgaggcctcctcatctagtggtacncactccgaaccgagggcccagtcggtaacnccccagtcctaggttcagtcggctagggtgggtctaggggaactaggtacgtttccaaccttcgaccaaccgtataccgacgtacgacgtcctacggacgtaacgttccgtaaggtaaagttacgttttacgacgtttaagttttaacttaacgtagtacgaggtactaaggttaataacggttcggtacccgggtctacccggtacgtaacggtttccgggacggggtaacggaccgtaagggtcgaagttaacaacgaaacgtacgngtcgcgtcgactactacgtntacg

SEQ ID NO: 225136 - DNA, 631 bp, Homo sapiens
  misc_feature: GYAE6OF02JK1PU.49.33.C11.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccacctgtctgtntctccgaggggaaangtcaccctctcctgcgagggccagtcagngtgtaggncaattgcctggtatcgagcagaacctggccaggctccgagctccgtcatctagtggtcncaactccgacgaggcccagtcggtactcccgaagccgtagttccaggtcgacgtacggtgggtctaggggactaggtcttacactctaccactagtcagactacgtcctgctactacggtagtaacgttgtttacgacgtttaagttttctacgtcgttacaaggtacttaaggttaactacggttcccgggttacccggtaccgttaacccgggacttaaccgggttccgggaaccgggttacggaccggttaaggtcggaaagtaacgtaacccgaaaacgttccgttggtaaccggtcctaacgtacccgaacttcgtaccggtaccg

SEQ ID NO: 225137 - DNA, 679 bp, Homo sapiens
  misc_feature: GYAE6OF02H05VI.49.33.C11.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccagggaanagtcaccctctcctgcagggccagtcagagtgtaggagcaattagcctggtatcagcagaaacctggccaggctccaggcctcncatctatggtncatccacgagggccacgtggtactcccgagcctaggttcaggtcgggactagggtgggtcgtaggggacctagtacgttaccacgttcctaccaccgtattacgacgtccgtaacggtccttggaccgtacgtaccgttaggtaaacgttacgttttacggacttaagtttttacgttaacgttcgtactaacgtacgtaagttagttaacgtcggttacccgggtacgttacccgggtaacttaccgggttttaccggggaccggggttaacgggtaacccggttaagggtcgggtaaaggttaaccgtaaccggtaaaccggttaaccgttagggttacgggtaccttacggacccgtaaccgtacgttaccgtttaccgg

SEQ ID NO: 225138 - DNA, 181 bp, Homo sapiens; identical to SEQ ID NO: 224903
  misc_feature: GYAE6OF02HBINE.49.33.C11.1.454.CMB.1.raw
  modified_base (174)..(181): a, c, t, g, unknown or other
  misc_feature (174)..(181): n is a, c, g, or t

SEQ ID NO: 225139 - DNA, 653 bp, Homo sapiens
  misc_feature: GYAE6OF02F1S2T.49.33.C11.1.454.CMB.1.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngtcaccctctcctgcagggccagtcaggtagtgttaggagcaacttagcctaggtatcagcaagaaaccgtggccaggcctcccaggctcctactatcgtagtggtncatcccaccgacgggccacgtcggtactcccgagtccgaggttcagggttggacgtaggttcgggttcgtacggggaactaggtaacgtttccgaaccttctacccgaacctatccgaagcctacgccctgacctagtcgtaggtaaagttgtttacgttattagttttacttacgttgtacagtacgtaagttacgttaagttccggtccggtaccgttaccggtaacgtaccggtttcggggaaccgggtacgggaccgtaagggtacggaacggtaacgtaaccggtaaaacggtacgttggtacggtactaccggacctaaccgtcgttacgttacg

SEQ ID NO: 225140 - DNA, 660 bp, Homo sapiens
  misc_feature: GYAE6OF02HZME1.49.33.C11.1.454.CMB.1.raw
  modified_base (120)..(120): a, c, t, g, unknown or other
  misc_feature (120)..(120): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
  modified_base (504)..(504): a, c, t, g, unknown or other
  misc_feature (504)..(504): n is a, c, g, or t
  modified_base (646)..(646): a, c, t, g, unknown or other
  misc_feature (646)..(646): n is a, c, g, or t
tcagagtcgagagacacgaccggtgctcgatttagagtgagctcgtgggttggggaggaactgctcagttaggacccagacggaaccatggaagccccagcgcaagtcttctctcctcgngactacgtcgtggcctacgaggactacctgtcggaaactaaagtcgacgtagcgaccgcgtagtccaccgacgaccctccgtggtctggtctcccgaggaaagggaanccaccncctctgngacggcgaccgtagtnaggtagttgacncgacataacgtcgccgtagtaccagacaagacgtcgaccgtacggtccaccgagtcctcctacgtacttacgtaggttcgactcctacacccacggacgtacacgtaacggtccacccgagtaccgttaggacctgggcgacgtcggttggaccgtaggactggtaactctacgctacaccgtnacgtcacgcgtcgnagtcgtagtacgtcttacgtacgtacgtttacgttancgtacgataacgtacgttaaagttaacttcgtcgtacgtttccgtttacggtaccggaacggtaaccgtagtacgtacggtaggtaactaaccggttacgaacggtcggtaacgttcggaccgttaccgtaccgtaaccgtnttacggtccgttcg

SEQ ID NO: 225141 - DNA, 217 bp, Homo sapiens
  misc_feature: GYAE6OF02JT8V9.49.33.C11.1.454.CMB.1.raw
  modified_base (184)..(217): a, c, t, g, unknown or other
  misc_feature (184)..(217): n is a, c, g, or t
tcagagtcgagagacacgaccggtgctcgatttagagtgagctcgttgggtttgggggaagaggaagactgacggtccccccaggagttcaggtgctgggcacagcggcccgtacggctcgcctggtacgtaacggacttaccttcctctctcgactcgtagaggcggtgcgaagcggtaacgnnnnnnnnnnnnnnnnnnnnnnnnnnnnnnnnnn

SEQ ID NO: 225142 - DNA, 723 bp, Homo sapiens
  misc_feature: GYAE6OF02J21HT.49.33.C11.1.454.CMB.1.raw
  modified_base (119)..(119): a, c, t, g, unknown or other
  misc_feature (119)..(119): n is a, c, g, or t
  modified_base (209)..(209): a, c, t, g, unknown or other
  misc_feature (209)..(209): n is a, c, g, or t
  modified_base (382)..(382): a, c, t, g, unknown or other
  misc_feature (382)..(382): n is a, c, g, or t
tcagagtcgagagacacgaccggtgctcgatttagagtgagctcgttgggtttgggggaggaactgctcagttaggacccagacggaaccatggaagccccagcgcagcttctcttccncctgctactctggcctcccagactaccactggagaaatagtgatgacgcagtctaccagccaccctgtctgtacgtctaccgaggggaancgtccacccgtctcctgcgacggccaggtcagtagtgttaggcgtactacgttttacgccgtaggttactccgagacgtaacgaaccgtggacccgacgtcctacccgacgtcctacctcgattcgtagtcggtcactaccgtcccgtaccggacggtcctacgtacgtaccnccccgtagtccgtaggttcgcggtacggtactagggtcggtcgtacggaactacggtacttaccacgttaccgacttacccgacttaccgacgaccgtcgtaccctacggtaccgtacgttgtaacgttaagttccgtttacggtacctttagtttaacttccgttagtcgaacgtttacgaatttacgtaccggtttacgtacccgggttccgtaccgtccgttaaccggttcgggaccgggtaaccggttcggtaggtacggtaacgtaccgtaacggtaaccggttacgaacgggtttcgtaaccggtcggtaccctaccgtaggtttcccttaccgg

SEQ ID NO: 225143 - DNA, 685 bp, Homo sapiens
  misc_feature: GYAE6OF02GP314.49.33.C11.1.454.CMB.1.raw
  modified_base (204)..(204): a, c, t, g, unknown or other
  misc_feature (204)..(204): n is a, c, g, or t
  modified_base (305)..(305): a, c, t, g, unknown or other
  misc_feature (305)..(305): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagtcaccctctcctgcgaggccagtcagagtgttaggagctaacttgcctggtatcagcagaaacctggaccaggctcccaggcctcctcatctagtggtncctatcccaccgacgggccctagtcggtactccccgagcctaggttccaggttcggactaggttcgggtcgtaggggaacctaggtacgtttaccacgttcctaccaaccgtataccgaacggtccaacggtccgtcggaccgtaggttaccgtaaggtaaacgtttagttttacggaccgttttaaggttttaactttaccgttaggtactaacggtacgttaaaggttaacttaacggttccgggtacccgggtccgttacccgggtaaccgttaccggtttacggggacgggtaacggggtaccgtaaggggtcggtaacgtacgtaaaccgtaaacggtacgtggtacggccgtacgacctacgtacgtcgttacg

SEQ ID NO: 225144 - DNA, 684 bp, Homo sapiens
  misc_feature: GYAE6OF02IEAZR.49.33.C11.1.454.CMB.1.raw
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagaaatagtgatgacgnagtctccagccacctgtctgtcgtctcgaaggggaanagtccaccctctcctgcgagggccagtcagtagtgtagagcaacttgctggtatcagcaagaacgtggaccaggcctccgaggctcctanatctagcggtgctactaccgaccgacgggtccaactcgggtactaccccgaggaccctaggtttccgaaggtcggacgtaagggttcggggtacgttacgggggactacgggtaacgttccctacgttaccttacgacctaacgtacgacgacgaacgtccgacgtgtaccgttcgtaacgtaaggttactttacggtaacgtttagttaaccgtttaagtttctacggtacgtaagttaccgttaaataacgtcggttccggaccggttaccggttactacggttccgggtacgggacgggtacgtacgggtacgggaacgtaaactaccggaaaacggtaccggtacgggtagtaccggtaccgtaatacccggtacgttggttaacccg

SEQ ID NO: 225145 - DNA, 616 bp, Homo sapiens
  misc_feature: GYAE6OF02GP8CS.49.33.C11.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
tcagagtcgagagacacgaccggtgctcgatttagagtgagctcgttgggtttgggggaggaactgctcagttaggacccagacggaaccatggaagcccagcgcagcttctcttcctcctgctactctggctcccagataccactggagaaataggtgatgacgcagtctccagccacctgtctgtgtctcgagggaaacgngtcaccctctcctgcgaggccagcagagtgtaggacnctaacttgccgtggtactcgagcgaacgaacctcggaccnggctcccgaggtcctcgtacactctagtggtcnctactccgacgagggcctaacgtcggtactaccccgagtacccgtaggttcaggtcggcgtaggtcgggtcgtcggggaactacgttacggtaccacttccgtacaccgtatacgacggtcacgtcctcgacgtcgtacgtgtaacgtatttcgtacttaagttttactacgttcgtacgacgtacgtagtacgttacgtcgggtccgtacgtccgtacgtcggttaccgggaggacggtacgacggtaggacgtacaaccggaaacgtggtacgtcggtacctggtaccactacgttgtccg

SEQ ID NO: 225146 - DNA, 696 bp, Homo sapiens
  misc_feature: GYAE6OF02JU7JM.49.33.C11.1.454.CMB.1.raw
  modified_base (210)..(210): a, c, t, g, unknown or other
  misc_feature (210)..(210): n is a, c, g, or t
tcagagtcgagagacacgaccggtgctcgatttagagtgagctcgttgggtttgggggagggaactgctcagttaggacccagacggaaccatggaagccccagcgcagcttctcttcctcctgctactctggctcccagatacccactggagaaaatagtgatgacgcagtctccagccaccctgtctgtgtctaccgaaggggaaatntccaccctctcctgcagggccagtcaagacgtgttacggagcaaccgttagcctaggtatcgaagaccagaaacctgggccctaggtccctcccgagggccttcctcgtaactcgtagtaggtacgtcaactccgaccgacgggtcccagttcggtacaccctacggtccaggtttcgacgggttcgactacgggttcgggtaccttgggggaacctaaggtctttacggacccttgacctaaccgtactcgtacgtaccgacgtcccctggtaccgtagtacgtacggtaaagttacgttagtacgttaatttacttactagttcagtctacgttagtacgttacgggccggtaccgtaccggtaccgttacggtttacgggtaccgggtaaccggtggtaacgggtaccggaaggttaccgtaaccggtaaaccgtacggtcttacggggaccgtacgtaccggtacctaccgttagttaccgg

SEQ ID NO: 225147 - DNA, 728 bp, Homo sapiens
  misc_feature: GYAE6OF02IUK4J.49.33.C11.1.454.CMB.1.raw
  modified_base (200)..(200): a, c, t, g, unknown or other
  misc_feature (200)..(200): n is a, c, g, or t
  modified_base (320)..(320): a, c, t, g, unknown or other
  misc_feature (320)..(320): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctcagccacctgtctgtgtctccgagggaanagtccacctctcctgcgacggccagtcagagtgttaggagcaacgttagccgtggtatcagacgaagtaaaccgtggaccgacggcctacccgaggcctccgtcaattcctagtggtacncactacccgaaccgagggaccctacgtcggtacctcccgacggtaccgtaggttcgaaggtcggtacgtaggttcgggtacgtacggggtactaaggttacgttcctaccgtccctaaccgacccgtaacgtccgaaagtacccgtaacggtccccttaggaccgttacgttacggttaacggttaacgtttcgtttttaacggaacgtttaacgtttttaaccgtttacgtaggttacccgaaggtcttaaagtttaactaacggttccggtacccggtaccgttaccggtacgttacggttaccgggaacggtaccgggaccgttaagggtacggaacggttaacgtaaccggaaacgtttcggacgttccggtacttccggaacttaccgtagttccgttaccgg

SEQ ID NO: 225148 - DNA, 719 bp, Homo sapiens
  misc_feature: GYAE6OF02INHJE.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgacgcagtctccagccacctgtctgtgtctccgagggaaangtccacccgtctcctgcgagggccagtcagagtgttagagcaaacttgcctggtatcgagtcagaaacctggaccaggcctccacggctcctcactcgtagttggtgcctacgtcccgaccgcgggaccctacgtaggtactcccgacgtccgtaggttaccgaggtccggacgtaggttcgggtcggtagggtaacgaggtaacgttccacgttcctaccaaccgtacgtcgaacggtcctaaaccggtcccgttaggacccgttacgtaccgttagggttaaaccgttagttttttccggaaacgtttttaacggttttaacgttttacccgttagttacccttaaggggtaaccttaagtttaaacttaacgggtttccggttcccgggttacgttaccccggttaacgttaccggtttaccgggacgggtacgggtacgtaacgggttacggaacgtaaccgttacgaaaaccgttcgtaggtcgaccgtaggaccaccggttattgtaccg

SEQ ID NO: 225149 - DNA, 657 bp, Homo sapiens
  misc_feature: GYAE6OF02FRSZX.49.33.C11.1.454.CMB.1.raw
  modified_base (208)..(208): a, c, t, g, unknown or other
  misc_feature (208)..(208): n is a, c, g, or t
  modified_base (253)..(253): a, c, t, g, unknown or other
  misc_feature (253)..(253): n is a, c, g, or t
  modified_base (324)..(324): a, c, t, g, unknown or other
  misc_feature (324)..(324): n is a, c, g, or t
tcagagtcgagagacacgaccggtgctcgatttagagtgagctcggttgggtttgggggaggaactgctcagttaggacccagacggaaccatggaagccccagcgcagcttctcttcctcctgctactctggctcccagataccactggagaaatagtgatgacgcagtcctccagcccaccctgtctgtgtctccgaaggggaaangtccaccctctccgtgccgagggccaggtcaggagtggtaggacnctaacttagcctggtatcagcaacgaaaccgtggccaggtcctacccgaggcctcctcatcttagtggtanctactccgaaccgtacggggcccacgttcggtacctaccccgagtacccgtagggttaccaacggttcggacgttaagggtcggggtacgtacgggacaaggttacgttacaccttcaccaccatacagccagtcctggactacggtactagtaaggttactttgaaccttaaggtttacttacgtacgttacgaagtctaagttaactacggttcggtcccgggacttaccggacttaccggttcgggaaccggacggtacggaaggtggaacgtaactaaccggtaaacgtacgtggtacggaccttaggaccctaactcgtacgttaccg

SEQ ID NO: 225150 - DNA, 185 bp, Homo sapiens
  misc_feature: GYAE6OF02HZIFC.49.33.C11.1.454.CMB.1.raw
  modified_base (173)..(185): a, c, t, g, unknown or other
  misc_feature (173)..(185): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnn

SEQ ID NO: 225151 - DNA, 819 bp, Homo sapiens
  misc_feature: GYAE6OF02F59OS.49.33.C11.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtccaccctctcctgccagggccagtcagngtgtagnacaacttgcctgtatcagcagaacctggccaggcctccaggcctcctcatctagtggtcgcactccgaccgacgggcctacgtcggtacctacccgacggccgtacggttcgaggttcgggacgtaggttcggggttcgtagggggtaacctacgggtaacgtttccgaaccgttcgttacccgaacccaacgttaccgaacggtcctaaacggtccccgttacggaccgttacgtttaccgttaacgggttaaacggtttacgttttttacgggtaaccgttttaaagggtttttttaccgtttaaccgtttacggtttaaccgtaacgggtttaacccgttaaaggtttaaacgtttaaaccggtttccgggttaaccccggggttacccgttacccgggttaaccgtttaccgggttttaaccgggggacccggggttaaaccgggggttaacccggttaaagggggttaccggggtaaacggtaaaccggttaaaccgtaaaaccggttaacgtttcgggtaacggttaccggtaccggttaaccgaaacccgtttacggttaccgttacccgg

SEQ ID NO: 225152 - DNA, 648 bp, Homo sapiens
  misc_feature: GYAE6OF02JL456.49.33.C11.1.454.CMB.1.raw
  modified_base (243)..(243): a, c, t, g, unknown or other
  misc_feature (243)..(243): n is a, c, g, or t
  modified_base (312)..(312): a, c, t, g, unknown or other
  misc_feature (312)..(312): n is a, c, g, or t
  modified_base (636)..(636): a, c, t, g, unknown or other
  misc_feature (636)..(636): n is a, c, g, or t
tcagagtcgagagacacgaccggtgctcgatttagagtgagctcgttgggtttgggggagggaactgctcagttaggacccagacggaaccatggaagccccagcgcagcttctcttcctcctgctactctggctcccagataccactggagaaataggtgatgacgcagtctccagccacctgtctgtgtctccagggaaagagtcaccctctcctgcacgggccagtcaggatgttagganctaacttgccttggtatcagtcgaagtaaacctggcctaggcctcccgagcctcctcattctatcggtncatccaccgaggccaacgttggactccccgagtcctagggtttccaggtacggtcaggtcgggtcgttacggggactacggtcgttccacgttcctcaacccgtatccgtaacgcgacggtcccttacggacccgtagttacccgtagggtaaaccttgtttttcgaccgtttattttaacgtaaccgttgtaccaggtccgtaattaagttaacgttggtcccggtacgttccgaaggttccgttgggggacccgtagggtaccaagggtcggtaatacgtacgtaaaaccggtgttacggcggtacgtcgtacctaaccgtnttccgttaccgg

SEQ ID NO: 225153 - DNA, 175 bp, Homo sapiens; identical to SEQ ID NO: 224707
  misc_feature: GYAE6OF02GD95R.49.33.C11.1.454.CMB.1.raw
  modified_base (173)..(175): a, c, t, g, unknown or other
  misc_feature (173)..(175): n is a, c, g, or t

SEQ ID NO: 225154 - DNA, 590 bp, Homo sapiens
  misc_feature: GYAE6OF02GDP6L.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttaggagcaacttgcctggtatcagcagaaacctggccaggcctcccgaggcctcctcatctagtggtgcactcccaccgacggggcccacgttcggtactccccgagtcccgtaggtttccaggtcgggcgtaggttcggggtaccgtggggaactaggtacgtttcaccttcctccaacctatcagccacgcctgcagtctaggtaagtgtttgacttagtttacttacgtgtcagtctaagttatacgtcggtccggtctaccggtactccggttcgggacggtacgggtaccgagggtggaacgtacgtaaccgaaacgtacgtcggtcggactgaccacgtactcgttcg

SEQ ID NO: 225155 - DNA, 697 bp, Homo sapiens
  misc_feature: GYAE6OF02F966M.49.33.C11.1.454.CMB.1.raw
  modified_base (245)..(245): a, c, t, g, unknown or other
  misc_feature (245)..(245): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (412)..(412): a, c, t, g, unknown or other
  misc_feature (412)..(412): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccacgtggagaaatagtgatgacgcagtctccagcccaccctgtctgtgtctccgaggggaaagagtcaccctctcctgcagggccagtcagagtgttaggancaacttagcctggtatcagcaagaaccgtggaccaggcctcccgaggcctcctcatctagnggtcncactccgaccgagggcctacgtgtacctaccacgacctaggttcaggtcggagtaggttggggtacgttacggggacaagtacggtttaccacgtttaccncccaacgtacttaccagccgacgcccgtacgacgtagtccgtaaggtaacgtttacgttttacgacctttaaagtttttacgttacgttacgttactacggtacttaaggttaactttacggttaccgggttacccgggtacccgttacccgtaggttaccccggtttccggggacggggtaaccgggtacccgtaaggggtacggtaacggtaacctaaccgggtaaaaccgtggttaaccggtggttacccgacgtaacccgtacgttaccgttagtttaccg

SEQ ID NO: 225156 - DNA, 758 bp, Homo sapiens
  misc_feature: GYAE6OF02GII7B.49.33.C11.1.454.CMB.1.raw
  modified_base (204)..(204): a, c, t, g, unknown or other
  misc_feature (204)..(204): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctaccgaggggaanagtccaccctctcctgcagggccaggtcaggacgtggttaggacgtacaacttacgccgttggtactcgagcaacggaaaccttggaccaggtcccgtccccgagggtcccttcccgtactacttaccgttaggtcggtacgactactcccgaaccgtacggggaccctacgtacggtacctaccccgacggtacccgtacggtttccaaggtcggtaccgtaacggggtttcggggtaccgttacgggggtaacctaaggttaccgggtttaccctacccgttaccttaccccgaacccgttaacgttccgaaacggtccgtaaccgggtccccgttcgaacgttaccgttacggttaacggtaaacgtttacgttttacggacgttttaacgtttttacttacggttacgtaccagtacgtaagttaacgtaacgtccggtaccggtcgtacccggttaacgtcgttacgggacgggtacggtacgtaggtacggacgtaagtaccggaaacgtcggtagcggtacgtacggactaccgtcgttcgttaccg

SEQ ID NO: 225157 - DNA, 553 bp, Homo sapiens
  misc_feature: GYAE6OF02FPC1W.49.33.C11.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttaggagcaaacttagcctggtatcagcagaaacctggccaggctccaggctcctnatctatggtncactccaccgagggcccacgtcggtactccccgagccaggttcagtggctaggtgggtctgggacaggagttcacgtctcaacntcagcagcctgctagtctagaagtntttgctagtttattactgtcagtctagtaatagtcggtccgggtcttccggactacgtttacgggacgggtacgggacgaagggtaggaagtaacgtacaaacggtaacgtggtacggtcgtcggacctaccgtactcgttcg

SEQ ID NO: 225158 - DNA, 667 bp, Homo sapiens
  misc_feature: GYAE6OF02JKJV1.49.33.C11.1.454.CMB.1.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaangtcacccgtctcctgcgacgggccagtcaggagtgttaggancaacttgcctggtatcagcacgaaacctggccaggcctacccaggcctaccgtacactctagtcggtcgctaacgtcccacgacggggcctaacgtggtacctccccgagccgtaaggttcaggtcgcgtagtgggtctaggggactaggtacgtttccaacttccgtcaaccgtagtaccaaggcctaacgtccgtagtacctaggttacctaggaacgtttgttttacgacgtttaacggttttaacttacggtcgtaccgaaggtaccgtaaggtttactaacggttccggtacccgggtaccgttacccggtaacgtttaccggtccgggagggtacccgggtacgtaacgggtacggacgtacgttaacgaacggtacgttgggtcgtacggtacgtaaccgacgtagtccgttcg

SEQ ID NO: 225159 - DNA, 178 bp, Homo sapiens; identical to SEQ ID NO: 224989
  misc_feature: GYAE6OF02F5Z2Q.49.33.C11.1.454.CMB.1.raw
  modified_base (173)..(178): a, c, t, g, unknown or other
  misc_feature (173)..(178): n is a, c, g, or t

SEQ ID NO: 225160 - DNA, 656 bp, Homo sapiens
  misc_feature: GYAE6OF02GDM0R.49.33.C11.1.454.CMB.1.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctcgaggggaangtcaccctctcctgcagggccagtcagagtgttaggagcaacttagcctggtatcagcaagaaacctggccaggcctcccaggcctcctcatctagtggtcncatcccaccgacgggcccagtcggtactcccgagcctaggttcaggtggcaggtcgggtcgtggggactaggtacgttccacttcctaccaacctagtcacgccgacgccgtgactacgtcgtaagtaacgttattttacggctttaagtttttacttacgttgtacctaacgtacgttaagttacgttaacgttcgggttacccggggtccgttaacccggtacgttacccgggttttcggggaccgggtaacggggtaccgtaaggggtacgggtaacggaacgttaaccggaaaacggtacgttacgggtacggtccgtaggacccgtaaccgtacgttccgttaccgg

SEQ ID NO: 225161 - DNA, 746 bp, Homo sapiens
  misc_feature: GYAE6OF02I57XK.49.33.C11.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
tcagagtcgagagacacgaccggtgctcgatttagagtgagctcgttgggtttggggaggactgctcagttaggacccagacggaaccatggaagccccagcgcagcttctcttcctcctgctactctggcctcccagataccactggagaaatagtgatgacgcagtctccagcccacctgtctgtgtctccgaggggaangtccacctctccgtgcacggccagtcagagtgtagngctaatgcctggtancagcaagaaccgtggccaggcctcccgaggcctccctacattctagtcggtnaccgactacccgaccggcgggtcccacgttacggtactcccccgtaaggtaccgtacggtttcgaggttcgggaccgtgggttacggggtcgaggggtaactagggtacgttaccacgttccgtaccaacctataccgagacccgtacgtaccctcgtacgtagtaccgttaaggtaaacgttcgttttacggaccttttaacggttttaacgttacgttacggttacgtacggtaacgttaaggtttaaacgttaacgggtttccgtacccggggttaccccgttaccgggtaacccggttacccggtttaccggggaccggggtaacggggtacccggtaaggggtacgggtaaggtaaccgtaaaccgtaaaccgggttaaccgttcgggttaccggtacgggtaccgtacccggtaacccgtaccgttgttacccgg

SEQ ID NO: 225162 - DNA, 729 bp, Homo sapiens
  misc_feature: GYAE6OF02ICIGQ.49.33.C11.1.454.CMB.1.raw
  modified_base (202)..(202): a, c, t, g, unknown or other
  misc_feature (202)..(202): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagccacctgtctgtgtctccgagggaanagtccacctctcctgcgagggccagtcagagtagttaggagactaacttacgccgttggtactcagccaacgtaaacccgtggaccacgggccctacccgaggtcccttaccctacacttccttaaggttcgggtacaccacctccccgaaccggacgggtccctaacgttacggtacctccccgaggtcccgtaacggttccgagggtcggacgtaggggttcgggtaacggtcggggaactggtacgttacccacttcccgtaaccaacctacgtacgtacgaccgtacggtccctacgtaccgtagttaccgtaaggttaagttttcgttttacgtacgtttaagtttttactaccggtttagtacccgtaagtaccgtaaggttaacttaccgggttccgggtacccgggttaccgtacccggttaacgttaccgggttacggggaccgggtaacggtacgtagggtacgaacgtaccgtaacgaacgtagtacggacgtcgtacgacgtactcgttacctcg

SEQ ID NO: 225163 - DNA, 734 bp, Homo sapiens
  misc_feature: GYAE6OF02IJOVG.49.33.C11.1.454.CMB.1.raw
  modified_base (203)..(203): a, c, t, g, unknown or other
  misc_feature (203)..(203): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtctccagccacctgtctgtgtctcgaggggaaanagtcaccctctcctgcagggccagtcagagtgttaaggagcaattagcctaggtatcagacaagaaaccctggaccaggcctcccgaggcctcctacattcgtagtcgggtcacactaccaccgagggacctacgtggttaactccccgagtccgtaaggtttccagggtcggtacaggggttaccgggtcgtacgggggacctagggtacgtttacccaacgttccgtaccaacccgtagtaccgaacgtaccgacggtcccgtacggaccgtacgtaccgttaggtaaacgttagttttacggtacgtttacgttttaacgtttaacttacggttaccgaagtaccgtaacgttaagtttaacgtttaacgttacgggttacgttttaccgggtttttacgggaaccggttaaccggggtaacctaacgggtacgtaacgggttaacggtaactaacggtaaacggtaaccggtaacgtttacgggtacggtaccgttacgtacccgtaaccgttacgttccgttaccg

SEQ ID NO: 225164 - DNA, 691 bp, Homo sapiens
  misc_feature: GYAE6OF02G72KT.49.33.C11.1.454.CMB.1.raw
  modified_base (202)..(202): a, c, t, g, unknown or other
  misc_feature (202)..(202): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccatggagaaatagtgatgacgcagtctccagccacctgtctgtgtctccgaggggaaangtcaccctctcctgcacgggccagtcaggagtgtaggagcaaacttagcctggtactctagcaacgaaaccgtcggaccgaggcctccagggcctaccctctacttctaagttcgggtcgtacctacgtcccaaccgaacgggaccgtacgtaggtacctaccccgacgtaccgtagggttcacggtgggtacgtaggttcgggtacggtacgggtaacaagggtacgtttaccaccgttacctaccgtaaccctaacgtacgaacgtccgaacgtcccgtcggtacctacgtactaggtaacgttattttggtactttacgtttattccgtagtaccgtacgtactaagttaactacgtcggttccggtaccgttaccgtacgttaccggttcgggacggtaacgggacgtaacgggtacgaacgtacgttaaccgaaacggttaacgtcggtacggtcgtacggtacctaacgtattccggtaaccg

SEQ ID NO: 225165 - DNA, 736 bp, Homo sapiens
  misc_feature: GYAE6OF02IB6JA.49.33.C11.1.454.CMB.1.raw
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
tcagagtcgagagacacgaccggtgctcgatttagagtgagctcggttgggtttgggggaggaactgctcagttaggacccagacggaaccatggaagccccagcgcagcttctcttctcctgctactctggcctcccagataccacgtggagaaatgtgatgacgcagtctccagccacctgtctgtgtctcgaggggaaatgtccaccctctcctagcagggccagtcagngtgtagngacattcgctaggtatcaggacaacgaacgtcggaccacggtacctcccgaggtcctccctagtataccgtgtcggacgtactaccgtccgacggaccgggtcctaacgtcgggttaccctcccggaaggtccccgtaggttacccagggttcgacggtcggttcgggtcgtacggggaccttaagggtacctttccgaaccgtttccaccgtaacccgtagttaccgaacggtccgtaacgtcccgtaggtcgtaacggtaccgtaaggtaggtttactttcgggaacttttacgttactttacgtacggttccgaaaggttagttaacgttaagtaccgttccgggttacccgggtaccttccgggtaaccgtttaccgttacggggtaccgggtaacggacgggttaacggtacgggaacggtaacctaaccgggtaaaacgttcggttcggtaaccggccggttaagaccccgtaattccggttccgttacg

SEQ ID NO: 225166 - DNA, 762 bp, Homo sapiens
  misc_feature: GYAE6OF02F8YKW.49.33.C11.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
  modified_base (550)..(550): a, c, t, g, unknown or other
  misc_feature (550)..(550): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccccgtntgtgtctccgaggggaaangtccaccctctcctgcgacgggccaggtcagtagtggttagggagctaagttacgcctggtatcagcaagaaaccgtggacctaggcctacccgaggcccttcccgtcacttcttaggtcggtcgcctaacgtcccaaccggacggggtcccctacggttcggttacctaccccgacgtcccgtaacgggttccaaggttcgggacgtaggggttcggggtacgtaggggacgtaaggtacgtttccgtaactccttaccgaacctacgtaccacgacaccgtccgtagccgtacgtcgtagtaagttacgttttacggtactttaaaggtttttacttacggtntaccgtaagtaccttaaaggttaacttaacgggtttccgggtacccggggttaccctacccgggttaacgttaccgggtttacccggggacgggtaaccgggaaccgggttaggggtacgggtaacggtaaccgtaaccggaaaaccggggttcgttacgggtacggacggttaccgaacccgtacccttcgtttaccggtccgttttaccg

SEQ ID NO: 225167 - DNA, 677 bp, Homo sapiens
  misc_feature: GYAE6OF02I3CT2.49.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgcttactctggctccagataccactggagaaatagtgatgacgcagtcctccagccaccctgtctgtgtctcgagggaagngtcaccctntcctgcagggccagcagagtgtaganacaacttgcctgtatgagcacaaccgtgcagcctcgagctctactgtctagtcggtanccngtacccaccgtaagggacctagtcgtaccgtccgacgtacaggttcaggtcggaccgtaggtcggggttaccagggtacacgttgtaccgaccttctcgaacctaggtaccagctaacgccgtagtcctagggtactaggtaaatttacggttgtaacgttacttttaacggttcgtacgttacggactaacgttaagttaacgtttagtacccggggtttccccgggaaccttaaccccgggaccgttttaacccggttagggggaaccccgggttaaggacccggtaaaggggtcggttaaacggaaccgttaaccggtaaaacgtacgggttcgttacggccgttaccgaacgttaccgtaagttcccgttaccg

SEQ ID NO: 225168 - DNA, 637 bp, Homo sapiens
  misc_feature: GYAE6OF02JCMYC.49.33.C11.1.454.CMB.1.raw
  modified_base (445)..(445): a, c, t, g, unknown or other
  misc_feature (445)..(445): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtcgtctccgagggaaagcgtaccaccctctcctgcgagggccagtcagtagtgtagagctaactagcctggtatcgagacgaacgaaccgtcggaccacggtcctcccgacggtcctccgtactacgtactagtggtcgtctacgtaccaccggtacggacctaccgtgtacctcccgacgtaccggtagtcgaacggtcgcgtaggttcgggtcggtcgggacgtagtacgttcaccttcgtaccactagtccagacncgctgcctagtcgtagtagttacgtttgtacgtttagttattcgtacttcgacgtagtaagttaactaggtacgggtacccgtacgttccggtaacgttacggttccgggacggtacgggtacgtaagggtacggtaacgtacgtaaccgtaaacgtagtcgggtacgcgtacgacctacggtatcgttacg

SEQ ID NO: 225169 - DNA, 667 bp, Homo sapiens
  misc_feature: GYAE6OF02HHCGM.49.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
  modified_base (353)..(353): a, c, t, g, unknown or other
  misc_feature (353)..(353): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgagggaagngtcacctcnctgcagggccagtcagagtgttacggancaacttagccgttaggtatcgaagcgaacggaaaccctgggacccagggcctaccccgaggcctccctcattcctatggtncctatcccgaccgtaggggcccacgtggtacncccccgagccgtagttccgaggttcggcaggttggcgtggggacaggtacgttcacgtcctacactagtcacgtcacgcctgcacgtactgaacgttattttgaccgtttagtttacttacgttcgtatacggtcctaagttagttaaacgtggttaccccgggtacggtttaccccgtaacgtacccggttttacgggggacgtaaccgggggtaccgtaacggggtacgggtaaagaacccggttaagtaaaacccggtagtttaccgggaaggtcccgtaccggacccgtaaccttacgttcccgttaacg

SEQ ID NO: 225170 - DNA, 735 bp, Homo sapiens
  misc_feature: GYAE6OF02I4YOE.49.33.C11.1.454.CMB.1.raw
  modified_base (151)..(151): a, c, t, g, unknown or other
  misc_feature (151)..(151): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactgganaaatagtgatgacgcagtctccagccaccctgtctgtgtactccgagggaaagtatccgaccctctctgccagggccagtcagtagtgttaggagcaacgttagccttggtactcagcaacgtaaacctggaccaggtcctaccccgaggtcctacccgactagttacctaagttggtacgtcctaacgtccccaaccggtacggggcccctaaacgggtttcgggtaaacctcccccgaaacggcccctaaaggggttttcccagggttccgggaccgtaggtttccggggggtaccttacgggggaaactgggtagtttacccacggtttccctaaccggacctacgtaccgaacgtaccacgtccgtcgactacgtctacgtaagtacttttgacttagttttacgttactgtactagtactaacgttactagttccgtccggtccgttaccggacgtttaacccggttcgggaacggggttaccggaccgttaagggtacggtaacggtaaccgttaacgtaaacccggtacgttacgggttaggtaccgtacggaacccgtaccgtagtaccgtttccg

SEQ ID NO: 225171 - DNA, 635 bp, Homo sapiens
  misc_feature: GYAE6OF02GQZ18.49.33.C11.1.454.CMB.1.raw
  modified_base (205)..(205): a, c, t, g, unknown or other
  misc_feature (205)..(205): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaangtccaccctctctgcgaggccagtcagtagtgtaggagctaacgttgccgttaggatcagcaacgaaccgtggaccaggcctacccgaggcctccctgaattctagtggtcgacctactcccacgcgggacctacgtggtactccccgagtcctaggttcaggtggctagggttcgggtactcgggaataggtacgttcaccgttcaccacctatcgacgcacgtcctgaccgtagttacgtagtaacgttagtttacgtacgtttagtttacttacgttcgtacgtagtacgtagttaattagtccgggtccggtaccgttcccggtaacgttacgttacggggacggacgggtaccgaaggtacggtaagtaacgtacggtaaaccgtacgtggttaccggtcgaccgtactaccgtagtcgttaccg

SEQ ID NO: 225172 - DNA, 785 bp, Homo sapiens
  misc_feature: GYAE6OF02H2DPR.49.33.C11.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctccagataccactggagaaatagtgatgacgcagtcctccagccaccctgtctgtgtcctcgaaggggaaangtccaccctntcctgacagggccagtccgaggagtggtaaggngactaaacgttagccttagggtactccgaagacaacgaaacctgggaccaaggcctccccgaaggcccttcccgtacaacttcgtaagtcggtaacggccctaaactcccggacggtaacgggtaccctaaaccgttcggtactaccccggacggtaccgtagggtttaaccaggggttccgggtactaacggggtcggggtaacgtacgggggaacctaacgtacggtttcccaaccgttccaccggaaaccttgtaccggaacgtaccgaccgtaccgttcggaacttaacggtacgtaaaggtaacgtttagttttaccgaacgttttaacgtttaacgttacgttacgtagtaacggtccgttaaagtaacggtttacgtaccgggttacccgggtacgtttacccgggacgtttaaaccgggttacgggaaccggggttaaccgggtaaccgaaggggtaccgggaaacgtacgtaaacggaaacggttcgtacggtcgtacgaccgttactaaccgttacgtacctacgg

SEQ ID NO: 225173 - DNA, 722 bp, Homo sapiens
  misc_feature: GYAE6OF02JWUQN.49.33.C11.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgacgcagtctccagccaccctgtctgtgtctccgagggaagngtccaccctctcgtgcaggccagtcgngagtgtagagacagttagcttaggtntcgagccaagaacctgccaggctccgagcctcacntntagtggtatcactacccaccgcggcctacgtacgtactaccccgngaccttcggtcacgggttcggcgtaggtgggtcgtcggacgtgtacgttcactccgtaccgactacgtcgacgccgtacgtcccgtaggactcggttacttagggtaactttgtttaccgttaagtttacggttttaactttaccggttacgttacaaccggtttataacgtttaaccggttagtttcccggggtaaccccggtttaccggttaccccggttaccggttaacccgggtttcgggaacccggtacccggggtttaaccgggaggtttaaccgggaacggtttaacccgttaaagggtaaacccccgttagggttaccggtaccggttccgtaaccggtaaccttacccggtaccggtttaccgtttaaccccgg

SEQ ID NO: 225174 - DNA, 627 bp, Homo sapiens
  misc_feature: GYAE6OF02GJMME.49.33.C11.1.454.CMB.1.raw
  modified_base (205)..(205): a, c, t, g, unknown or other
  misc_feature (205)..(205): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngtcaccctctcctgcagggccagtcagagtgttaggagcaacgttagcctggtatcagcaagaacctggcccaggccctcccgaggtcctcctcatcgtatggtcncactccgaccgngggccctagtggtctcccgagtccgtaggttcaggtggcaggttggggtctgggacagtacgttcaccgtcaccactatcgacgcacgtcctagctagtactagtaagttatttcgtacttagttttacgttagttgtacctaggtacgtagttaaacgttaggtacgggttcccgggtccgtaacccgggtacttaccgggttcgggaccgggtacgggtaccgtaagggttacggaacggtacgtaaacgaaaccggtacggttaggtacggtacgtccgtacctaaccgttcgttcgttcg

SEQ ID NO: 225175 - DNA, 619 bp, Homo sapiens
  misc_feature: GYAE6OF02GWFB5.49.33.C11.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (421)..(421): a, c, t, g, unknown or other
  misc_feature (421)..(421): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccatggagaaatagtgatgacgcagtctccagccacctgtctgtgtctccgaggggaaangtcaccctctcctgcagggccagtcagagtgttaggancaacgttgccttggtatcagcagaacctggccagctcccaggtcctcctacatctatggtncactccaccgagggcctacgtggtaccnccccgagtccgtaggttccaggtcggactagggttcgggtcgtagggaacgtaggtacgtttccaaccgttctacccacctagtacacgacncgtacctcgtcctacgtactggtaagtacgttttagtcttagtttacgttacgttcgttacgtagtacgtagtaatacgttcggtccgggtccgtaccggtacgtaccgtttccgggacgggtacgggacgtagggtacgggtaagtacgtaacgtaaacgtaacgtaggtacggcgtacgtacgacctagtacttcg

SEQ ID NO: 225176 - DNA, 722 bp, Homo sapiens
  misc_feature: GYAE6OF02HODZR.49.33.C11.1.454.CMB.1.raw
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (377)..(377): a, c, t, g, unknown or other
  misc_feature (377)..(377): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctccagactaccactggaagaaatagtgatgacgcagtctccagcccacctgtctgtgtctcgaggggaaagntccnccctctcctgcgacgggccagtcgagagtgttagganctaattcgcctggtactcgagacacgaaaccgtggaccgagccctaccgacggtcctcccgtacacttacgtagttagggtccactacttaccccgaaccggacggggtcccctaaggttacggttaccnccccgaacggtccgttaagggttcctaaggggttccgaccgtacggggttcgggttaccgtaacggggaacgttagggtaaccgttctaaccgttcaccgtaaccatacgacgactacggccttcgacgtacggtacgtacgtaaggttacttacggtacttttaaggttacttcgttagtccgagttacgtaagttaacgttacggtaccggtcccggtacgttaccggtacggttacgtaccggggtacggaaccgggttacggtagggttacggaacgtaacgtaacggaaaccgttaggtccggttacggacctacgtaccctacgttaccgtacgttacg

SEQ ID NO: 225177 - DNA, 690 bp, Homo sapiens
  misc_feature: GYAE6OF02IVG9Z.49.33.C11.1.454.CMB.1.raw
  modified_base (204)..(204): a, c, t, g, unknown or other
  misc_feature (204)..(204): n is a, c, g, or t
  modified_base (441)..(441): a, c, t, g, unknown or other
  misc_feature (441)..(441): n is a, c, g, or t
tcagagtcgagagacacgaccggtgctcgatttagagtgagctcgttgggtttgggggaggaactgctcagttaggacccagacggaaccatggaagccccagccgcagcttctcttcctcctgctactctggcctcccagataccactggagaatgtgatgacgcagtctccagccacctgtctgtctcctccgaggggaaancgtccaccctctccgtgcgacgggccagtcagagttggtacggagcctaactagcctaggtactccagctaacggaactcggaccgtacgccgtacccgacggtcctacctactactctagtcggtcgtccaatccgaccgacggccgtactggtacctcccacgtcgtacggttcaggtcggacgtcgggttacggtcgtcggggtacaggtacgtctacgtctaccactacgtancgacaccggtcctacgtcgacgtacgtaacggtaagtttcgtttagttactttacggtttaacttacgttacgtaccgtagtaacgtaagttacttacggtacgggttccggtaccgtccggtaaccgttacccgggttagggaccggggtaccgggtacggtagggtacggtaacggtaaaccggttaacgaaaccggttacggtacgtacggtaccaccgggtacctaccgttactacgtttcccgg

SEQ ID NO: 225178 - DNA, 189 bp, Homo sapiens
  misc_feature: GYAE6OF02HWK63.49.33.C11.1.454.CMB.1.raw
  modified_base (177)..(189): a, c, t, g, unknown or other
  misc_feature (177)..(189): n is a, c, g, or t
tcagagtcgagagacacgaccggtgctcgatttagagtgagctcgttgggtttggggggaagaggaagactgaccggtccccccaggagttcaggtgctgggcacagcggccctgggctgcctggtcaaaggactacttcctctctcgactctgagcgggctggcaaggcgcatagnnnnnnnnnnnnn

SEQ ID NO: 225179 - DNA, 756 bp, Homo sapiens
  misc_feature: GYAE6OF02HMUJ5.49.33.C11.1.454.CMB.1.raw
  modified_base (216)..(216): a, c, t, g, unknown or other
  misc_feature (216)..(216): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaattgtgttgacacagtctccggccacctgtctttgtctccgagggacagtcgccacctctcgngcgaggccagtcagacgtgttagtacgcttcttacgcctaggtaaccaacgtaacgaaaaccgtggaccctaacgggcctaccccgaaggtccctccgtacacttactagtcggatcgactacgtacccaacggtacggacctacgtacggacctaccgtaccccgaacgccggttaacggttacgacggttacggacggtaggtcgggtttactagggttaccgaaacgtaacggttacctttccgtaaccttcccgtaacccgtaaacctacgttaacgaacgtacccgacggttaaacccgaacggaaccggtaacccttaagggaaaccgttacgtttacggtaacgtaccgtttaaaggttttaacctacggttacggtactacggccgtaagtaccgaagtaccgagtttccgccgtattacggtaccgttaggggaccggtaacgggtaccgtaagggttacggaagtaaacgttaacccggaaaagtccggtaggttacggcctaagtacccgaactaccggttactaccgg

SEQ ID NO: 225180 - DNA, 713 bp, Homo sapiens
  misc_feature: GYAE6OF02IGZKQ.49.33.C11.1.454.CMB.1.raw
  modified_base (237)..(237): a, c, t, g, unknown or other
  misc_feature (237)..(237): n is a, c, g, or t
  modified_base (372)..(372): a, c, t, g, unknown or other
  misc_feature (372)..(372): n is a, c, g, or t
tcagagtcgagagacacgaccggtgctcgatttagagtgagctcgtttgggtttgggggaggaactgctcagttaggacccagacggaaccatggaagcccccagcgcagcttctcttcctcctgctactctggcctcccagataccactggagaaatagtgatgacgcagtctccagcccacctgtctgtgtcctccgagggaaagcgtccaccctctcctgcgaggccagtcagngtgttaggagacaactagcctgtatcagcagaaccgtggccagcctccgagcctcctacatcctagtggtcacactacccaccgacggacctacgtcgtacctccacggcgtaggtcaggtgcgtaggtggtcgnggactgtacgttccaccttcctaccaccgtactacgtacgccgacgtcccgtcgaccgtaggttaccgtaggttaacggtttagtttacgttaacgtttacggttttttaacttccgtttacgtacgtaacgtacgttaaacggttaacgtttacgttaccgggttacccgggttcccgttacccggggttaacccgttaccgggttttaccggggaccggggttaaccggggaaccgttaacgggggtaacggtaccgggtaaaccgtaaccgggtaaacggttaaccggttaggtaccggtacgttacccggacctaccggttaccgttccgttaccgg

SEQ ID NO: 225181 - DNA, 687 bp, Homo sapiens
  misc_feature: GYAE6OF02FHDMZ.49.33.C11.1.454.CMB.1.raw
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
  modified_base (304)..(304): a, c, t, g, unknown or other
  misc_feature (304)..(304): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggaagaaatagtgatgacgcagtcctccagcccaccctgtctgtgtcctccgaaggggaacngtccaccctctcctgccgagggccagtcagagtgtagganctaacgttgccgtgtactcagcaacgtaacgtggccgaggcctcccgagcctcnctatctagtcggtgctacgttaccgaccggtacgggccctaacgttggtacctaccccgtagtaccgtaggttcgaagggtcgcgtaggttcgggtcgtacgggacaaggtacttacaccttaccgtacccaacgtactccgagaccctacgaccgtcgacgtacgttacaaggtaaacgttgttttacgacgtttaacgttttacttacggtcgttactaacgtacgtaaagttactttaacgtaccgttagggtttcctttttacgggttacggaccggtaacgggtaaccgtaacggttcgtaagggaacgttactacggaaaccgggtactaacggttaggtcggtacctaaccggtcctaaccgttagttcttaccgg

SEQ ID NO: 225182 - DNA, 635 bp, Homo sapiens
  misc_feature: GYAE6OF02JWP0V.49.33.C11.1.454.CMB.1.raw
  modified_base (189)..(189): a, c, t, g, unknown or other
  misc_feature (189)..(189): n is a, c, g, or t
  modified_base (262)..(262): a, c, t, g, unknown or other
  misc_feature (262)..(262): n is a, c, g, or t
  modified_base (470)..(470): a, c, t, g, unknown or other
  misc_feature (470)..(470): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgacgcagtctccagccacctgtctgtntctccgagggaagacgtcaccctctctgcgaggccagtcgagtagtgtaggagactaacgttagcctaggtancacgcaacgaaaccgttggccgtaggccctaccgacggtcctccctactacgttcgtacgtggtcacgttcacccgtaccggaccggaccgtacgtacgtaccgtcccgacgtaccgtaggttacgaggtcggtctagggtgtcggaggtacgtagtacgtcgtctaccgtagcctgtacagtcagtcagtcgcgtagtagttagttnttcggtattacgtttanaccgttgtancgtacgttagtacgtagttccgggtacgtcgtaccgtaccgttcggtacgggacgtagggaccgtggtaagggactaaggtaacccgtaagaccggttcggtacgaccgttaccggacctaccgtggtaccgtttccg

SEQ ID NO: 225183 - DNA, 695 bp, Homo sapiens
  misc_feature: GYAE6OF02HM9HK.49.33.C11.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggctcccagataccactggagaaatagtgatgacgcagtcctcagccacctgtctgtgtctccgaaggggaancgtccaccctctctgcgagggccagtcaagngtgtaggacactaatgctggtancgagacaacgaaccgtggaccgacggcctcccgaggtcctcctctacttcgttagtcgggtcacctactacccgaccggacggtcctacgttacggtacctcccgagtccgtaggttcgaggttcgacgtgggtcgggtcgacgggactaggtacgttactactcgtaccaccgtatcgacgcgacgtccgtacgctacggtactaaggtatttacgttttcgaacgttttagtttacgtcgttacgtactacggtattaaggtttaacgtacgttcggggttacccgggtacgttacccggttaacggttacggttccccgggaaggggtaccgggacgggttaaggtacgggtaaacggtacccgtaaacggtaaaccggttggtaccgtacgggtccgttaacccggacctttaacgttgttccggtttaccgg

SEQ ID NO: 225184 - DNA, 757 bp, Homo sapiens
  misc_feature: GYAE6OF02JZ9E5.49.33.C11.1.454.CMB.1.raw
  modified_base (169)..(169): a, c, t, g, unknown or other
  misc_feature (169)..(169): n is a, c, g, or t
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (479)..(479): a, c, t, g, unknown or other
  misc_feature (479)..(479): n is a, c, g, or t
tcagagtcgagagacacgaccggtgctcgatttagagtgagctcgttggggtttgggggaggaactgctcagttaggacccagacggaaccatggaagccccagcgcagcttctcttcctcctgctactctggcctcccagactaccactggagaaatagtgatgacgnagtctccagccaccctgtctgtgtcctaccgaaggggaanacgtccaccctctcctgccaggccagtnagagtgtagganacaacgttagccgtggtactacgagacaacgaaccgtggaccgtaggccccttaccccgaggtacccttcccgtactaaccgtaccgttagttcgggtacaaccctactaccccggacggtaacgggtccctaacgtacggtacctccccgaacgtccgtagtccgaggtcggacgtcggtgggtcgtacgggaacgtagtacgttcaccgttcctaccgaatactcganaccgaccgttcggactacgtaacttcgtaaaggtaacgttcgttttggaaccgtttagttttaacgtattccgtaacgtagtaccggtttaattaaacggttcggttacccggttcccgggtaaccttaacccggtacgtttaccccggggttggggaaaccgggtaccgggaaacgggtttaggggtaacggtaacggtaacctaaaccggggtaaacgttacccggagggttacggttaccgaccggttaacccaacggttcgttcggttaaaccg

SEQ ID NO: 225185 - DNA, 698 bp, Homo sapiens
  misc_feature: GYAE6OF02JF9J0.49.33.C11.1.454.CMB.1.raw
  modified_base (111)..(111): a, c, t, g, unknown or other
  misc_feature (111)..(111): n is a, c, g, or t
  modified_base (154)..(154): a, c, t, g, unknown or other
  misc_feature (154)..(154): n is a, c, g, or t
  modified_base (211)..(211): a, c, t, g, unknown or other
  misc_feature (211)..(211): n is a, c, g, or t
  modified_base (443)..(443): a, c, t, g, unknown or other
  misc_feature (443)..(443): n is a, c, g, or t
  modified_base (461)..(461): a, c, t, g, unknown or other
  misc_feature (461)..(461): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (520)..(520): a, c, t, g, unknown or other
  misc_feature (520)..(520): n is a, c, g, or t
  modified_base (583)..(583): a, c, t, g, unknown or other
  misc_feature (583)..(583): n is a, c, g, or t
tcagagtcgagagacacgaccggtgctcgatttagagtgagctcgttgggtttggggagaactgctcagttaggacccagacggaaccatggaagccccagcgcagcttcncttcctcctgctactctggcctaccagactacccgactggaanaaatagtgatgacgcagttcctaccacgcccacctgtctgtctctaccggagggaancgtccaccctctcgtgccgagggcctaggtcaagggtgttacggttaacgggactaccttaaacggtttacggcccgttaggttaaccttcggaacggaccttaaaggaaaacccttccggggaaccctacggggtccccttcccccgaagggtcccttaaccctccgtaagttacccgtagtacgattacggcaccgttacccgaaagtccgggacccagtcggacctacncccgacgcgtagttccgngttcggacgtggttcggcttacggganacctaggaccctttnaccctcgtacaccgtanccgaacggcaccggtacagcccgtctaggtaatcttcgacgtcttacgttttcattccggtanaccggtctacgtacctagccgtaacgtcggaccttgtacccgtagttccgggaaccggtcggacgtagggtacaacgtaacgtccggaaattcggacggttcgactaccggtacc

SEQ ID NO: 225186 - DNA, 186 bp, Homo sapiens
  misc_feature: GYAE6OF02GDP86.49.33.C11.1.454.CMB.1.raw
  modified_base (174)..(186): a, c, t, g, unknown or other
  misc_feature (174)..(186): n is a, c, g, or t
tcagagtcgagagacacgaccggtgctcgatttagagtgagctcgttgggtttggggggaagaggaagactgacggtccccccaggagttcaggtgctgggcacagcggccctgggctgcctggtcaaggactacttcctctctcgactctgagcgggctggcaggcgcatagnnnnnnnnnnnnn

SEQ ID NO: 225187 - DNA, 767 bp, Homo sapiens
  misc_feature: GYAE6OF02GPWDQ.49.33.C11.1.454.CMB.1.raw
  modified_base (203)..(203): a, c, t, g, unknown or other
  misc_feature (203)..(203): n is a, c, g, or t
  modified_base (320)..(320): a, c, t, g, unknown or other
  misc_feature (320)..(320): n is a, c, g, or t
  modified_base (502)..(502): a, c, t, g, unknown or other
  misc_feature (502)..(502): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgacgcagtctccagccacctgtctgtgtctccgagggaaangtccaccctctcctgcgagggccagtcagagtgtaggacactaacgttgccgtagtatcagcaacgaaccgtcggcgtacggccgtccgacggccttccgtcattctagtgtcgacnctaccgaccgacggcctacgtacggtacctcccgacgtaccgtaggttcgacggttcggacgtacgggttcgggtcggtaagggtaccaagggtaccgttaccgtacccttacgaacccgtacgtactaccggtacgaccgtacggtccctacggtactacgtaacgttagtaaacggtttnttttacgtacggttttaactttttagttacgtacgttactaacggtacgttaaagttaaccgtttacgggtccggtttcccgggtaacccgtttacccggttaacgttaacccggggtttccgggaaccggggttaacgggaaaccccgggttaggggtaaaccggtaacgtaacccggtttaaaaccgtaaaccgggttaccggttacgggtacgtttaaccggacccgttaaaccgacccgttttacggttcccgtttaccgg

SEQ ID NO: 225188 - DNA, 611 bp, Homo sapiens
  misc_feature: GYAE6OF02GDAIC.49.33.C11.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactgganaaatgtgatgacgcagtctccagccaccctgtctgtgtctaccgaggggaaangtccaccctntcctgcgagggccagtcagagtgtaggngactaacgttgcgtgtactcagcaagaacctggccaggcctacccgagtcctcctacatcgtagtgggtcncgtacnccgaaccgtcgggcctacgtcgtactcccgagccgtaggttccagggtcgctaggtcgggtacgagggataggtacgttcaccgtcctaccacgtactacgacgtcgacgtctaggctaggtctaggtaacgttagtttcgtacgttagttttactacgttcgtacagtactaaggtattaacgtcggttccggacgttaccgtacgttacggttacgggacggtacggtacgaaggtaggaacggtaacgacgaaacgtcgtggtacgtcgtacgcgtactacgtcgtacg

SEQ ID NO: 225189 - DNA, 702 bp, Homo sapiens
  misc_feature: GYAE6OF02GYGSX.49.33.C11.1.454.CMB.1.raw
  modified_base (202)..(202): a, c, t, g, unknown or other
  misc_feature (202)..(202): n is a, c, g, or t
  modified_base (325)..(325): a, c, t, g, unknown or other
  misc_feature (325)..(325): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgaggggaanagtccaccctctccgtgccgaggccagtcagagttgtagagctaacgttagccttggtactcgacgacgaacgaaaccgtcggccacggtccacccgacggcctcctactactctagtggtcncacgtacccgaccgtacgggacctaccggttacgggtaacccttccccgacggtaccggtacgggtttacagggtcgggtacggtaggttccggggttacggttcggggaacgtaggtacgtttccacttccgacctaccgactcgacgtcacgtccctacggactggtactaggtaagttacttttcgacgttttagtttactttacgtcgtactaggtacttagttaagttaacgttccggggtaccggtccgttaaccgggtaccttcgggtaccggggtaccggaacggggtacctaggggtaacggaactaacggtaaaccgtaaccggtagttacgggacgtacgtacgtaccaccggtattccgttaccg

SEQ ID NO: 225190 - DNA, 179 bp, Homo sapiens
  misc_feature: GYAE6OF02HF756.49.33.C11.1.454.CMB.1.raw
  modified_base (173)..(179): a, c, t, g, unknown or other
  misc_feature (173)..(179): n is a, c, g, or t
tcagagtcgagagacacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 225191 - DNA, 838 bp, Homo sapiens
  misc_feature: GYAE6OF02HFKJ0.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctcccagataccacgtggaagtaaatagtgatgacgcagtctaccagcccaccctgtctggttcgtctaccggaaggggaaagacgtcccacccttctcctcggacgacgggtacccaaggtcaaggtacggttaggttaacgggacgactaaaacgttacgccgtaggttacttaccgacgacgaaacggaaaacccgtcgggacccgacgggtcccctaccccggacgggttcccctacccttaccacttaccgtaggttcgggtacgtaccctaacctccccgggaacccggacggggtacccctaacgggttaccggtaacccctacccccggtaacgtccccggtagggtttacccgacggggttccggacgggtacgggtttacggggtaccggtaacgggggtaacgtaggttacggtttaccctaccgtttacccgtacccttaaccgaacgtacgtaaccggcgtaaccgttccccgagggtaacctaggttacgtaacgggttaagtttcgtttacggtaattttacgtttactacgttagtacgtactacttacgttaagtcggttacggccggttaccgttaccgtacggtccggttacggggacgggaccgggtacggacgggttaacggaacgttacggaaccgtaagttacggtcggtacgaccgttagcccttaagtccgtttactaccg

SEQ ID NO: 225192 - DNA, 878 bp, Homo sapiens
  misc_feature: GYAE6OF02H9HO8.49.33.C11.1.454.CMB.1.raw
tcagagtcgagagacacgaccggtgctcgatttagagtgagctcggttgggtttgggggagaactgctcagttaggacccagaccggaacatggaagccccagcgcagcttctcttcctcctgctactctggcctcccagatacccagtgggaataaatggtgatgacgtcagtcctaccagcccaccgttgtacttggtgtaccgtacggaaagggtaaacgtccgtccaccccgttctccgtggacgacgggtcctaggtcgaggtaggttaggtacggactaccgttaacgttcggccgttaggtataccgacgacgtaaccggtaaaccggtcggaccgtacggtccctacccggtacgtccttccgtatacgttaccgtaggtcggtccgaccgtaccgtacccgaaccggaccgggttaccctaccggttacgttaaccccgaccccgtacgggtacccggtttacgggtaccggtaacgggtccggtaaacggttggggtttccggggtaaccggtacggggtaaacgtccgggtttaacctcccgtacccgttaccgtaaccgtaacccggttacttacccgaacgtacccggtaccggtaccgtcggttaacccgttaacggttcgttaaacggttaacgttttacgtttaccggttaacgttttttaccgtttacgttaaccggttagaccgtaacgttaacggttaagttaaccggttacgttacccggggtcccggtaacccgttaccgttacccgggttggtaaccggggtacggtacgggtacggtaacgggtaggtacggtaaacgtaacgtaaccggtacgttcgggtacgtaccgtaccgtacctagttaccgttgtaacc

SEQ ID NO: 225193 - DNA, 783 bp, Homo sapiens
  misc_feature: GYAE6OF02HBGF1.49.33.C11.1.454.CMB.1.raw
  modified_base (255)..(255): a, c, t, g, unknown or other
  misc_feature (255)..(255): n is a, c, g, or t
tcagagtcgagagacacgaccggtgctcgatttagagtgagctcggttgggtttgggggaggaactgctcagttaggacccagacggaaccatggaagccccagcgcagcttctcttcctcctgctactctggctcccagataccactggagaaatagtgatgacgcagtctcagccaccttgtcctgtcgtctccgaaggggaaatcgtccacccctctccctggaccagggcccagtcaggagttggtaggancaacgttagccttaggtactacagacctaacggaaaccgtcggaccgacggccctaccccgaggtccctcccttaccgacttacgtagttcggtacacgacctacccgaaccgacgggtcccacgttacggttacctcccgaacggtacccgtaggttaccagggtcggacggtggtcggggtacgtacgggggactacgggtaacgttacccgacttccggtacctaacccgtgttaaccgaaccggtacggtacccgtccgttacggaccgttaacgttcggtaagggtttaaacgtttcgtttttacggtaactttaacggttttttaattaccgttacgttaccaaagggttactaaggtttaattaccgggttccgggttcccgggttaaccgtaccggttaacggttacccgttaccggggacggggtaaccgggtacggtacgggtaggaacgtaacgttaaacggtaaacgtcggtacggtacggtacctacggtaccctaacgtacgttacgttaccgg

SEQ ID NO: 225194 - DNA, 720 bp, Homo sapiens
  misc_feature: GYAE6OF02FOTA7.49.33.C11.1.454.CMB.1.raw
  modified_base (148)..(148): a, c, t, g, unknown or other
  misc_feature (148)..(148): n is a, c, g, or t
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
tcagagtcgagagacacgaccggtgctcgatttagagtgagctcgttgggtttgggggaggaactgctcagttaggacccagacggaaccatggaagccccagcgcagctctcttcctcctgctactctgctccagataccactgganaaatagtgatgacgcagtctccagccacctgtctgtgtctccgaggggaagngtcaccctctccgtgccgagggccagtcaggagttcggttaagganctaaacttgccgtggtatcagcacgaaacctggaccacggtccctacccgagggcctcccgtactacgttacctaagtcggtcgacctactcccgaaccgacgggtccaacgttggtccgtaccccgagtcccgtacgggttacgtacgtcggtacgtacggttcgggcggttacgggggaactaggtaacgttccgaacttcccgttacacccgtagtacgaacgtcgacgtacccgtcgaccgtgttacgtacggtaaagttcgttttaggactttaacgttttacgttcgttacgtactacgtaaccgtattagttaacgttaccggtcccgggtcgttaacccggtacgtttacccggttaggggaccgggtaacgggaacggtacggggtacgggaacgtaacggttaaccggaaacggtaccgtacggtacgtaccggtcgtaacccggtaacctcgttacgttaccg

SEQ ID NO: 225195 - DNA, 763 bp, Homo sapiens
  misc_feature: GYAE6OF02HTT0C.49.33.C11.1.454.CMB.1.raw
  modified_base (387)..(387): a, c, t, g, unknown or other
  misc_feature (387)..(387): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatgtgatggaacgcagtctaccagtcccacctgtctgtgtcctcgaacggggaaagtacgtcctaacccgtctccgtaggcgaacggggccctaaggtccgaaggtaaggttcggttaacgggagtacctaaaaccgtttggaccccgttaggttactaccgagacgaacggtaaaaccgtcgggacctaacgggcctaccccgaggccttcccgtctatcctagttcgggtanacctacgtacccgaacgacggggacctacgttaggttaccgtaccccgaaggtccccgtaagggttaccgtaacggttcgggggaccttaacggggttcgggggttttacccggaaggggtaaacccgtaaggggttacccgtttcccgaaacgtttcccgtaaccggaaccttacctacggaaaccgtcgaaccgggtccaacggtctaacggtacgtagtacggtagtttaccgacgttaagttacttacgtgtctacgtatacgtactagtccgtacggtcctaggtccgtcgttcggtacgggaccgtacggtaggtagaacgagtaaccgtaacgtacggtacgtagccgtagttacccgattcggattcg

SEQ ID NO: 225196 - DNA, 904 bp, Homo sapiens
  misc_feature: GYAE6OF02IHBQW.49.33.C11.1.454.CMB.1.raw
tcagagtcgagagacacgaccggtgctcgatttagagtgagctcgttgggtttgggggaggaactgctcagttaggacccagacggaaccatggaagccccagcgcagcttctcttcctcctgctactctggctccagataccactggagaaatagtgatgacgcagtctccagccacctgtcttgtcgtctaccgaaggggaaactacgtccaccccttcttaccgtcgacgacgggccctaaggtcaaggtaggttaggtttaggaacgtacctaaacgttacgtcccgtaggttactaccgtacggacgtaacggtaaacccgtcggacccgtaacgggtccctacccccggtaacgggttaccccttccccttacgtaacccgtttaccggtttaacggttcgggttacccgtaccctaaccggttaccccgaacccggggaacccggggtaccccttaaaccggggtttaccgtttaaacccgtacccccggtaacggttaccccggttaaggggtttacccgttacggggtacgggtacgggttaaccggggttccggggttaccgggtaacgggaccgtttaacgggttaacctttcccggtaacccttccgtaacccgtaacccgtagtacccgtaaacgcccgtaccggtaccgttacggtcgtaacggttcgtaacggttaagttttacgttacgttaacgtttagtttacgttacttgggtactacgtactaagtttaacgtcggtaccggttccggtacgtaacccgggttcgtaccgggtttaacgggaccgggttaaccggaccgggttaagggaccggtaacgtacgtaaaacccgtaaggtaacgtcgggtacgtcgtaccgtaaccgtaccttaccgttcgttaccg

SEQ ID NO: 225197 - DNA, 826 bp, Homo sapiens
  misc_feature: GYAE6OF02IIR9W.49.33.C11.1.454.CMB.1.raw
  modified_base (171)..(171): a, c, t, g, unknown or other
  misc_feature (171)..(171): n is a, c, g, or t
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
tcagagtcgagagacacgaccggtgctcgatttagagtgagctcgttgggtttgggggaggaactgctcagttaggacccagacggaccatggaagccccagcgcagcttctcttcctcctgctactctggctcccagataccactggagaaatagtgatgaccgcagtcnccagcccacctgtctgtgtctcgaagggaancgtccaccctctctgacngggccagtcagagtgttaggancctaagttcgcctggtactcgagacaacgaaccgtggccaggtcctcccgaggtcctccctactatacttagtcggtnaccacctccgaacgtaccgggcctacgtaccggttaccaccccgaggtcccgtaacggtttcgacggtcggtacgaggggttggggtacccgtaagggggtaacctagggtaccgtttacccaaccgtttccccgtactaacccgtagtaccgtacggcctaaccggtccgttacgtccgttaaggttccgttaaaccgggtagttttacgtttaaccggttcgttttaaacgttttacgtttaacccgttgttaaccgaaggttaacttaaacggtttaagttaacgtcccggggttaccccgggttacgtttacccgggtacccgttttaaaccggggtttcccgggggaaccggggttaaaccgggtaccccggtaaaggggttaccggtaaacggttaaccccggttaaaaccgggtaaacccggttaacgggttaccggtttaccgggtaacccgttacccggtaaccgtaaccggttacccggtttccgtttaacccggg

SEQ ID NO: 225198 - DNA, 743 bp, Homo sapiens
  misc_feature: GYAE6OF02GAQ2C.49.33.C11.1.454.CMB.1.raw
  modified_base (221)..(221): a, c, t, g, unknown or other
  misc_feature (221)..(221): n is a, c, g, or t
  modified_base (350)..(350): a, c, t, g, unknown or other
  misc_feature (350)..(350): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgtctactctggctccagataccactggagaaatagtgatgacgcagtctccagcctaccctgtctgtgtctaccgaggggaaagagtccaccctctccngcagggaccagtcgaagtacgtggttaggacgactaacgtacgccgtaggttactacagccgaaggtaaaaccgtggaccagggccctaccccgagggtccttacctactacttacctaagtcggttanaccgtactacccgtaaccggacgggtaccaacggttaggtaacctccccgaagaccccggttaggttaccaaggttcggatacggggttacgggtacgttacgggaaacgtagggtaacgtttcccgtaacgtcctaacccgaactaacgtacaaggtacccacgtaccgtacggacgtacgttaccaggtaaacggtacttttggtaaccttagttttaacttacgtctacgtagaccgtaagtaacttaaggttaccgttccgggttacccgtaaccggtaactacccgggttacggacgggtaacggtaccggaggggtacgaaaggtacgtaaaccgtaaacggttacgtaggtacggtccgtaagaccctaccgtagtaccgttaccg

SEQ ID NO: 225199 - DNA, 763 bp, Homo sapiens
  misc_feature: GYAE6OF02F3GPL.49.33.C11.1.454.CMB.1.raw
  modified_base (208)..(208): a, c, t, g, unknown or other
  misc_feature (208)..(208): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatgtgatgacgcagtctccagcccaccgtgtctgttcgtctccgaaggggaaagngttccacccgtctcctgcgagggccagtcagagtgtaganctaacttacgccgtagtntcacgacgaacgaaccgtggaccaggtcctaccgacggtcctccctcactcttaggtggtcgtacctactcccgaaccgacggggacccctacgttacggtacctaccccgacgtccgtaacggttcgaacggtcggtacgtagggttcgggtacgtaggggtaacaggtacgttaccacgttccgacctaacgactacgacgcgacgtccgtagtacgtcgtacgtaacggttaacgttacgttttacgtacgttttaacgttttaccttacgttacgtacgtaacgtacgttaacgttaacgttaacggttccgggtacccggggttaccgttacccggggtaccggtttaccggttttaccggggaacggggtaacccgggttacgggtaacgggttgggtaacgggtaacgtaaaccggttaaacgggtaccggtttaagggtacggttacgttacccggaaccgtttacccggttactttaccggtttaccg

SEQ ID NO: 225200 - DNA, 753 bp, Homo sapiens
  misc_feature: GYAE6OF02H9NJX.49.33.C11.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagagtcgagagacacgaccggtgctcgatttagagtgagctcgttgggtttgggggagaactgctcagttaggacccagacggaaccatggaagccccagcgcagcttctcttcctcctgctactctggcctcccagataccactggagaaatagtgatgacgcagtctccagccacctgctgtgtctcgaaggggaanacgtccaccctntccgtgcgagggccagtcagtagtgtaggagacctaacttcgcgtaggtatacgagccaaggaaaccgtggaccacggtacctacccgacggtccttcctacgtactccgtaagtcgggttacaccgtactccccgaacccggacgggtacccctacgtacgggttaacctccccgacggtacccgtacgggttaaccacggggttcggcccggtaagggttccggggtacgttacggggaaactgggttaacttacccgaacttccgaccgtaaccctagacgacgtaccgacgtccgtacgaccgtagtaccgtaggtaagtttacgtttacgtacgtttaacgttttaacgttacgtacgggtatacggtaacttaacgtaacgttacgtccggggttaacccggtccgttaacgtaccggtttaacggttaccgggacgggtaaccggggaccgtaaggggtaccggaagtaaccgtaacggtaaaaccgtacggtggtaaccgcgtacgaacccggtacttaacgttccgttacg

SEQ ID NO: 225201 - DNA, 582 bp, Homo sapiens
  misc_feature: GYAE6OF02HAMM2.49.33.C11.1.454.CMB.1.raw
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (280)..(281): a, c, t, g, unknown or other
  misc_feature (280)..(281): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
tcagagtcgagagacacgaccggtgctcgatttagagtgagctcgttgggtttgggggaagaggaagactgacggtcccccaggagttcgaacggtgcgtagggccaacagccggccctgggctgcctggtcaaggactacttccgctctcgactctggacgacggtctggcaaaggccgacagtacgngncngntcgtncagcagtcgctcngcngntgcgacncgtgtnagctcgtagngngacctagnacgtgngngcncngctcgacagcactntnnananagtgcncgcgcgcgcgacgtcgngagcgagcgcgacgacgtacgactcgacgcgtacgtacgtacgtacgtacgtacgacgtacgacgacgacgaagtacgtacgtacgttagtacgtacgtacgtacgtacgtagtacgtacgtaccgtacgacgtacgtaacgtacggtacggtacggtacgtacgacgtacggtacggaacgtacgtacggacgtagtacgtacgacgtacgtacgtacgtacgtacgtacgtacgtaccgtaccgtacctaaccgtacgtaaccgtagtaacg

SEQ ID NO: 225202 - DNA, 687 bp, Homo sapiens
  misc_feature: GYAE6OF02JZQ6H.49.33.C11.1.454.CMB.1.raw
  modified_base (160)..(160): a, c, t, g, unknown or other
  misc_feature (160)..(160): n is a, c, g, or t
  modified_base (226)..(226): a, c, t, g, unknown or other
  misc_feature (226)..(226): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
tcagagtcgagagacacgaccggtgctcgatttagagtgagctcgttggggtttgggggaggaactgctcagttaggacccagacggaaccatggagccccagcgcagcttctcttcctctgctactctggcctccagataccactgggaagtaaactgngagtacgacgctaagtctaccgacgtccctacccttggtctgttgtccgtaccgaagggggtaaanacggcctaccccttctaccgtggaccgagggtcccaaggtcgaaggtagttggttaacgtacggtcctaaacgttacgccgttaagtacgtcaagactacgactcggcgacgtccncgaccgtctacctnacttcgngtaggctacctactcccgacggaccgtccgtaggcgtacnccaggtccgtacggcgtcggtagacgtccgtgggtacctaggactagccgttacaccgtctcgaccctaagtcacgctacgtctagtacgtagtacgtacgtagttacttacgtaccttagttacttagtaccgtagttaccttaagtaacgttagtaacgtaccggttaccggtccgttaaccgtaccgtaaccggtttcggaaccgggttacgacgggttaacgggtagaacgtaggtaaccgtaacgagtacgtagtacgattaccctcgtatacggttcc

SEQ ID NO: 225203 - DNA, 821 bp, Homo sapiens
  misc_feature: GYAE6OF02I1O67.49.33.C11.1.454.CMB.1.raw
  modified_base (205)..(205): a, c, t, g, unknown or other
  misc_feature (205)..(205): n is a, c, g, or t
tcagagtcgagagacacgaccggtgctcgatttagagtgagctcgttgggtttggggaggaactgctcagttaggaccagatggaaccatggaacgccccagcgcagtcttctcttcctcctgctactctggctcccagactaccactggagaaatagtgatgacgcagtctccagccacctgtctgtgtcgtaccgaggggaancgtccacccgttctcctgcacgggccagcaaggtgtgtacgacgactaacgttacgccgttaggtatcgacgacgtaacgaaacccgtggacccctagggccctacccgaggtccttaccctacgtactttcgtaaggtcggtcgacctaccgtacccacgtacgggaccctacggtcggttacctacccgagtacccggtaagttacgtagggttcggacggtaggtttccggggtactacggggaaaccgtagttacggttacctacgttaccgtaaccacctacgacgtaacggccaacggtcccgtaagccgttacgtaccgtaaaggttaccgtttagtttcgtaacggtttacgtttaaccgtttacgtacgttaacgacgtacgttaaacggttaaccggttaaggtttcccgggttaacccggggtacccgttttaaacccggtaacggttttaaccccgggggttaccgggaaaccggggggtaccggttaaccggggtaaaacggggttccgggaaaacgttaaccggtaaacccggtaaccggttagggttacgggtttaaccggtacccgttaccgaaccccgggttacctaggtttaccccgg

SEQ ID NO: 225204 - DNA, 645 bp, Homo sapiens
  misc_feature: GYAE6OF02HF5IP.49.33.C11.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (397)..(397): a, c, t, g, unknown or other
  misc_feature (397)..(397): n is a, c, g, or t
  modified_base (421)..(421): a, c, t, g, unknown or other
  misc_feature (421)..(421): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcaggccagtcagagtgttaggngacaacgttacgcctaggtatcgagactaacgaaaccgtggccaagggccctacccaggtcctccgtacacttctagttcggtgcctatccccgacgtacgggcctaacgttcggtacctcccgacgccgtaggttcaggtcgcgtaggtgggtcgnggacgtagtaggttccacgttacnccgtaaccagtccgacgactacggcctaggactagtctacggaagtttctttaggactttaagttttacttaccgtgtacacgtacgtaaggttactaggtcccggtcggtacctacggtaccgttaacgttcgggggaccgtaacggggtacgtaagggtcgggaatacgtaaccggtaaactcgggtggtacggtcctacggtaacccacttcgtacttcgg

SEQ ID NO: 225205 - DNA, 766 bp, Homo sapiens
  misc_feature: GYAE6OF02IFJLJ.49.33.C11.1.454.CMB.1.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (757)..(757): a, c, t, g, unknown or other
  misc_feature (757)..(757): n is a, c, g, or t
tcagagtcgagagacacgaccggtgctcgatttagagtgagctcgttggggtttgggggaggaactgctcagttaggacccagacggaccatggaagccccagcgcagcttctcttcctcctgctactctcggctcccagatacccactggaagaaatagtgatgacgcagtctccagccacctgtctgtntctcgagggaancgtcaccctctcctgcaggccagtcaggtagtgttaggagctaacgttgccgttaggtatacagacaagtaaaccgtggccacggtcctcccgaggcccttaccgtcctattaccgttagttcgggttacgacctaccgtaccccgaacccgggaaccgggtaccctaaccgttcgggttaaaccgtacccccaacggtccccggttaacggtttaccggtacgggtcggccggttaacggggttcgggttacggtaacgggggaaccgtacggttaacgttcctaaccgttcctaccggaaccctagtacgacgacccgtacggtcccctaggccttaacgttcgttaacgtaagttacgttttaccgaacgttttagtttaacgttacttcgtacgtacgtaacggttaattaacgtacggttcgggttacccggttacccgttaacccgggtaccgttaccggttccggggaacgggtaaccgggtaccggtaagggtaggaacgtaactaacggaaaccgttacgttggacggtacgtacgtacctacgnttacttcgg

SEQ ID NO: 225206 - DNA, 762 bp, Homo sapiens
  misc_feature: GYAE6OF02H6QC4.49.33.C11.1.454.CMB.1.raw
  modified_base (187)..(187): a, c, t, g, unknown or other
  misc_feature (187)..(187): n is a, c, g, or t
  modified_base (319)..(319): a, c, t, g, unknown or other
  misc_feature (319)..(319): n is a, c, g, or t
  modified_base (395)..(395): a, c, t, g, unknown or other
  misc_feature (395)..(395): n is a, c, g, or t
  modified_base (519)..(519): a, c, t, g, unknown or other
  misc_feature (519)..(519): n is a, c, g, or t
  modified_base (740)..(740): a, c, t, g, unknown or other
  misc_feature (740)..(740): n is a, c, g, or t
tcagagtcgagagacacgaccggtgctcgatttagagtgagctcggttggggtttgggggaggaactgctcagttaggacccagacggaaccatggaacgccccagcgcagccttctcttcctcctgcctactctggcctacccagtactaccacgtggaagaaatggtgatcgaccgcacgttccnccgacgcccaccctggtctgtcgtcctaccggaaggggtaaaacgcgtacccacccttctccgtacgacgacgggtcctaagtacaggtacgttaggtaacggacgtactaaacgtttcgccgttaaggtcnccgtaagaccgaagtaaccgcggccgtaacggtccacccgtcggtcctcccctagtaccgtacgtttgaccggtanaacctaccgccggaaccgtacgggacctaccgttcggtacctacccggtccggagtacgggttacccggggtacgtcggtaggggtcctaacgggttcggaaatacggtacttccacccgttanacccggattaggacacgtaccgtactacccgcgtacgtacgtactaggtaccgttagtttcgtaaccgttagtttaactcgttacgacgtacgtacgtaagtacttacggtacccgtcgtacccgttacgttaccgttacggtaccggtacgggtacggtacggacgggttaggaacttacggtaaaccgaaccggttacgttacggcgttacgttacccncggtaaccacggtttctaccgg

SEQ ID NO: 225207 - DNA, 721 bp, Homo sapiens
  misc_feature: GYAE6OF02HSBXD.49.33.C11.1.454.CMB.1.raw
  modified_base (112)..(112): a, c, t, g, unknown or other
  misc_feature (112)..(112): n is a, c, g, or t
  modified_base (118)..(118): a, c, t, g, unknown or other
  misc_feature (118)..(118): n is a, c, g, or t
  modified_base (157)..(157): a, c, t, g, unknown or other
  misc_feature (157)..(157): n is a, c, g, or t
  modified_base (395)..(395): a, c, t, g, unknown or other
  misc_feature (395)..(395): n is a, c, g, or t
  modified_base (515)..(515): a, c, t, g, unknown or other
  misc_feature (515)..(515): n is a, c, g, or t
tcagagtcgagagacacgaccggtgctcgatttagagtgagctcgttgggtttgggggagaactgctcagttaggacccagacggaaccatggaagccccagcgcagcttcncttccnctgctactctggctacccagataccactggacaaatgtnatgacgcagtctccacgcctacctgtctgtgtcctacgaaaggggtaaatcgtccacccgtcctctggaaccgtagggccctagtcagtagtgttaaggcacctaaacttcgtcctgtactcgtagacaacgtaacgtggtacccgacggtaccctcccggaaggtcccttccacgtacttacgtacgtggtcgaccgtactacccgaaaccgtggacccgtaacgtaggttaacccncccgtacgtccggttaacggtccgtaagtcggtacgggtagggttcgggtaacgtggggtaaccagggtttacgtaacccgttcgttccgtaaccgtactaaccgtcgacggtctaccgngtaccggtctaacgtttcgtaagtaggtttacgtcttaacctttagttacttacgattccgaagtaccgttataacgtacggtacggtaccgtccggttacctacggttaggtccggtaacgggaccgaggttaccggaggtacctaacggaacttaaacggttccgaggtacgtaaccgccgtaactacccttagtccgttaacg

SEQ ID NO: 225208 - DNA, 814 bp, Homo sapiens
  misc_feature: GYAE6OF02GPOE1.49.33.C11.1.454.CMB.1.raw
  modified_base (212)..(212): a, c, t, g, unknown or other
  misc_feature (212)..(212): n is a, c, g, or t
  modified_base (255)..(255): a, c, t, g, unknown or other
  misc_feature (255)..(255): n is a, c, g, or t
  modified_base (304)..(304): a, c, t, g, unknown or other
  misc_feature (304)..(304): n is a, c, g, or t
  modified_base (327)..(327): a, c, t, g, unknown or other
  misc_feature (327)..(327): n is a, c, g, or t
tcagagtcgagagacacgaccggtgctcgatttagagtgagctcggttgggtttgggggaggaactgctcagttaggaccagacggaaccatggaagccccagcgcagcttctcttcctcctgctactctggctcccagataccacgtggagaaatagtgagtgaccgcagtcctccagcccacctgtcctggtcgtctccgaaggggaaanagtcccaacccttctcctgcgagggccagtcagtgtgtaggancgaacttgcttggactcgagcaacgaacctcggccgacggccctaccgnggtcctcctctatcctagtcggnccactccgaccgtcgggtacctacggtacggtacctacccgacgtaccgtaacggttacgtacggttcggtacggtgggttacggggttcgtacggggaacgtagtaaccggtttctaccgttcctacccgtaaccgttacaccggacgtaccgtaccggttccgtaacgtccgttacggttaccgtaagggttaacgttacgttttacggtacgttttaaacgttttacgttaccgtttgtaaccgtacggttacgttaaacgggttaaacgttaccgggtttacccgggttaccggttaccccgggttaaccggggtttaaccttacccggggttaaacggggtacccggggaaacccggggtttaccgggtaaaaggggttcccgtaaacggttaaccgggtaaaacccggttaaaggtaccggttaggggttcccgtaacgtcccgggttaacccgaacgttttacccggttcggtttaaccc

SEQ ID NO: 225209 - DNA, 187 bp, Homo sapiens
  misc_feature: GYAE6OF02G4IH2.49.33.C11.1.454.CMB.1.raw
  modified_base (173)..(187): a, c, t, g, unknown or other
  misc_feature (173)..(187): n is a, c, g, or t
tcagagtcgagagacacgaccggtgctcgatttagagtgagctcgttgggtttgggggaagaggaagactgacggtccccccaggagttcaggtgctgggcacagcggccctgggctgcctggtcaaggctacttcctctctcgactctgagcgggctggcaaggcgcatagnnnnnnnnnnnnnnn

SEQ ID NO: 225210 - DNA, 613 bp, Homo sapiens
  misc_feature: GYAE6OF02GS6XJ.49.33.C11.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggcctcccagataccactggagaaatagtgatgacgcagtcctccgagcccaccctgtctggtcgtctccgaaggggaaangtccaccctctccgtgcgaggccagtcagtagtgtagnactacttagctgtatgagcagtaaccgtggccnggcctccgaggcctcctacattctagtcggtgcctacctaccgaccgacggacctacgtcggtacctacccgacgccgtaggttcgagtcggtacgtggttcgggtcgtagggacagtacgtcgtactcctacgacctcgtaccgagtacacgtccgagactcgtactaaggtacgttntttacgactttagtttatacgttntacgtagtactagttagttacgtcgggtccggcttaccggattacggtcgggaccgggtaggacgtagggtcggaacgtcgtaaccgtaacggtagtggtcgtacgacgtaccgtactacgtcgtacg

SEQ ID NO: 225211 - DNA, 640 bp, Homo sapiens
  misc_feature: GYAE6OF02HUR0T.49.33.C11.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctcagccacctgtctgtcgtctccgagggggaaanagtccaccctctcctgcagggccaggtcagngtagtaganctaattacgctagtatccagacaagaacctggccaggtcctacccgagggtctaccgtcatactagtcggtcgactactaccaaccgacgggaccacgtcggtaactccccgagtcctaggttacaggttcgacgtagggtcggtacgtgggaacaggtacgttcacgtcacaccgatcagcaacgtcctgacacgttacaggtaagttagtttagacgtttagtttacttaccgttgtacgaacgtactaaggttaaattacggtaccggttccgggaccgttacggtaaccgtaccggtttccggacgggaacgggtaccgtaagggtacggaagtaaccgtaacgaaaacgttacggtggtacggcgtacgaacccgtactacgtacttaccg

SEQ ID NO: 225212 - DNA, 914 bp, Homo sapiens
  misc_feature: GYAE6OF02JIUMI.49.33.C11.1.454.CMB.1.raw
  modified_base (178)..(178): a, c, t, g, unknown or other
  misc_feature (178)..(178): n is a, c, g, or t
tcagagtcgagagacacgaccggtgctcgatttagagtgagctcgttgggtttgggggaggactgctcagttaggacccagacggaaccatggaacgccccagcgcagcttctcttcctcctgcctactctgcctcccagactaccacgtaggaacgaattagtgatagacgcagtcnccgacgccctaccgtgttcgttcggtcgttccgtaccgggaagggtaaagtcgtccctaccttcctcgtacgaccgtacgggccgtagacgacggtagttacggttacggacgtaaccgtaacggttacgtccgttaggaacctagtaacgcgtaaacggtaaccgtcggaccgtacggtaccccgtcccggtacgtccgtcctaacttacgtacgttcgtgggtaccaccgtaacgtacccggaccggtaacggccgtaaccgttacggtaccctaccggtacgtaccgaggttccgtaagggccggtacggtacggtcgggttcgtaacggacggttaccgttcgtaacccgttacgttccccgttaaccggaccttaacggtaccgtacgaccggttaccgttcccgtacggttccgttaacggttaccgttaacggtttacgtttaccggtttacggttaacggttttaactttttaccggtttaagttaccggttaaaccgtacgggttaccgtttaaacggtttaaggttaacccgtttaccggggtccgttaccccgggttacgtttaacccgggtttaaccgggttcccggggtaaacgggtttacccgggaaccggttaacgggtaaccgggtaacggttaaccggttaacggtaaaccgggttccggtttagaccggggttacgttaccgtaacccggtttacggttaccggttccgtttaaccgg

SEQ ID NO: 225213 - DNA, 199 bp, Homo sapiens
  misc_feature: GYAE6OF02GDOAA.49.33.C11.1.454.CMB.1.raw
  modified_base (170)..(170): a, c, t, g, unknown or other
  misc_feature (170)..(170): n is a, c, g, or t
  modified_base (174)..(199): a, c, t, g, unknown or other
  misc_feature (174)..(199): n is a, c, g, or t
tcagagtcgagagacacgaccggtgctcgatttagagtgagctcgttgggtttgggggaagaggaagactgaccggtccccccaggagttcaggtgctgggcacagcggccctgggctgcctggtacaaggactacttcctctctcgactctgagcgggctggcaaggcnatgnnnnnnnnnnnnnnnnnnnnnnnnnn

SEQ ID NO: 225214 - DNA, 728 bp, Homo sapiens
  misc_feature: GYAE6OF02HIRCZ.49.33.C11.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (693)..(693): a, c, t, g, unknown or other
  misc_feature (693)..(693): n is a, c, g, or t
  modified_base (702)..(702): a, c, t, g, unknown or other
  misc_feature (702)..(702): n is a, c, g, or t
tcagagtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgaagggaanagtccaccctctcctgccagggccagtcagtacgttgtacggngacctaacgttagccttaggtactacgagccgaaagtaacccgtggacccgaacggtcccctacccggaagggtccccttcccgtacgtaacgttcgtaacgttgggttaccgacctacgttacccccgaaccggaccggggtacccttaacggttacgggttaccccttaccccgacgtaccccgtaaaggtttccgaacgggttcggtacgtagggttcggtccgtaggggactagtacgttccactactccacctagtcacgtacacgtcccgtgactacgtagtaggtaacgttagtttcggtaactttagttttaaccttcgttacgtacgtcggtaagttaagttaacgttaacggttccggtaccggttacgtacccgtacgttacccgggttcggaccggggaacggtacgtacgggtacgaagtaccgtaagtaaccgngttaacggnggaccgtgaccgtactattccgtacg

SEQ ID NO: 225215 - DNA, 799 bp, Homo sapiens
  misc_feature: GYAE6OF02JZ223.49.33.C11.1.454.CMB.1.raw
  modified_base (153)..(153): a, c, t, g, unknown or other
  misc_feature (153)..(153): n is a, c, g, or t
  modified_base (160)..(160): a, c, t, g, unknown or other
  misc_feature (160)..(160): n is a, c, g, or t
  modified_base (574)..(574): a, c, t, g, unknown or other
  misc_feature (574)..(574): n is a, c, g, or t
tcagagtcgagagacacgaccggtgctcgatttagagtgagctcgttgggtttgggggaggaactgctcagttaggacccagacggaaccatggaagaccccagcgcagcttctcttcctcctgctactctggcctcccagataccactgganaaatagngatgacgctagtcctaccagccctacctggtactgttctccgtaaccgaagggggtaaatacggtaccctaacccctttctaccgtcggaccgtacgggggaccacggtacaggttaggtttaggtaacgggaacgtaccttaaaacgggttcgacgtttaacggggtacttaccgacgaacgtaaaccggtaaaccggtcgggtaaaccgaccggtaccgttacccgacggtcccttacctacgtaacctcggttacgtacggtcgtacaaccgttacccgaccgggtaacgtccccgaacggttaccggtaccacccgtaccgtaacggttcgtaccgttaaggcggtacgtacggttagggtccgagggtaacgtacggttatcgtaaccgtacctcgaccgtgtacgacnccggaacgtcgtaacccggatactacggtagtaacgtcgttagtacttacggtttactgtccgtagacgtaaagttcgttaaacgttccgtcgggttccggacccgtttacggacgtttaccgggaacggggttacgtaacgggtacgtaagggtcgggttaacaccgttaacggtaacgaccggttcggtaggttaccacgtaccggtactaccggttattccg

SEQ ID NO: 225216 - DNA, 500 bp, Homo sapiens
  misc_feature: GYAE6OF01EXAS9.36.79.H02.1.454.CMB.1.raw
  modified_base (366)..(366): a, c, t, g, unknown or other
  misc_feature (366)..(366): n is a, c, g, or t
  modified_base (492)..(492): a, c, t, g, unknown or other
  misc_feature (492)..(492): n is a, c, g, or t
tcagtacgctgtctcacgaccggtgctcgatttagtgtcacacgaagggaaagggggagtcagacccagtcaggacacagcatggacatgagggtccccgctcagatcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggcgtctactttggaaagtggggtcccatcacggttcagcggcagtggatctgggacagaattcactctnaccattagcagcctgcagcctgatgattttgcaacatattactgccagcaatataatacgtattggacgttcggccaagggaccagggtggagatcgaaagactgtggctgcaccatctgtattcntcttcccg

SEQ ID NO: 225217 - DNA, 504 bp, Homo sapiens
  misc_feature: GYAE6OF01EVD7I.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggcgtctactttggaaagtggggtcccatcacggttcagcggcagtggatctgggacagaattcactctcaccattagcagcctgcagcctgatgattttgcaacatattactgccagcaatataatacgtattggacgttcggaccaagggaccgagggtggagatacaaacgaacgtgtggctgcaccatctgtcttcatctcccg

SEQ ID NO: 225218 - DNA, 512 bp, Homo sapiens
  misc_feature: GYAE6OF01CLUW4.36.79.H02.1.454.CMB.1.raw
  modified_base (501)..(501): a, c, t, g, unknown or other
  misc_feature (501)..(501): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggctctactttggaaagtggggtcccatcacggttcagcggcagtggatctgggacagattcactctcaccattagcagcctgcagcctgatgattttgacaacatattactgccagcaatataatacgtattggacgtttcggaccgaagggaccaggggtggagatacgaaacgaacgtgtaggctgcacctatctgtcttcnttccttccccg

SEQ ID NO: 225219 - DNA, 477 bp, Homo sapiens
  misc_feature: GYAE6OF01B693N.36.79.H02.1.454.CMB.1.raw
  modified_base (450)..(452): a, c, t, g, unknown or other
  misc_feature (450)..(452): n is a, c, g, or t
  modified_base (454)..(455): a, c, t, g, unknown or other
  misc_feature (454)..(455): n is a, c, g, or t
  modified_base (457)..(477): a, c, t, g, unknown or other
  misc_feature (457)..(477): n is a, c, g, or t
tcagtacgctgtctcacgaccggtgctcgatttagtgtcacacgaagggaaagggggctggagtgggtctcagttatttacagtggtggtaacagataccacgcatactccgtgaagggccgattcaccatctccagagacacatccaagaacatgatttatcttcaaatgaacagcctgagagtcgaggacacagccgtatacttctgtgtgagagttaggacctctgactcggaaaatggatacagcgactcatatcaccacatggacgcctggggcagagggaccacggtcaccgtctcctcagcctccaccaagggcccactcggtcttccccctggccaccctcctccaagacgcacctcgtgggggcacacgcggcccgtgggcctgcctggtcaagggactacttcagacagcgtactgagcgggctggcaaggcgcatacgnnntnngnnnnnnnnnnnnnnnnnnnnn

SEQ ID NO: 225220 - DNA, 471 bp, Homo sapiens
  misc_feature: GYAE6OF01EVI6U.36.79.H02.1.454.CMB.1.raw
  modified_base (269)..(269): a, c, t, g, unknown or other
  misc_feature (269)..(269): n is a, c, g, or t
  modified_base (342)..(342): a, c, t, g, unknown or other
  misc_feature (342)..(342): n is a, c, g, or t
  modified_base (451)..(451): a, c, t, g, unknown or other
  misc_feature (451)..(451): n is a, c, g, or t
  modified_base (460)..(471): a, c, t, g, unknown or other
  misc_feature (460)..(471): n is a, c, g, or t
tcagtacgctgtctcacgaccggtgctcgatttagtgtcacacgaagggaaaggggctggagtgggtctcagttatttacagtggtggtaacagataccacgcagactccgtgaagggccgattcaccatctccagagacacatccaagaacatgatttatcttcaaatgaacagcctgagagtcgaggacacagccgtatacttctgtgtgagagttaggacctctgactcggaaaatggatacagcgatcatatcaccacatggacncctggggcagagggaccacggtcaccgtctcctcagtcctccaccaagggcccatccgtcttccccctggccnccctgcctccagggacgccaccctccgagacgccacacgcccgcccgtgggcctcgccctggtcaaggactacttacacgacagcgtactggagcggctggacgaggcncgagtacgnnnnnnnnnnnn

SEQ ID NO: 225221 - DNA, 466 bp, Homo sapiens
  misc_feature: GYAE6OF01A2O2J.36.79.H02.1.454.CMB.1.raw
  modified_base (445)..(445): a, c, t, g, unknown or other
  misc_feature (445)..(445): n is a, c, g, or t
  modified_base (447)..(466): a, c, t, g, unknown or other
  misc_feature (447)..(466): n is a, c, g, or t
tcagtacgctgtctcacgaccggtgctcgatttagtgtcacacgaagggaaaggggctggagtgggtctcagttatttacagtggtggtaacagataccacgcagactccgtgaagggccgattcaccatctccagagacacatccaagaacatgatttatcttcaaatgaacagcctgagagtcgaggacacagccgtatacttctgtgtgagagttaggacctctgactcggaaaatggatacagcgactcatatcaccacatggacgcctggggcagagggaccacggtcaccgtctcctcagcttccaccaacgggcccatccgtcttccccctgcgccctgcctccaggagcaccctccgagagcacacgccgccctgggctgcctggtcaggactacttccagacagctactgagcggctggcaaggccgcactaggancnnnnnnnnnnnnnnnnnnnn

SEQ ID NO: 225222 - DNA, 546 bp, Homo sapiens
  misc_feature: GYAE6OF01DNDR7.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaacgcccctaaggtcttgatctataggcgtctactttggaaagtggggtcccatcacggttcagcggcaggtgatcgtgggacagaattcactctcactattagcagcctgcagcctgatgtatttgactaactatattactgccagtcaaatattaaagtacgtaagttaggtacgtttacggaccgtaagggaccgtaggggtaggagtatacgaaacggtaacgtggtaggcgtgaccacctatcgttacgtcttcgtattccgttaccccg

SEQ ID NO: 225223 - DNA, 551 bp, Homo sapiens
  misc_feature: GYAE6OF01CC8A8.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccggcagtcagagtatagtcagttggtgctggtatcaacagaaccaggaacgccctaaggtctgatactataaggtctctacgttggaagtgggtccatcacggttcagcgcagtgatcgtgggacagaattcactctcacctatagcagcctgcacgtcctgattagtatttagactaactatattactacgtaccagtactaataataattaacgttagttacggtacgttacggaccgaacgggaccgtagggtaggagtaacgtacgaaacgtacgtggtaggacgtcgactacctacgtcttacgttaccttactacgttcccgtaccccg

SEQ ID NO: 225224 - DNA, 511 bp, Homo sapiens
  misc_feature: GYAE6OF01AR9X4.36.79.H02.1.454.CMB.1.raw
  modified_base (507)..(507): a, c, t, g, unknown or other
  misc_feature (507)..(507): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatctcttgccgggcaagtcagggcattaacaatcatttagcctggtatcagcagaaaccagggaaagttcctaagctcctgatatatgctgtattcactgtgcaagtcggggtcccatctcgttcagtggcagtggatagtgggacagtatttcactctcaccatcagcagccctgcagccctgaagtatgttcgactaactttattattcgtactaaaagtataaactagtcgccctactcacgttcggcggacggaccgaggtggagtagtaccaaacgtactagtacggctagcacnttcg

SEQ ID NO: 225225 - DNA, 447 bp, Homo sapiens
  misc_feature: GYAE6OF01E2LIH.36.79.H02.1.454.CMB.1.raw
  modified_base (442)..(447): a, c, t, g, unknown or other
  misc_feature (442)..(447): n is a, c, g, or t
tcagtacgctgtctcacgaccggtgctcgatttagtgtcacacgaagggaaaggggctggagtgggtctcagttatttacagtggtggtaacagataccacgcagactccgtgaagggccgattcaccatctccagagacacatccaagaacatgatttatcttcaaatgaacagcctgagagtcgaggacacagccgtatacttctgtgtgagagttaggacctctgactcggaaaatggatacagcgactcatatcaccacatggacgcctggggcagagggaccacggtcaccgtctcctcagcttccaccaaggccccatccgtcttccccctggcgccctgctccaggagcacctccgagagcacagccgccctgggctgcctggtcaaggactacttccagacagcgttactgagcgggctggcaaggcgcatagnnnnnn

SEQ ID NO: 225226 - DNA, 448 bp, Homo sapiens
  misc_feature: GYAE6OF01EBP6F.36.79.H02.1.454.CMB.1.raw
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
  modified_base (440)..(448): a, c, t, g, unknown or other
  misc_feature (440)..(448): n is a, c, g, or t
tcagtacgctgtctcacgaccggtgctcgatttagtgtcacacgaagggaaaggggctggagtgggtctcagttatttacagtggtggtaacagataccacgcagactccgtgaagggccgattcaccatctccagagacacatccaagaacatgatttatcttcaaatgaacagcctgagagtcgaggacacagccgtatacttctgtgtgagagttaggacctntgactcggaaaatggatacagcgactcatatcaccacatggacgcctggggcagagggaccacggtcaccgtctcctcagcttccaccaagggcccatccgtcttcccctggcnccctgctccaggagcacctccgagagcacagcccgccctgggctgcctggtcaaggctacttccagacagcgtactgagcgggctggcaaggcgcatagnnnnnnnnn

SEQ ID NO: 225227 - DNA, 522 bp, Homo sapiens
  misc_feature: GYAE6OF01BN1OQ.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggcgtctacgtttggaaagtggggtccatcacggttcagcggcagtggatcgtgggacagaacttcactctcacattagcagcctgcagcctgatgtattttgactaactatattactgccagctaatataatacgtattaggacgttcggaccaagggaccagggtcgagatacgaaacgtacgtggtggactcgcacgtatctcgtacttctacttcgtacccg

SEQ ID NO: 225228 - DNA, 798 bp, Homo sapiens
  misc_feature: GYAE6OF01ADVG2.36.79.H02.1.454.CMB.1.raw
tcagtacgctgtctcacgaccggtgctcgatttagtgtcacacgaagggaaagggggagtcagacccagtcaggacacagcatggacatggacgggtccccgctcagcctccgtggggctcctgctgctctggcctcccgaggtgaccaaaggtgacatccagatcgaccctagtccctcccttcccaccctgtctgctatcgtaggtaggagacaggactaccaccatccgtacgtcggccggtactagtacgaggtagttattagtcgtagtttcgggtcgtccgtaggtacaaccgaacgaacgtaaaccggacgggtaaccgtcccgtaagttctagtactacgtaagtacgtcgttacttacggttagggaacggtcgggtacctacgtaccggtacggtacggacggtcggtacggttagggtacggtacgttacgggtacggaaaccgttaacggtaaccttccctaaccgttaccctaccgtaaacccgttagtaccggaccgtaccggttacccgacggtaccgacgttaccggttgttaacgttcggtttaactttaaccgaaaccttaactaacgtttaccgttaacctaacgtacgtaagtaaccttaagtaaacgtttaacggttaacggttaaccggtccggggtaaaccggtacggtaaccggaacgggaaccggtaggggtaagaaccggtaaccgaaccggtaaacgggtcgtacggtcgtaccgcgtaaccgttaccgtcttccgttacctaccgttacctccccgttacccgtaccccg

SEQ ID NO: 225229 - DNA, 657 bp, Homo sapiens
  misc_feature: GYAE6OF01CDGEL.36.79.H02.1.454.CMB.1.raw
  modified_base (396)..(396): a, c, t, g, unknown or other
  misc_feature (396)..(396): n is a, c, g, or t
  modified_base (466)..(466): a, c, t, g, unknown or other
  misc_feature (466)..(466): n is a, c, g, or t
  modified_base (608)..(608): a, c, t, g, unknown or other
  misc_feature (608)..(608): n is a, c, g, or t
tcagtacgctgtctcacgaccggtgctcgatttagtgtcacacgaagggaaagggggagtcagacccagtcaggacacagcatggacatgagggtcccccgctcagctccgtggggctcctgctgctctggctcccaggtgaccaaaggtgacatccagatcgacccagtcctcccttccaccctgtctgcatctggtaggagacagacgtccaccatcacgttcggccgggccagtcagtagtattagtctagttggttcgcctggtatacaacgaagaaaccgagggaaaccgtaccccgttaaggttccttaggacttacgtaagtaacgggtcttacgttacgtttagggaaacggttcgggtaccctaagtccgtacggttcgacggcggngtaggtcggtatcggtagggaactaggtaacttcaaccttcacctactagttacgcctacgccgtcgacncggtcctagtacttagttacgtttacgaacttaatacttattactcgacgtaatactaattaactaagttacgttacgttacgggtaccgttacggaccgaacggggtacgagggtaggagtacgtaacgaacgtagtaggngacgtcgacctacgtacttccgttagttaccttctcgttcccgtacccg

SEQ ID NO: 225230 - DNA, 549 bp, Homo sapiens
  misc_feature: GYAE6OF01B7MHY.36.79.H02.1.454.CMB.1.raw
  modified_base (274)..(274): a, c, t, g, unknown or other
  misc_feature (274)..(274): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttgcctggtatcaacagaaaccagggaaacncccctaaggtcttgatctataaggctctacgttggaaagtgggtccagtcgacggttcagcgacaggtgatcgtgggacagtaattcactctacaccattagcagcctgcacgcctagtatgtattttcgactaaactattaattactagccagtactaattaataagttacgttattacggtacgttcggaccgtaagggaccgtagggaggaagtagtacgaaacgtagtggtaggactcgacctacatcgtcgtacttctactccttacccg

SEQ ID NO: 225231 - DNA, 603 bp, Homo sapiens
  misc_feature: GYAE6OF01ECXNF.36.79.H02.1.454.CMB.1.raw
  modified_base (445)..(445): a, c, t, g, unknown or other
  misc_feature (445)..(445): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcacatcacttgccggccagtcagagtattagcagttggttggcctggtatcaaacagaaaccagggaaacgcccctaaggtcttagattctagtaaggcgttactacgtttggaaagtcggggtacccagtccacggttcaggcggacaggtggatcgtagggactagaacttcactctacacctattagcagtccctagccacgtcctgtacttgtactttgactaactattattaccgtnacctaagtacctaaattacttaaagtaacgttagttacgggtaacgtttccgggaaccgtaacgggaaccgtaggggtaggaacgacgtacaaaacggtacgtaggtaggctacgacctaccgtattccgttagttccttactacttcccttaccccg

SEQ ID NO: 225232 - DNA, 670 bp, Homo sapiens
  misc_feature: GYAE6OF01EBUJB.36.79.H02.1.454.CMB.1.raw
  modified_base (418)..(418): a, c, t, g, unknown or other
  misc_feature (418)..(418): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatcgacccagtcctccttccacctgtctgcatctgtaggagacagacgtcaccatcacgttggcccggcagtcagtacgttattagtctagtttgggttcgccgttaggtactaccaaacgaacggaaaccgaaggggaaaccgtaccccgttaaaggtccttaggacttacgtaagtaacggtcgttacgttacgtttagggaaacggttcgggtaccagtcgtacggttcaggcggacgtaggtcggtatcggtaggaanagtactcactctacacgtatacgctacgctgcgtacgcgtagtacttagttagtttagacctaattattacgttacgtcgacgaagtataaatttaactaagttacggttaagttacgggtaccggttaccgggaaccgtaacggggtaccgtaggggtaacgaggtaaccaaaccggtaaacgtacgtcgggtacggtacgtcgaccacgtacgttcttacggttacctttcgaacccttcccgttaaccg

SEQ ID NO: 225233 - DNA, 761 bp, Homo sapiens
  misc_feature: GYAE6OF01AO1CP.36.79.H02.1.454.CMB.1.raw
  modified_base (234)..(234): a, c, t, g, unknown or other
  misc_feature (234)..(234): n is a, c, g, or t
tcagtacgctgtctcacgaccggtgctcgatttagtgtcacacgaagggaaagggggagggtcgagacccacgtcaggacgacagcatggacatgagggtccccgcctcagctcctggggctcctgctgctctggctcccaggtgccaaggtgacatccagatgacccagtctccttccaccctggtctgcatctgaggagacagatcaccatcgcttggccggccagtcagtntatttagtcagttggttggtccgtggtatcaacagaaccagggaacgccctaaggtctgtatactagtaaggctactaccgtttagggaaagttcggggtacccatcgtacgggttacgaggtccggactaggtggtacgtcgtaggggaccgtaagtaacgtttcaccttaccttccgaaccgttagttaggccgagtcccttcggactaacggtccctagtagttacggttagttttaccggacaaaaccgtagtttaactttaacgtccgtaccgtaaccggtaataacggtttaaactttaaacgttacggtttaaacggtttccggggttaacccgttaaccggggggtaacccctaacggggggaaacccgttaggggggttaccgggggtaaataaccggttaaaaccgaaaccggtttaaaccgggtggtttaccgggaccgggttaccgtacgtaaaccccgtcgttttacgttacggttacccgttttcgttaacccgtcccggtttaaaccccccg

SEQ ID NO: 225234 - DNA, 509 bp, Homo sapiens
  misc_feature: GYAE6OF01A0472.36.79.H02.1.454.CMB.1.raw
  modified_base (500)..(500): a, c, t, g, unknown or other
  misc_feature (500)..(500): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccaggggaaagccccctaaggtcttgatctataaaggcgtctactttggaaagtggggtcccatcacggttcagcgcagtgatctgggacagaattcactctcaccattagcagcctgcagcctgatgattttgctaacatatactgcagcaatataatacgtattggacgttcggaccaagggaccagggtggagatacaaacgaacgtggtgcgtcgacaccatctattcttcntcttccccg

SEQ ID NO: 225235 - DNA, 603 bp, Homo sapiens
  misc_feature: GYAE6OF01A4W7B.36.79.H02.1.454.CMB.1.raw
  modified_base (271)..(271): a, c, t, g, unknown or other
  misc_feature (271)..(271): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctggtaggagacagagtcaccatcacttgccggcagtcagagtattagtcattggttggcctggtatcaacagaaccagggaancccctaaggtcttgatctataaggctctactttggaaagtcggggtccatcgacggttcaggcggcagtggatcgtgggacagtacttcacttctcacctattagcagcctgcacgtcctgactgtattttcgactaacattattactgtccagtctaataattaacttacgttaagttacgggtaccgttacgggaccgtaacggggtaccgtaggggtacgggtaaggtacgttaaccggaaaacggtaaccgttacggtcgggtacgtcggaccgaaccctacgttaccgtttacggttcctttacctaccgttcccgtttacccccgg

SEQ ID NO: 225236 - DNA, 760 bp, Homo sapiens
  misc_feature: GYAE6OF01AYN0Y.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccacctgtctgctatctgtaggagacagacgtcaccatcacgttggcccgggccagtcagtagttattacgtctagtttggttcggccttaggtattaccgaaacgtaacggaaaccgaacggggaaacgtacccccgtaaggttccttagacgttacgtaacgtaagggtccgttacgttacgtttagggtaaacggttcggggtaccctaagttccgaacgggtttacacggtcgggtacgtaggttacggaacgtcggtacgggaactagtaacttccgaacttcctaccgaacctaagttacgccgtaacgtcccgtacggctagtacccgttggtaactttaggtaacttttcgacctaaacgtatttaacgttaacgtaccgacctaagtactaaagttaacttaacgttaaccggttaagttccgggtaaccggttaccgggtaacccggtaaggggtacccgtaggggtaacggtaaggaaccttaaaccggaaaaccggtaccgttgggtacggtacgttaccggaccgtaaaccttcgttaaccgttcttaccgttaccgttccgttcccgttacccg

SEQ ID NO: 225237 - DNA, 601 bp, Homo sapiens
  misc_feature: GYAE6OF01DAU4S.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccacctgtctgcatctgtaggagacagagtcacatcacttgccggcagtcagagtattagtcagttggttggcctggtatacaacagaaaccagggaaacgcccctaaggtcttgatctataaggctcgtactttaggaaaggttgggtcccagtcaacggttcagcgcagtggatcgtgggacaggtaattcgacttactctaccattacgcacgtcctagcagccgtgtactggttattttggacaagtacttattaccgacaccgagtacaattaacttaagttaacgtagtttagggtacgtttaccggacgaaacgggtaccgtaggggtacggaagtaagtaaccgtaaagacggtacgtagggtaccgttgaacccgtaccacgttaccgttcgtaccgttttacgcttcccgttaccccgg

SEQ ID NO: 225238 - DNA, 658 bp, Homo sapiens
  misc_feature: GYAE6OF01BDK53.36.79.H02.1.454.CMB.1.raw
  modified_base (197)..(197): a, c, t, g, unknown or other
  misc_feature (197)..(197): n is a, c, g, or t
tcagtacgctgtctcacgaccggtgctcgatttagtgtcacacgaagggaaagggggagtcagacccagtcaggacacagcatggacatgagggtccccgctcagctcctggggcctcctgctgctctggctcccaggtgccaaaggtgacatccagatgacccagtctccttccaccctgtctgcatctgtagganacagagtcacctatcacttggccggcagtcagtagtattagtctagttggttggcctggtatacaacaagaaaccgaggaaacgaccccgtaaggtcttagtactactaagtaacggtcgttacgttacgtttagggaaacggttcggggtacccagtacgtaccggttcgaggcggcgaggtcggagtcgtgggacaaggtaacttcacttctacacctaattacgactacgccgtagccgtacgtccgtggtattagtagttttcgaactaactaagtttacttacgtcgacctaagtactaaattaacttaacgttaacgttaaggtttacgggtaaccggtttaccggaacgtaacggggaacggtacggggtaggtaacgaacgttaacgaaacggtaacgttcggtaggcgtagcccaacctattacgttacttacttacctcttcccgtacccg

SEQ ID NO: 225239 - DNA, 771 bp, Homo sapiens
  misc_feature: GYAE6OF01BH4Y6.36.79.H02.1.454.CMB.1.raw
tcagtacgctgtctcacgaccggtgctcgatttagtgtcacacgaaggggaaagggggagtcagacccagtcaggacacagcatggacatgagggtccccgctcagctcctggggcctcctgctgctctggctcccaggtgaccgaaaggtgacatccagatgacccagtcctccttcccacctgtctgcatctggtaggagacagactcaccatcacgttcggccggccagtcaagtagtattagtctagttggttcggcctggtactacaacgaaggaaaaccgaacgggaaacgtaccccgttaagttcttagactacgtaagtaacggtcgttacgttaacggtttagggaacggttcggggtacccagttacgtacggttcgacggcggacgtaggtaggactcggtaggggaactagtaactcctacgtcctacaccgttaattacgacgtacgtccgtcgaccgtacgccttaggatttacgttaacgtttacgaaacttaacaacttttaaccgttacgtacgtaacccgtagttaaacttaaacgttaaacgttaaacgtttaccggtaacgttttaacgggggtaacccgggtttaccgggaaacccggggtaaacggggtaaccgggtaaggggttacggtaaaccgtaaccgttaaacccggtaaaacggtaccgttacgggtcgggtaacgtccggaaacccttaccgtacgtttaccttaccggtttactttacccgtcccgtttccccggtacccg

SEQ ID NO: 225240 - DNA, 664 bp, Homo sapiens
  misc_feature: GYAE6OF01CVT9N.36.79.H02.1.454.CMB.1.raw
  modified_base (638)..(638): a, c, t, g, unknown or other
  misc_feature (638)..(638): n is a, c, g, or t
  modified_base (641)..(648): a, c, t, g, unknown or other
  misc_feature (641)..(648): n is a, c, g, or t
  modified_base (650)..(652): a, c, t, g, unknown or other
  misc_feature (650)..(652): n is a, c, g, or t
  modified_base (655)..(664): a, c, t, g, unknown or other
  misc_feature (655)..(664): n is a, c, g, or t
tcagtacgctgtctcacgaccggtgctcgatttagtgtcacacgaagggaaaggggctggagtgggtctcagttatttacagtggtggtaacagataccacgcagactccgtgaagggccgattcaccatctccagagacacatccaaagaacatgatttatcttacaaatgaacagcctgagagtcgaggacacagccgtatacttctgtgtgagagttacggacctctgactacggaaaatggatacagacgactacaattactacaaccacatcgggaaccgccgtaggggcaaggacgggacccgacgggtccaacccgtctcctcagtccttaccaccgaacgggccccacgtccccgtccttccccccgtggccccgtcccctcggtacccttaccgacgggtaccgacccgtaccccgtaccggaacgaccgtcccgaaccgaacccggtccccggtaccccggtacggggtccgtaccggtccccggtttcgggttaacccgtaaacgggtaaccctttacccgttacccgaaacggaacccggacggttccggtaaaccgtcggggaacgggtcccgggggtcgtacggggaaccgaaacggggcccggaacttaaggaacggtcaganacnnnnnnnngnnngcnnnnnnnnnn

SEQ ID NO: 225241 - DNA, 858 bp, Homo sapiens
  misc_feature: GYAE6OF01BYT7Z.36.79.H02.1.454.CMB.1.raw
  modified_base (195)..(195): a, c, t, g, unknown or other
  misc_feature (195)..(195): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgagganacagagtcaccatcacttgcccgggccagtcagtagtattagtctatttgggttggccttaggtactacgaaaccaagaaaaccgaagggaaacgtaccccgtaaaggttcttagacttacgtaagttaaacgggtccgttacttaacggtttagggtaaacggtcggggtacccctaagttccgtaaccgggtttacgacggtaccggcgtaacggtaggtacgttacgtacggggactaacggtaacttacccgtactaccgtacccgaacccgttaactttaacggcctaacggtccccgttacgaccgtaccggtcccgttacgtaacgttttcggttaaacttttttaacccaaaacgttacgtttaactttaaccccgttaggtaacccctaaacggttaaccgttaaaattaacgtttaaaccgttaacggtttaacggtttaccggggttaaacccggtttacccggggtaaacccggtaaaccggggggttaacccgtaacggggggttacggtaaacggtaacgttaacccgggtaaaaccggttaaccgttacggggtcgggtacccgttaacgggtaccccgtaaaccgttaccgttaccgtttacggtttaccctttaacccgtcccgtttacccgttcccccgtacccg

SEQ ID NO: 225242 - DNA, 693 bp, Homo sapiens
  misc_feature: GYAE6OF01DWC7Z.36.79.H02.1.454.CMB.1.raw
  modified_base (679)..(679): a, c, t, g, unknown or other
  misc_feature (679)..(679): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggcctcccgaggtgaccaaaggtgacatccagatcgacccagtcctcccttccaccctgtctgcatcgtgtaggacgacagacgtccaccatctacgttcggaccggcctagtcagtagttattagtctagttggttgccgtggtactacaacaacgaaaccgagggaaccgaccccgtaggtctagtatacgtagaaggtcgttacgttacgtttagggaacggttcgggtaccctagtaccgtacgggttacaggccggtacgtaggtcggtacgtcgggtaggaactaacggtaacttccgtacttcctacctaccgtaagtaccgacgtaccgtaccgtcgaccgtacggtcctaggtacgtttagtacgtttaacgactaacttacttacgttacctcgacctaagtaacttaagttacttaagttaccggttaggttacggtaccgggtacggaccggtaacgggacggtaggggtagaacgtaacgaaccgtaacggtacgtgggtacacgtacgacccgtactcgttacgtacgttaccttacnccttccccgtaccg

SEQ ID NO: 225243 - DNA, 739 bp, Homo sapiens
  misc_feature: GYAE6OF01AZTAH.36.79.H02.1.454.CMB.1.raw
tcagtacgctgtctcacgaccggtgctcgatttagtgtcacacgaagggaaagggggagtcagacccagtcaggacacagcatggacatgagggtcccccgctcagctcctggggctcctgctgctctggctcccaggtgccaaaggtgacatccagatgacccagtcctccttccaccctgtctgcatctgtaggagacagagtccaccatcacgttcgcccgggccagtcagagttattagtctagttggttggcctggtactacaacgaagaaaccgaaggggaacgccccgtaaggtcttagatacgtaataacggtcgtacgttaacgtttggaaacggtcgggtaccctagtccgtaacggttcaggtccggactaggtggtacgtcggtacgggaactaagtaacttcctaacgttcctaccgaacctaagtttacgaccacgtcccgtgaccgacgtcctagtagttagttacgtttacgaccgttaaactacttaacttaccgtaccgtacgtaacgtaactaaagttaacttaaacgtttaaccgtttaaggttaaccgggttaaccgggttacccgggtaaccgggtaaaccgggtaccgggtagggggtaacgtaacggtaaacgtaaaccggaaaacgttacggtaggttaccggtacggtaccgtaaccgtaaccgttacgttaccgttacctttaccgtaccttacccgttccgttaacccccg

SEQ ID NO: 225244 - DNA, 953 bp, Homo sapiens
  misc_feature: GYAE6OF01BJARX.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggcctcccaggtgccgaaaggtgacatccagatgacccagtctcccttccaccctgtctgcatctggtaggagacagagtccacatcacttgccgggccagtcagtagttattagtctagttggttcggccttgggtactaccgaacaacgaaaaccgaaggggaaaccgtacccccgtaaaggtcttaggtaacttacgtaaggtaacgggtccgttacgttaacggttttaggggaaaagggttccgggggttacccctaaggttacccgtaacggggtttccgaacgggtacccgggtccggtaaagggtttacgggtaacgttaccgggttaacggggggtaaacctaaaacgggtaaaccgtttaccttaaacccctttcccgtttacccgtaaaacccccttaaagttttaaccgggaacccgtaacccggttcccccggttacggaacccgtaacccgggttaccccgttacgggttaagtttacggtttaaacgttttttaccggaaacctttaaaaccttaacgttttaacgttttaaccggttaccgtaaccccgtaagggttaaacctaaaagtttaaaccgtttaaacgtttaaaccgggtttaaacggttttaccggggttaacccgggtttaacccggggtaacccggggttaaaaccgggggtaacccgggttaagggggttacggaaacggttaaccgtaaaccgtaaaaccggttaacggtacggttagggtacccggttccgaccgtaaccgttacgttaccgtttacgttacccgtttacccgttaccgttccccgtttaccccccg

SEQ ID NO: 225245 - DNA, 952 bp, Homo sapiens
  misc_feature: GYAE6OF01DTJPK.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctccgtggggctcctgctgctctggcctccgaggtcaccaaaggtgacataccagatcgacccagtcctcctccacctgtctgcatctaggtagagacaggactaccaacctataccgtacctttcggacccggggtacctaagttccaaaggtaaggttaacttttaaggtccttaaggttttggggttttacggaccccgtttaggggttaaacttaaccggaaaaccaaaaccgggtaaaaacccggaaaggggaaaaccgtaaccccccgttaaagggttaccgttacggaatttacgttaaacgttaaacgggtccggtttaccgttaacgtttaacggggtaaacggttacggggtacccctaaagttaccggtaaccgggttaccaagggaccgggtcgtaaagggttcggaacgttaccggttaagggggaacgtaaacggtaaactttacccgaaccctttacccgttaacctaacccgtaaacgtttaacggaaccgtaaacccgggttcccttaacgggaccgtaaaccgggtcccgttaaggtaacgtttacggttttaaagtttacggtaaaccctaaacttaacttttactttaaccggacgtaacccgaagtaacgtaaaacttaagttaaaaggtttaacccgttaaggtttacccggggtaaaccgtttccggggtaaacccggaaacgggaaccggggttaacggggaggtaaccggtaaaccgttaaaacgtaaaccgtaaccggttacggttacggaaccgttcggaaccctaaccgtaacgttccggttaccgtttacgttacccttaacgttccccgttaacccg

SEQ ID NO: 225246 - DNA, 602 bp, Homo sapiens
  misc_feature: GYAE6OF01B2XH7.36.79.H02.1.454.CMB.1.raw
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
  modified_base (583)..(602): a, c, t, g, unknown or other
  misc_feature (583)..(602): n is a, c, g, or t
tcagtacgctgtctcacgaccggtgctcgatttagtgtcacacgaagggaaaggggctggagtgggtctcagttatttacagtggtggtaacagataccacgcagactccgtgaagggccgattcaccatctccagagacacatccaaagaacatgatttatcttacaaatgaacagcctgagagtcgaggacacagccgtatacttctgtgtgagtagttacgacctntgactacggaaaatggatacagcgactcatatcaccacatggacnccgtggggcaggacgggaccacggtcaccggtcctcctcacgccttcccgaacgaacgggaccccactccccgttccttcccccccgtgggccccgtcccctcggtcctcccgtaacgggaccgtccctaccccgttacccggaacgacggccgaaccgaacggtcccccggcccccgtggggtaccctcggtccccgttcggtaacgaaacggggtacctttacccttacccgaacgtaaccgacggtaccggttacgtagggaccggccgggtcgtcggaacgacgggacacgaacgtgagcgatgnnnnnnnnnnnnnnnnnnnn

SEQ ID NO: 225247 - DNA, 751 bp, Homo sapiens
  misc_feature: GYAE6OF01B7YPM.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggcctcccaggtcgaccgaaaggtgacatccagatcgacccagtctccttccacctgtctgcatctgtaggagacagagtcacatcacttcgccgggcagtcagtagtatagtctagttggtgcctggtatacaaacgagtaaaccgaggaaacgccccgtaaggtcttagactacgtagtaacggtcttacgttacgtttagggaaaggttcggggtaccctagtccgtaacggttcgacggtaccggacgtaaggtcggtaacgttcggtaaggggtaacgtaaggtaacctttacgaccttcctaccaaacccgttagttacggacctaacggtccgttacggacctaacggtcccttaggaacgtttacgtaacgtttttcggaaccttaaacgtaactttaacgttaaccgtcggaaccctaaggtaacctaaattaacgttaaacgttaccgggtttaagtttacggggtaccgtttacccgggaacggttaaacgggtaccggtaagggggtacgtaacgacgtaaaccggaaaacgtaggtcgggttaggtccgtacggaccgtaacctacgttccgttacgtttacccttacgtacccgttcccgttaaccccgg

SEQ ID NO: 225248 - DNA, 717 bp, Homo sapiens
  misc_feature: GYAE6OF01DMI9C.36.79.H02.1.454.CMB.1.raw
  modified_base (203)..(203): a, c, t, g, unknown or other
  misc_feature (203)..(203): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggcctcccaggtcgaccaaaggtgacatccagactcgacccagtcctccttcccaccctgtctgcatctggtaganacgagactcaccatcacgttcggaccggccagtcgagtagttatagtctagttggttcgcgtaggtactacaacgaacgaaaccgaagggaaccgtacccccgtaaggtccttaggtatacgtaagtaacggcgttactacggtttaggaacggttcgggtacctagttcgtacgttcgacggtcggacgaggtggactcggtaacggacgtaagtaacttaccacttcacaacgtattacgcgactccgagaccgtacgtccgtagtagttacgttagtttacgaactaacgttattaacttaccgtacgacctaacgtaactaattaacgttaacgttaacggttacggtacgggttacccggttaccgggaaccgggttaaaccgggaaccggtagggggttaacgaacggtaacggtaaaccgtaaacgggtacgtacgggttacggaccttcggaacccgtacctacgttcgtttacgttccctttacgttcccttccccgttaccccg

SEQ ID NO: 225249 - DNA, 760 bp, Homo sapiens
  misc_feature: GYAE6OF01CZ16U.36.79.H02.1.454.CMB.1.raw
  modified_base (151)..(151): a, c, t, g, unknown or other
  misc_feature (151)..(151): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggcctcccaggtcgaccaaaggtnacatccagatcgacccagtctccttccacctgtctgctatcgtgtagagacagagtcacattcacttcggccggcagtcgagtagttattagtactaggtttcggttcggtccgttaggttactaccaaacgtaacggaaaaccgaagggaaaccgtaccccgttaaggttccgttagtacgttacgtaacgtaaggtcgtttaccgttaacggttacgggtaacggttcggggtaccctagtccgtaacgttacgacggacgacgtaggtggtacgtcggtacgggactaacggttaacttacctacttacctaccgtaacctagttacgtaccgtacgtcccgtagaccgtacgtcccgtaggtaaacgttgtttaagtttacgaactaacgtaatttaactttacgtacctacgtaaccgtaataacttaaagttaacgttaacgttaacgggttaacgggttaccgtaccgggtaacgggaaaccggtaccggtaggggtacggaaacgtactaaacccggtaacgtacggttacggtacgttcggtacgcccgtaaaccttcgttacgtttacccgttacttaccgttccttcccgttaacccg

SEQ ID NO: 225250 - DNA, 761 bp, Homo sapiens
  misc_feature: GYAE6OF01D159M.36.79.H02.1.454.CMB.1.raw
tcagtacgctgtctcacgaccggtgctcgatttagtgtcacacgaagggaaagggggaggtcagacccagtcaggacacagcatggacatgagggtcccccgctcagctcctggggctcctgctgctctggctcccaggtgaccaaaggtgacatccagatgaccagtctccttccaccctgtctgctatcgtgtaggagtacaggactccaccatccacgttcggcccgggcctagtccgagtagttattagtctagttgggttcgcctagggtaataccaaacgaacgtaaaaccgacggggaaacgtcccccgttaaaggttcttacgtaacttacgtaaacgtaacgggtccgttaccgttaacggttttaacggggaaacggttccggggttacccctaagttaccgtaacgggttacccgaaagggtacgggtaccgtaggggttacggtaacggttcccggtaagggggtaacctaaacggtaaacgtttcctaacccgttcgtaacccgtaccctaaggttaaccggacctaacgccgttacgaccgacgttccgtagttaaacttcgttagtttccgaactaaaccttagtttaacttaccgcgtaaccgacctaagtaaacttaacgtattaacggttgttacggtaccggtacgaaccgaagggtacaggggtagaaccgtacaacggaaacgtacgtgcggtacctcggaactccgtacttcttcgttcctacgtccttcccgtacccg

SEQ ID NO: 225251 - DNA, 826 bp, Homo sapiens
  misc_feature: GYAE6OF01B9YVS.36.79.H02.1.454.CMB.1.raw
  modified_base (785)..(785): a, c, t, g, unknown or other
  misc_feature (785)..(785): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggcctcccgaggtgaccaaaggtgacatccagatcgacccagtcctccttccaccctgtctgctatcgtggtacggagacagacgtacaccatcctacttcggcccgggccagtccagtagttagttacgtcgtagttggttcggccgtgggttactaccgaaaacgaacggaaaaccgaacggggtaaaaccgtacccccgttaaagggttcctttaggaacttacgtttaaagtaacgggtccgtttaccgtttaaaccggttttaggggaaacgggtttccggggtacccctaacgtttaccggtaacgggtttaccgaaggtcccgggacgttaaggggtacgtaagttccggtaacggggaaaccgtaagggttaactttaccgaaccttccctacctaaacctaagttacgaccgtacggtccctagaccgtaacgtccgtaattccgttaggtttagtttacgaacttaaacgtactttaacgtttcgtaccgaacccgtaagtaacctaaagtttaacgtaaactttggtttaaacgttaccgggtaccgggtttaccggggaacccgtaacggggtaaccggtaggggtacgaaacggttactaaaccggtaaaaccggtagttgggaccgtcgtaacgacccgttacnccgtttacgtactttaccgtcctaccgttacccgttacccg

SEQ ID NO: 225252 - DNA, 980 bp, Homo sapiens
  misc_feature: GYAE6OF01DJMEU.36.79.H02.1.454.CMB.1.raw
  modified_base (129)..(129): a, c, t, g, unknown or other
  misc_feature (129)..(129): n is a, c, g, or t
tcagtacgctgtctcacgaccggtgctcgatttagtgtcacacgaaggggaaagggggagtcagacccagtcaggacacagcatggacatggagggtccccgctcagctccgtggggctcctgctgctntggcctcccaggtgaccaaaggtgacatccagatgacccagtcctcctcccacctgtctgctatcgtaggtaaggagaacgtagacgtaccaacctactccgtacgttccgggcccggtaccgtaggtacgaaggtaacgttaattacgtacgttagttgggttacggtccgttaggtactaaccgaaaacgaacggtaaaacccggaacggggtaaacccgtacccccggttaaaggttaccgttagtaacgttaacgttaaacggttaacgggtacccgttttacgtttaaaccggttttaaggggtaaacgggtttaccgggggttacccctaaaggtttacccggtaaccgggtttaccgaacgggtacccggggtacgtaacgggttacgggtaacgttaccggggtacggggtaaacgttaaacggtttaaaccctttaaccgtaaccgtttacccctaacccgttaaacccgttaaagtttaacccggaccgtaaccggtccccgttaaggtaccccgtacggtaaccccgttagggttaacgtttacgttttaacggttttaacgaaaccgtttaaaccgttaactttaaccggtttaaccgttaaccggaccttaaacggttaaacttaaacgtttaaacgtttaaacgttaacggttttaacgggttaaccggggtttaaacccgggttacccgggaaaccggggtaaccgggtaaccggggttagggggtaacgtaaaccggtaaacgtaaccggtaaaacggttcggtaacggtcgggtaacgtaccgaccgttaactacgttccgttacgttccttacgttcccttacccgtacccgg

SEQ ID NO: 225253 - DNA, 649 bp, Homo sapiens
  misc_feature: GYAE6OF01B708T.36.79.H02.1.454.CMB.1.raw
  modified_base (154)..(154): a, c, t, g, unknown or other
  misc_feature (154)..(154): n is a, c, g, or t
  modified_base (218)..(218): a, c, t, g, unknown or other
  misc_feature (218)..(218): n is a, c, g, or t
  modified_base (285)..(285): a, c, t, g, unknown or other
  misc_feature (285)..(285): n is a, c, g, or t
  modified_base (582)..(582): a, c, t, g, unknown or other
  misc_feature (582)..(582): n is a, c, g, or t
  modified_base (595)..(595): a, c, t, g, unknown or other
  misc_feature (595)..(595): n is a, c, g, or t
  modified_base (602)..(602): a, c, t, g, unknown or other
  misc_feature (602)..(602): n is a, c, g, or t
  modified_base (612)..(612): a, c, t, g, unknown or other
  misc_feature (612)..(612): n is a, c, g, or t
  modified_base (640)..(640): a, c, t, g, unknown or other
  misc_feature (640)..(640): n is a, c, g, or t
tcagtacgctgtctcacgaccggtgctcgatttagtgtcacacgaagggaaagggctggaggtgggtctcagttatttacgagtggtggtaacagataccacgcagactccgtgaaggcctattccaccatctccagagacacatccaagaacntagtatttatctacaaatgaacagcctagagtacgtcgagacacgagtccgtatacttctgtgngagtagtacggacctcgtagtacgtaaggaaatggatacgacgtcgactacgactactccaactacncgtacggaccgtcggtcgggacaggaccggtaccacggtaccgtccgtacctccgacgacgtacctacccaacggtacccggccttaccgtcccgttccccgtccccgacggtccgtcccgtgtaccgtaccgaggaccgcctacccgtacgacgactcccgaacgtacggccccgtaccggtggcctacggtccgtaacggaccgtaacgtaccgtttacgaacctacggtaacgtaccgtcgttacgacggtaccgggcgtaccgtcggaaccggtcggactacgtaacgtcggntacggacataganaaccgtnagcggtaacngtagctagtctactcgtactcggactancttcgatcg

SEQ ID NO: 225254 - DNA, 677 bp, Homo sapiens
  misc_feature: GYAE6OF01EHOLQ.36.79.H02.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (484)..(484): a, c, t, g, unknown or other
  misc_feature (484)..(484): n is a, c, g, or t
tcagtacgctgtctcacgaccggtgctcgatttagtgtcacacgaagggaaagggggagtcagacccagtcaggacacagcatggacatgagggtcccgctcagctcctggggctcctgctgctctggctcccaggtgaccaaaggtgacatccagatgacccagtcctccttccacctgtctgctatctgaggagacaggacncaccntctacgtggccggcagtcaggtattattaggtctagttcgggtgtccgtaggtactacgaacagaaaccgaggaaacctccgtaaggtctagactacgtaagtacggtcttaccgtagtttagggaacgtccgggtcctaagtcgtacggttcaggtcgacgaggtcgtactcggtagggactaagtacgtcctacgtctaccacttaagttaccgacgtacgtaccgtgacctacggtcgtagtacggttacttaagtttacgaactaaacgtntttaacgtctacgacctagtactaaacttacgtaacggttactttacgggtaacggttacggttcccggaaacgtacgggggtaaccgtaggggtacgtaaaccgtagttaaaccgaaacggttcgtacgggtagtaaccgcgacctaacccgtgttaccgttacgttactcgttacccgttcccggtacccg

SEQ ID NO: 225255 - DNA, 898 bp, Homo sapiens
  misc_feature: GYAE6OF01D59PO.36.79.H02.1.454.CMB.1.raw
  modified_base (170)..(170): a, c, t, g, unknown or other
  misc_feature (170)..(170): n is a, c, g, or t
  modified_base (204)..(204): a, c, t, g, unknown or other
  misc_feature (204)..(204): n is a, c, g, or t
tcagtacgctgtctcacgaccggtgctcgatttagtgtcacacgaaggggaaagggggagtcagacccagtcaggacacagcatggacatggagggtccccgctcagctccgtggggctcctgctgctctggcctcccaggtgaccaaaggtgacactcagatcgaaccngtcctccttccacctgtctgcagtctggtagganacaggactaccactatccacgttcggcccggactagtacgaaggtacgtttaagttacggttactaggtttgggttcggtccgttaaggtaactaacaaaccgaaaggaaaacccgtaacggggaaaaccgttaccccgttaacggtttacgttagtaacgttacgttaaacgtaacgggtccggtttaaccgttacgggttttaacgggtaaagggtttacccgggggttaccctaacggttacgttaacccgggttacggaaccggacggggtcgtaacggggtaggttaccggtttaaccggaggggaaacgtaacttaacggtttaccgaaccttcggttaaccaaccgtaaagttaacggcctacgggtcccgtacgaccgtaaccggaccttaggtaactttagtttaacgttacgtaacgaaacctttaataccgttaactacgtaaccggaattaacccgtttaaataaaccggtttaaatttaaccgggtttaacggtttaaccgggggtaacccgtttaaccggggtaacccgttaaaaggggggaaccgggtaacgggttacggaaaacgttaaaccgaaaccgggtaaaacgtttaacgggtaccgggtgtaacgtccggaaaccttacgttaaacttccgttacggttaaccctttcgtaacccctttcgggtaacccccc

SEQ ID NO: 225256 - DNA, 451 bp, Homo sapiens
  misc_feature: GYAE6OF02IEK1T.36.79.H02.1.454.CMB.1.raw
  modified_base (367)..(367): a, c, t, g, unknown or other
  misc_feature (367)..(367): n is a, c, g, or t
  modified_base (441)..(451): a, c, t, g, unknown or other
  misc_feature (441)..(451): n is a, c, g, or t
tcagtacgctgtctcacgaccggtgctcgatttagtgtcacacgaagggaaaggggctggagtgggtctcagttatttacagtggtggtaacagataccacgcagactccgtgaagggccgattcaccatctccagagacacatccaagaacatgatttatcttcaaatgaacagcctgagagtcgaggacacagccgtatacttctgtgtgagagttaggacctctgactcggaaaatggatacagcgactcatatcaccacatggacgcctggggcagagggaccaggtcaccgtctcctcagcttccaccaagggcccatccgtcttccccctggccgccctgcctccaggagcacctccgagngcacagccgccctgggctgcctggtcaggactacttccagacagcgtactgagcgggctggcaaggcgcatagnnnnnnnnnnn

SEQ ID NO: 225257 - DNA, 511 bp, Homo sapiens
  misc_feature: GYAE6OF02GPGFM.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggcagtcagagtattagtcattggttggcctggtatcaacagaaaccagggaaagcccctaaggtcttgatctataaggcgtctacttggaaagtgggtcccatcacggttcagcggcagtggatctgggacagaattcactctcaccattagcagcctgcagcctgatgattttgacaacatattactgccagcaatataatacgtattggacgttcggaccaagggaccagggtaggagatacgaacgtaactggtggactgacacactcgtcgtcttctacttcctcccg

SEQ ID NO: 225258 - DNA, 501 bp, Homo sapiens
  misc_feature: GYAE6OF02FXWZ9.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggcgtctactttggaaagtggggtcccatcacggttcagcggcagtggatctgggacagaattcactctcaccattagcagcctgcagcctgatgattttgcaacatattactgcagcaatataatacgtattggacgttcggccaagggaccagggtggagatacaaacgacgtgtggctgcaccatctgtcttcatcttcccg

SEQ ID NO: 225259 - DNA, 505 bp, Homo sapiens
  misc_feature: GYAE6OF02FT084.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggcgtctactttggaaagtggggtcccatcacggttcagcgcagtggatctgggacagaattcactctcaccattagcagcctgcagctgatgattttgctaacatattactgacagcaatataatacgtattggtacgttcggaccgaacgggacgagggtggagagtacgaacgacgtgtagctgacacatctgtctctatctcccg

SEQ ID NO: 225260 - DNA, 447 bp, Homo sapiens
  misc_feature: GYAE6OF02JB0V2.36.79.H02.1.454.CMB.1.raw
  modified_base (440)..(447): a, c, t, g, unknown or other
  misc_feature (440)..(447): n is a, c, g, or t
tcagtacgctgtctcacgaccggtgctcgatttagtgtcacacgaagggaaaggggctggagtgggtctcagttatttacagtggtggtaacagataccacgcagactccgtgaagggccgattcaccatctccagagacacatccaagaacatgatttatcttcaaatgaacagcctgagagtcgaggacacagccgtatacttctgtgtgagagttaggacctctgactcggaaaatggatacagcgactcatatcaccacatggacgcctggggcagagggaccacggtcaccgtctcctcagcttccaccaagggcccatccgtcttccccctggcgccctgctccaggagcacctccgagagcacagccgccctgggctgcctggtcaaggctacttccagacagcgtactgagcgggctggcaaggcgcatagnnnnnnnn

SEQ ID NO: 225261 - DNA, 573 bp, Homo sapiens
  misc_feature: GYAE6OF02ITREP.36.79.H02.1.454.CMB.1.raw
  modified_base (199)..(199): a, c, t, g, unknown or other
  misc_feature (199)..(199): n is a, c, g, or t
tcagtacgctgtctcacgaccggtgctcgatttagtgtcacacgaagggtaaagggggagtcagacccagtcaggacacagcatggacatgagggtccccgctcagctcctggggctcctgctgctctggctcccaggtgccaaaggtgacatccagatgacccagtcctccttccaccctgtcctgcatctgtagganacaggagtcaccatccacttgccggcaggtccagtagtattagtcattggttggcctggtattacaactagaaaccagggaaagacccctaaggtcttagatcctaataaggtcgttactactttagggaaagttcggggtacccaagtactacggtttcaggcggcgagtggatcgtgggacagaattcgactcttacacctaattagactagcctgcagcctgatgtatttgctaacattattactagtccagtacaatataatacgttattggtacgttacgaccgtaacgggaccgtagggtcgagacgtacgaaacgacgtaggtacggactagacacgtacgtcgttcgtccttactactccttcccg

SEQ ID NO: 225262 - DNA, 534 bp, Homo sapiens
  misc_feature: GYAE6OF02GQ7R9.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggcgtctacttggaaagtggggtcccatcacggttcagcggcagtggatctgggacagaattcactctcaccattagcagcctgcagcctgatgattttgactaacattattactgaccagactaataataaatacgtattaggacgttcggaccgtaaggggaccgagggtaggagtataccgaaacgtaacgtggtaggcgtgacaccgactcttcgtcttctactccttaccccg

SEQ ID NO: 225263 - DNA, 499 bp, Homo sapiens
  misc_feature: GYAE6OF02IKUH0.36.79.H02.1.454.CMB.1.raw
  modified_base (492)..(492): a, c, t, g, unknown or other
  misc_feature (492)..(492): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggcgtctactttggaaagtggggtccatcacggttcagcggcagtggatctgggacagaattcactctcaccattagcagcctgcagcctgatgtattttgcaaactattattactgccagcaatataatacgtattgacgttcggaccaagggaccagggagagagtacaaacgatgtgctgcacatctgtctcntctcccg

SEQ ID NO: 225264 - DNA, 535 bp, Homo sapiens
  misc_feature: GYAE6OF02J1245.36.79.H02.1.454.CMB.1.raw
  modified_base (255)..(255): a, c, t, g, unknown or other
  misc_feature (255)..(255): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggcagtcagagtattagcattggttgcctggtatcanagaacaggaaagcccctaaggtcttgatcataaggcgtctacttggaaagtggggtccagtcacggttcagcggcaggtgagtctgggacagtaattcatctcaccattagctagcctagcagcctggatcgtattttgactaacattattacttgcccagactaatagttaatacgtattaggtacgttcggaccgaacgggacgtagggtagagactacgtaaacgaagtggtacggctagaccaccgtagtcctacgttctactactccttaccccg

SEQ ID NO: 225265 - DNA, 542 bp, Homo sapiens
  misc_feature: GYAE6OF02I3AW6.36.79.H02.1.454.CMB.1.raw
  modified_base (510)..(510): a, c, t, g, unknown or other
  misc_feature (510)..(510): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcacatcacttgccgggcagtcagagtattagtcagttggttgcctggtatcaaacagaaaaccgagggaaacgcccctaaagggtcttaggatctaataaggcgtactaacgtttaggaaagtgggtcccatcgacggttcagcggcagtggatcgtgggacagtaattcacgtctacacctattagcagctgcagcctgactgtattttgactaactattattactagtcagtactaataataatacgtattaggacgttacgacgtaagggaccgagggtagagatacgaagtaacgtggtacgntacgacactagtctgttctactactcctaccg

SEQ ID NO: 225266 - DNA, 454 bp, Homo sapiens
  misc_feature: GYAE6OF02FNXN6.36.79.H02.1.454.CMB.1.raw
  modified_base (356)..(356): a, c, t, g, unknown or other
  misc_feature (356)..(356): n is a, c, g, or t
  modified_base (445)..(454): a, c, t, g, unknown or other
  misc_feature (445)..(454): n is a, c, g, or t
tcagtacgctgtctcacgaccggtgctcgatttagtgtcacacgaagggaaaggggctggagtgggtctcagttatttacagtggtggtaacagataccacgcagactccgtgaagggccgattcaccatctccagagacacatccaagaacatgatttatcttcaaatgaacagcctgagagtcgaggacacagccgtatacttctgtgtgagagttaggacctctgactcggaaaatggatacagcgactcatatcaccacatggacgcctggggcagagggaccacgggtcaccgtctcctcagcttccaccaagggcccatccgtcttccccctggcgccctgctccaggancacctccgagagcacagcccgccctgggcctgcctggtcaaggactacttccagacagcgtactgagcgggctggcaagggcgcatagnnnnnnnnnn

SEQ ID NO: 225267 - DNA, 617 bp, Homo sapiens
  misc_feature: GYAE6OF02HGE6O.36.79.H02.1.454.CMB.1.raw
tcagtacgctgtctcacgaccggtgctcgatttagtgtcacacgaagggaaagggggaggtcagacccagtcaggacacagcatgggacatgagggtccccgcgtcagctcctggggctccttgctgctctggctcccaggtgccaaaggtgacatccagatgacccaggtctccttccaccctgtctgcatctgtaggagacagagtcaccatcacttgccgggccagtcagagtattagtcattggttggcctggtatcaacagaaaccgagggaagccctaaggtcttgattctaataaggcgtctacttaggaaagtggggtaccatcacggttcgagcggcaggtggatctgggacagaattcactctacaccaattacgctacgcctgcacgcctagattaggtattttgactaacattaagttacgtacgcctaagactaaataattaaataacgttaagttaggtaacgttacgggaccgtaaacggggtaccgagggtaggaaggtacgtaccgaaaacggtaaccgtacggttacgggaccgtacggaccgtaacccgtagttaccgttacgtttacctttaccgtaacgttcccgttaacccccgg

SEQ ID NO: 225268 - DNA, 569 bp, Homo sapiens
  misc_feature: GYAE6OF02JH5HQ.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctccaggtgccaaaggtgacatccagatgacccagtctccttccacctgtctgcatctgtaggagacagagtcaccatcacttggccggcagtcagagtatagtcattggtgcctggtatacaacagaaacagggaaacgccccgtaaggtcttgatacgtagtaacggcgtacttacgtttaggaaaggtcggggtacccagtacgtacggttacacggcggcaggtggatcgtgggacaaggtaattcaactctacacctatacgcacgctgcacgcctgatgtatttcgacaatattagttactcgactagactaatataatacggtattcgggtacgttcggaccgtaagggaccgtagggtagaactatacgaaacgtacgtggtaggtctacggaccactacgttcgtacgttactaccgtacttccgtacccg

SEQ ID NO: 225269 - DNA, 584 bp, Homo sapiens
  misc_feature: GYAE6OF02IK2T8.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcagttggttggcctggtatcaacagaaaccagggaaacgccctaaggtctgatctataaggcgtctacgttggaaagtcgggtacccatcacggttcagcggcaggtggatcgtagggacaggtaattcactctaccacctattacgcacgcctgcagcctgatgtatttcgactaactattaattacctagacctaagtactaaataataaagttacgttagtttacgggtacgttaccggacgaacgggaaccggtagggtacggtaagacgtacgaaaacggtacgtaggtacggactcgaccaccgtacttcgttcgttaccttactaccttcccgttacccg

SEQ ID NO: 225270 - DNA, 574 bp, Homo sapiens
  misc_feature: GYAE6OF02JA1SM.36.79.H02.1.454.CMB.1.raw
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtagganacagagtcaccatcacttgccgggcagtcagagtattagtcattggttgcctggtatcaacagaaaccagggaaacncccctaaggtcttgatctagtaaggcgtctacgtttaggaaagtgggtcccatcacggttcagcggcagtggatcgtgggacagaattcgactctcacctattacgcagtcctgcagcctgattgtacttttgctaactattacttactgcctaacgactaataataaattacgttattacgggtaacgtttcggaccgtaacggggaccgtaggggtacggagaagtacgaaacgtacgtggtacggctacggtaccaaccgtacttccgttcgttacttactacttcccgttaccccgg

SEQ ID NO: 225271 - DNA, 508 bp, Homo sapiens
  misc_feature: GYAE6OF02FK0G9.36.79.H02.1.454.CMB.1.raw
  modified_base (304)..(304): a, c, t, g, unknown or other
  misc_feature (304)..(304): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaaccagggaaagcccctaagggtcttgatctataaggcgtntactttggaaagtggggtcccatcacggttcagcggcagtggatctgggacaggaattcactctcaccattagcagcctgcagcctgatgattttgcaacatattactgccagacaatataatacgtattggacgttcggccaagggaccgaggtggagatacgaaacgacgtgtggctgcacatctgtcttctactcttcccg

SEQ ID NO: 225272 - DNA, 575 bp, Homo sapiens
  misc_feature: GYAE6OF02HASLD.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctcccttccaccctgtctgcatctgtaggagacagagtcacatcacttgccgggccagtcagagtattagtcagttggttggtcctggtaatcaacaagaaaccgaagggaaacaccccgtaaggtcttagatctaagtaaggtcgtactacgttagggaaacgtcgggtcccatcgtacggttcgagcggctaggtggatcgtagggacaagtacttcactctacactattacgctacgctgcacgcctagatgtatttcgacgtaactattacttactcgactagactaatattaactacgttagttacggtaccgttacggaccgaagggtaacgtagggtagagtatacggtaaacgcgtaggtgacgtacgacctacgtatcgttatctactacgtccctcccg

SEQ ID NO: 225273 - DNA, 520 bp, Homo sapiens
  misc_feature: GYAE6OF02G14CH.36.79.H02.1.454.CMB.1.raw
  modified_base (340)..(340): a, c, t, g, unknown or other
  misc_feature (340)..(340): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtatagtcattggttggcctggtatcaacagaaaccagggaaagcccctaaggtcttgatctataaggcgtctacgtttggaaagttggggtcccatcacggttcagcggnagtggatctgggacagattcactctcaccattacgcagcctgcagcctgatgtattttgactaactattattactgccagctaatataatacgtattggacgttcggacgaagggacgagggtaggagatacgaacgacgtggtaggctagcacgatcgttctacttctacttctccccg

SEQ ID NO: 225274 - DNA, 568 bp, Homo sapiens
  misc_feature: GYAE6OF02I0YVU.36.79.H02.1.454.CMB.1.raw
  modified_base (518)..(518): a, c, t, g, unknown or other
  misc_feature (518)..(518): n is a, c, g, or t
  modified_base (523)..(525): a, c, t, g, unknown or other
  misc_feature (523)..(525): n is a, c, g, or t
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (562)..(564): a, c, t, g, unknown or other
  misc_feature (562)..(564): n is a, c, g, or t
  modified_base (566)..(567): a, c, t, g, unknown or other
  misc_feature (566)..(567): n is a, c, g, or t
tcagtacgctgtctcacgaccggtgctcgatttagtgtcacacgaagggaaagggggcctaggagtcggtctcgagttatttaccagtggtggtaacagataccacgcagactccgtgaagggccgattcaccattctccgagagacacatccaaagaacatcgattttatcttcaaatgaacagcctgagagtcgaggacacagccgtatacgttctgtgtgagtagttacggacctctgacgtacggtaaaatggaatacagcgactcatatcaccacatcggaccgccgtgggacgagacgggaccgacggtcgaccgtcgtccgtcagccttaccaccgtaacggacccaactacccgtccttcccccgtaggcccgaccctcgcctaccgacgacgaccacctccgacgacgacacgacgcccgcccgtcggctcggccgtcggtacgaacggaccttacgttaccagaccacgacgtacgtcggacggccgggctagggaccgaaggccganagtgnnngnagactcgancgtgagtctagtgtagcagcngtntnnngnng

SEQ ID NO: 225275 - DNA, 538 bp, Homo sapiens
  misc_feature: GYAE6OF02HDLXZ.36.79.H02.1.454.CMB.1.raw
  modified_base (273)..(273): a, c, t, g, unknown or other
  misc_feature (273)..(273): n is a, c, g, or t
  modified_base (336)..(336): a, c, t, g, unknown or other
  misc_feature (336)..(336): n is a, c, g, or t
  modified_base (515)..(515): a, c, t, g, unknown or other
  misc_feature (515)..(515): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggcagtcagagtattagtcattggttggcctggtatcaacagaaaccagggaacnccctaaggtctgatctataggcgtctactttggaaagtgggtcccagtcgacggttcagcggnaggtggatcgtgggacaggaacttcactctcactattacgctagcctgcacgcctgattgattttgactaactattattactcgaccagtacctaataataatacgttattcggtacgttcggaccgaagggaccgagggtagagacgtacgaaacgtacgtggtggtactcgcaccgnttctgtcttactactccttcccg

SEQ ID NO: 225276 - DNA, 582 bp, Homo sapiens
  misc_feature: GYAE6OF02F27BN.36.79.H02.1.454.CMB.1.raw
tcagtacgctgtctcacgaccggtgctcgatttagtgtcacacgaagggaaagggggagtcagacccagtcaggtacacgagcgatggacatgaggggtccccgctcagctacctggggctcctgctgctctggctcccaggtgccaaaggtgacatccagatgacccagtctccttccacctgtctgcatctgtaggagacgagagtcaccatccacttcgccggccacgtcagagtacttagtcctattcggttggcctcggtatcaacagaaaccaggaaacgtccccgtaaggtcttgatactacgtaacggcgtactacgtttaggaaaggttggggtacccattccacggttcacgcggtcaggttggactcggtgggacaggaacgttcactctacaccattacgcagcctgcagcctgatgtattttgactaactattattaactcgtacagtacaattattaaacttacgtaagttcgggtacgttcggaccgtaagggaccgagggtggaagtatacgaaacgtaacgtggtaggtctcgacacgagttcgtacgttcttctactccgttcc

SEQ ID NO: 225277 - DNA, 824 bp, Homo sapiens
  misc_feature: GYAE6OF02F4G34.36.79.H02.1.454.CMB.1.raw
  modified_base (612)..(612): a, c, t, g, unknown or other
  misc_feature (612)..(612): n is a, c, g, or t
tcagtacgctgtctcacgaccggtgctcgatttagtgtcacacgaagggaaagggggagtcagacccagtcaggacacagcatggacatgagggtccccgctcagctcgtggggctcctgctgctctggcctcccgaggtcgacctaaagggtcgacatccagatcgaccctagtcctccttccacctgtctgctatcgtgtaggagacagacgtcacatcacgttcggccgggcagtcaagtagttagttagtctagttcggttcggcctaggtactacgaacgaacgtaaaccgacgggaaacgtaccccgtaaggttcttagactacgtaagtaacggtcgtttacgttaacgtttagggaaacggttccggggtaaccctacgttaccggtaaccgggtttacgacggtaccgggacgtagggttacggtaacgttccggttagggggaaacctaagggttaaactttcctaaaccgttcttaaccgtaacccgtaagtttaacgaccgtaacggtcccttagggacctacggtcccgttaggtacgttagttacgttttacgaacccgtaaacgtaacgtttaacgttaccgtagtaacccgttaanaaccgttaaattaagttaaacgtttaacgggtaacgtttaccgggtaacccgggtttaaccgggaaccggtaacggggtaaccgtaggggggttaacgaaggttaaccgtaaccgtaaacggtaaccggttacgggacggttacgtaccgtaaccgtaccgtactttccggttaccgtttaccgttacttaccgtttacccgttacccccgg

SEQ ID NO: 225278 - DNA, 537 bp, Homo sapiens
  misc_feature: GYAE6OF02FR8J0.36.79.H02.1.454.CMB.1.raw
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
tcagtacgctgtctcacgaccggtgctcgatttagtgtcacacgaagggaaagggggagtcagacccagtcaggacacagcatgaacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggcgtctactttggaagtggggtcccatcacggttcagcgacagtggatcgtgggacagaattcactctcaccattacgcagcctgcagcctgatgtattttgactaanattattacngccagactaatataatacgtattggtacgtttcggaccaagggaccgtagggtggaagatacgaaacgtacgtggtaggtctcggacaccgtagtcgttacgtcctttctacttccttccccg

SEQ ID NO: 225279 - DNA, 602 bp, Homo sapiens
  misc_feature: GYAE6OF02HIJH9.36.79.H02.1.454.CMB.1.raw
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
  modified_base (442)..(442): a, c, t, g, unknown or other
  misc_feature (442)..(442): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatcgacccagtctccttccaccctgtctgcatctgtaggagacagagtcaccatcacttcggccggcagtcagagtattagtcagttggtggcctggtactacaacaagaaaccgagggaacgaccccgtaagggtcttaggactactaagtaaggtcttacgtacgttaggaaaggtcgggtccagtctacggttnacggcggntaggtgtagtcgtagggacagtaatcgactactcactattacgacagccgtnactgacctgtatcgttatttcgataactnttacgttactgtaccaatactaatacttaagttaacgttagttcggaacgttccggaacgtaacgggaccggtaagggtgaacgtacgtacggtaaacgtacgttggccgtatcgaacctaccgtattccggttattcccgttactccgttcccgtaccc

SEQ ID NO: 225280 - DNA, 620 bp, Homo sapiens
  misc_feature: GYAE6OF02HHG5F.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagctagtttggttggccttggtatcaacagaaaccagggaacgcccgtaaggtctagattctagtaggcgtacttacgtttagggaaaggttcggggtcccagtcgtaacggttcaggcggctaggtgatcggtggacagtaattcacgtctacacctagttacgcagcctgctacgctacgagttgtattttacgactaaactattaactttactcgtaccacgactaactaattaacgtaacggttaagtttacgggtaaccgtttcgggaaccgtaaacgggacgtaacggggacgggtaagtaacgtacgaaacggtaacgtagggtcggtacgtgtaccgtaccacgttcgttacgttccttacttaccgtccttaccccg

SEQ ID NO: 225281 - DNA, 719 bp, Homo sapiens
  misc_feature: GYAE6OF02G723G.36.79.H02.1.454.CMB.1.raw
  modified_base (328)..(328): a, c, t, g, unknown or other
  misc_feature (328)..(328): n is a, c, g, or t
tcagtacgctgtctcacgaccggtgctcgatttagtgtcacacgaagggaaagggggagtcagacccagtcaggacacagcatggacatgagggtccccgctcagctccgtggggctcctgctgctctggcctcccaggtgaccgaaaggtgacatccagatcgacccagtcctccttccaccctgtctgcatctgtaaggacgactagacgtccaacctactcctacgtttccggccgggtcctaagtccgagtacgttaattacggtctagtttcgggttaggccgttaggttactacgaaacaacggaaaccgaaggggaaaccncccgtaaggttccttagacttacgtaagttaacggtcgttaccttaacggtttaggaaacgggttccgggttacccaacgtcgtacgggttcaggtccggacgtaggtcgtacgtccgttagggaactaaggtaactttcgaacttctaccaccgttaagttacgactacgtccgtgacctacgtaccaggtacttacgttagtttcgaactaactagttacttacggtccacgtactacgtaaataacggttacttaaggtacgtttaggtaacccgttcgggaacccggtaagggtaaccggtagggaagtacgaacgtaacgaacggttacggtaggtaccgacgtacgacctacgtagttcctaagttctacgttacttccgtaccg

SEQ ID NO: 225282 - DNA, 528 bp, Homo sapiens
  misc_feature: GYAE6OF02FRL65.36.79.H02.1.454.CMB.1.raw
  modified_base (275)..(275): a, c, t, g, unknown or other
  misc_feature (275)..(275): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgcccgggccagtcagagtattagtcattggttggcctggtatcaacagaaaccagggaaancccctaaaggtcttgatctataaggcgtctactttggaaaggtggggtacccagtcacggttcagcgcagtggatcgtgggacagaattcactctcactattagctagcctgcacgcctgatgtattttgacaactatacttactcgaccagactaatataattacgtaattcggtacgttacggaccgaagggaccgtagggtaggagtagtacaacgacgtgtggctgcacatctgttctctactctcccg

SEQ ID NO: 225283 - DNA, 700 bp, Homo sapiens
  misc_feature: GYAE6OF02H6TZV.36.79.H02.1.454.CMB.1.raw
  modified_base (680)..(680): a, c, t, g, unknown or other
  misc_feature (680)..(680): n is a, c, g, or t
tcagtacgctgtctcacgaccggtgctcgatttagtgtcacacgaagggaaagggggagtcagacccagtcaggacacagcatggacatgagggtccccgctcagctcctggggctcctgctgctctggcctcccgaggtcgcccgaaaagggtgacatccagatcgaccctagtcctcccttccaccctgtctgcatcgtggtaaggagacagacgtccaaccatcacgttcggccggccaagtcagtagtattagtctagtttggttcggtccgtggtatacaaacgaagaaaccgaaggaaacgaccccgtaaggttcttagatacgtaagtaacggtcgttacttaaggtttaggaaacggtcgggtaccctagtacgacggttacaggcggtacgtaggtaggtacgtcggtacgggaacaagtaacttcacttctaccaacgtattacgcgtaacgtccgtagacgtaccgtccgttagagttagttactttagaaccttaacgtaattaaccttaacggtacacgtaactactaaataaacttaactttacggtagttacggtaccggttaccgggaaccgttaacgggacccggtaagggtaagtaacgaaccgtaacgtaaacggtacgtcgtacggtcaaccgtacctaacgtacttcgtcgttaccttnttacccgtacccgttacccg

SEQ ID NO: 225284 - DNA, 651 bp, Homo sapiens
  misc_feature: GYAE6OF02HW258.36.79.H02.1.454.CMB.1.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (431)..(431): a, c, t, g, unknown or other
  misc_feature (431)..(431): n is a, c, g, or t
tcagtacgctgtctcacgaccggtgctcgatttagtgtcacacgaagggaaagggggagtcagacccagtcaggacacagcatggacatgagggtccccgctcagctccgtgggctcctgctgctctggctcccaggtgaccaaaggtgacatccagatcgacccagtctccttccacctgtctgcatctgtagganacagagtcaccatcacttcgccggcagtcagagtatagtcagttggtgcctggtatcaacaagaaccgaggaacnccctaaggtctgatactataggtctctagttaggaacgtgggtacccagttacgacggttcaggtcggacgtaggtagacgttcgtagggaacaaggtaacttcgaacttctaccgtaaacctacgttacgacgtacgccgttgacctagacccgttanacgttaggttaacttttcgaacctaaatatttaacttaccgtcgtaacgtacgtaactaaagttaacgttaaacgttaaccggttaagtttacgggtaccgttaccggtaaccggtaacgggtacccgtaaggggtacgtaagtaccgacgtaaacggtacgtgggtacgtctacgtacgacctagttccgtacgttctttacgtaccttacctacccgg

SEQ ID NO: 225285 - DNA, 857 bp, Homo sapiens
  misc_feature: GYAE6OF02HBTHU.36.79.H02.1.454.CMB.1.raw
tcagtacgctgtctcacgaccggtgctcgatttagtgtcacacgaaggggaaagggggagtcagacccagtcaggacacagcatggacatgagggtccccgctcagctcctggggctcctgctgctctggctcccaggtgaccaaaggtgacatccgagatggacccagtcctcccttcccaccccgtgtctcgactactcgtaggtacggagacgacggtactaccacctactaccgtacggttccgggcccgggacctaggtaccgaaggtaacggttattacggtcgttaggtttcggggttacgtcggttagtactaaccgaaacgtaaacggaaacccgggaagggtaacccctacccggtttaaaggttcttaacggtactttaacgtaaggaaccggttccggttaaccttaaggggtttaacgggtaacgggttcccggggaacccttaacgtccggtacggtccgagggtccgagtggtacgtgtccgggtaacggtactaagttactccgtaactcccgtaactacctaagtccgacgtaccgccgtacgccgtacgtccgtagtacgttagttacgttacgaaccgtaattacgttaaccgttacgtaccgaaccgtaacgtaaccttaaaagtaaacgttaacgtttaaccgggttaacgtttccgggtaaaccggttcccggggaaccgggtaaaccggggtaccgggtaagggtaaccggttaacgggtaacctaaaccgggtaaacgtaacgggtcgggtacggtacccggtacgtaaccccgttaaacgttccgttccgtttagtttacccgttaaccttaccgttaccccgttaccccgg

SEQ ID NO: 225286 - DNA, 571 bp, Homo sapiens
  misc_feature: GYAE6OF02JKGK7.36.79.H02.1.454.CMB.1.raw
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (358)..(358): a, c, t, g, unknown or other
  misc_feature (358)..(358): n is a, c, g, or t
  modified_base (407)..(407): a, c, t, g, unknown or other
  misc_feature (407)..(407): n is a, c, g, or t
  modified_base (476)..(476): a, c, t, g, unknown or other
  misc_feature (476)..(476): n is a, c, g, or t
  modified_base (519)..(519): a, c, t, g, unknown or other
  misc_feature (519)..(519): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (561)..(562): a, c, t, g, unknown or other
  misc_feature (561)..(562): n is a, c, g, or t
  modified_base (566)..(566): a, c, t, g, unknown or other
  misc_feature (566)..(566): n is a, c, g, or t
  modified_base (569)..(570): a, c, t, g, unknown or other
  misc_feature (569)..(570): n is a, c, g, or t
tcagtacgctgtctcacgaccggtgctcgatttagtgtcacacgaagggaaaggggccggagtgggtctcagttatttacagtggtggtaacagataccacgcagactccgtgaagggccgattcaccatctccagagacacatccaagaacatgatttatcttcaaatgaacagcctgagagtcgaggacacagccgtatacttctgtgtgagagttaggacctctgactacggaaaatggatacagcgactcatatcaaccanatggacnccgttgggnacggagggaccacggtacaccggtctacctcagccttaccaccgaacgggcccagtccgtaccgttccccctggccnccctgcctcacggtacgcaccctcggagacgacctacacgtccgcccgngggtacctcgcccgtcggtaccaaacgggacctttaccgtacccgacgaacacggtccgtacgtacggnggacccgggtcggtacggaccgtaacggccgacgtaacgtagngtacggctacagagcncgngngcgacgagacncncncanacnngcgnacnng

SEQ ID NO: 225287 - DNA, 685 bp, Homo sapiens
  misc_feature: GYAE6OF02JOFEG.36.79.H02.1.454.CMB.1.raw
tcagtacgctgtctcacgaccggtgctcgatttagtgtcacacgaagggaaagggggagtcagacccagtcaggacacagcatggacatgagggtcccgctcagctcctggggctcctgctgctctggcctccaggtgccaaaggtgacatccagatcgacccagtctccttccaccctgtctgactatctgtaggagacgagagtcaccatcactcgccggacagtacagtagtattagtctagttcggtggtcctaggtatacaactacgaaaccgaggaaacgacccgtaaggtcgttacgattacgtataaggtcgttacgttacgttagggtaacggtcggggtaccctagtaccgtacggttacgacggcgggcgtaggtacggtagtcggtagggacaagtaacttcgaactcctacaaccttagttacgctacggtccctagccacggtccttaggtactagttatttacgactaaacctagtttactaccgtcgaccctagaaacctaaattaacttaacgttaaacggttacggttaccggttaaccggttccgggaaccgtaaaggggtacggtacgggtaggaaccgtaagtaccgaaaacggtcgtacggtacggtacgtccgaaccgtaacgacgttcgtacgttactttacccgatttccccggtaaccc

SEQ ID NO: 225288 - DNA, 743 bp, Homo sapiens
  misc_feature: GYAE6OF02GWI1N.36.79.H02.1.454.CMB.1.raw
tcagtacgctgtctcacgaccggtgctcgatttagtgtcacacgaagggaaagggggagtcagacccagtcaggacacagcatggacatgagggtccccgctcagctccgtggggctcctgctgctctggctcccgaggtcgaccaaaggtgacactccagatcgacccagtcctccttccaccctgtctgctatcgtaggtaggacgacagacgtccaccatctacgttcggccgggcagtcaggagttattgtcgtagttggtggtccgtaggtactacgaaacgaacgtaaaccgaacgggaaaccgtccccgtaaggttcttagtacttacgtaagtaacggtcgttacttacggttagggaacggtcgggtacctagttcgacggttcgacggtcggacgtaggtacgtacgtcgggtaacgggtaactaacggttaacttcctacgttacctacctaacgtagttacgaccgtaaccgtccgcgtaccggtcgtacgttagtacgttacgttacgtttacgaacttaaccttagttaacttccgtacaactacgtaaactaagtttaactaacgtttacgttacggtaacgggttaccgtaaccggaccggtaacgggaacgggttacgggacggtaaagtacccggtaacaacgggtacggttacggtacggtcctaaccgccgtaaccgttgttaccgttacgttcccttacggttacctccccggttaacccgg

SEQ ID NO: 225289 - DNA, 724 bp, Homo sapiens
  misc_feature: GYAE6OF02HBN1A.36.79.H02.1.454.CMB.1.raw
  modified_base (177)..(177): a, c, t, g, unknown or other
  misc_feature (177)..(177): n is a, c, g, or t
  modified_base (250)..(250): a, c, t, g, unknown or other
  misc_feature (250)..(250): n is a, c, g, or t
  modified_base (667)..(668): a, c, t, g, unknown or other
  misc_feature (667)..(668): n is a, c, g, or t
  modified_base (676)..(676): a, c, t, g, unknown or other
  misc_feature (676)..(676): n is a, c, g, or t
  modified_base (682)..(682): a, c, t, g, unknown or other
  misc_feature (682)..(682): n is a, c, g, or t
  modified_base (684)..(684): a, c, t, g, unknown or other
  misc_feature (684)..(684): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (698)..(698): a, c, t, g, unknown or other
  misc_feature (698)..(698): n is a, c, g, or t
  modified_base (705)..(705): a, c, t, g, unknown or other
  misc_feature (705)..(705): n is a, c, g, or t
  modified_base (711)..(711): a, c, t, g, unknown or other
  misc_feature (711)..(711): n is a, c, g, or t
tcagtacgctgtctcacgaccggtgctcgatttagtgtcacacgaagggaaagggctggagtgggtctcagtttatttacagtggtgtaacagataccacgcagactccgtgaaggccgattcaccatctccagagacacatccaagaactatgtatttatcttacaaatacgaacngtcctgagagtcgagacagacgacgttatacgttctgtgtagagtagttacgacctcgtgtacgtaggtaaanggtactacgagacgtactcaatactaccaaccaatacggtacggtaccgaccgggttaggggaccgacgggtaacgggtaacccggtaccggttacccgaaccgttcccgttaccgtaaccgcgttacccttacccgaacccggtaaccgggacccctacggtttccccttccgttacccccggtcggcccgttcccgtacgtcccgtaaccggtacgtaccgaccgtaaccccggtacgaacgaccggacctaaccggaccggtaccccggttccgggttacgggtcccgtacggtcccggttacggtaaccggtaaccggtacccttaccgtaccgtacggtaccgtacggtaaccgttacggtacggacgggtaccgacggtaccgtacggaacgtcgtaacacgtaagcagtnnacgacgtnctacgngntaggcananagttnaccgtancgttanacacgtacgatag

SEQ ID NO: 225290 - DNA, 178 bp, Homo sapiens
  misc_feature: GYAE6OF01AWO0Q.13.22.B11.1.454.CMB.1.raw
  modified_base (171)..(178): a, c, t, g, unknown or other
  misc_feature (171)..(178): n is a, c, g, or t
tcagtcacgtactacacgaccggtgctcgatttagacgacagctcagggcccatcggtcttcccctggcgccctgctccaggagcacctccgagagcacagcggccctgggctgcctggtcaaggactacttcctagtacgtgactgagcgggctgggcaaggcgcatagnnnnnnnn

SEQ ID NO: 225291 - DNA, 174 bp, Homo sapiens
  misc_feature: GYAE6OF01E0UJJ.13.22.B11.1.454.CMB.1.raw
  modified_base (171)..(174): a, c, t, g, unknown or other
  misc_feature (171)..(174): n is a, c, g, or t
tcagtcacgtactacacgaccggtgctcgatttagacgacagctcagggcccatcggtcttccccctggcgccctgctccaggagcacctccgagagcacagcggccctgggctgcctggtcaaggactacttcctagtacgtgactgagcgggctggcaaggcgcatagnnnn

SEQ ID NO: 225292 - DNA, 173 bp, Homo sapiens
  misc_feature: GYAE6OF01E1FC2.13.22.B11.1.454.CMB.1.raw
  modified_base (167)..(167): a, c, t, g, unknown or other
  misc_feature (167)..(167): n is a, c, g, or t
  modified_base (172)..(173): a, c, t, g, unknown or other
  misc_feature (172)..(173): n is a, c, g, or t
tcagtcacgtactacacgaccggtgctcgatttagacgacagctcagggcccatcggtcttccccctggcgcccctgctccaggagcacctccgagagcacagcggccctgggctgcctggtcaaggactacttcctagtacgtgactgagcgggctggcaaggcgnatagnn

SEQ ID NO: 225293 - DNA, 725 bp, Homo sapiens
  misc_feature: GYAE6OF01BRRO6.13.22.B11.1.454.CMB.1.raw
  modified_base (592)..(592): a, c, t, g, unknown or other
  misc_feature (592)..(592): n is a, c, g, or t
  modified_base (604)..(604): a, c, t, g, unknown or other
  misc_feature (604)..(604): n is a, c, g, or t
tcagtcacgtactacacgaccggtgctcgatttagacgacagctcaggggactttctgagagtcctggacctcctgtgcaagaacatgaaacatctgtggttcttcctcctcctggtggcagctcccagagtgggtcctgtcccaggtgcagctgcaggagtccgggccaggactggtgacggtccttcacacgaccctcgtccctcatctgctagtcgtctcgtggtcgtccttccttcgagtcgtaggttcggtttacgtttcgtacgttggacgtcgttacggaccgtcccggacgaccggcccgggacggggaaggcgtgggtaggtggtaggttcgggtactttagacgtaacgtcggaccggtagggtcggggaccaaccgacggtaccctaaccccgtaacccctaccgtaacgaacggaccgcccgtaccgtacctaaccgttacgtttaaccgaacggtaaccgaccgtaacccgtaaccgaaaccggtaacctcgtacccttaccgtacccgtaaggaacgtcgttaaggtcgttacgacggtaccgaccgcgtacgaacgccgtaccggtctagtactcgngtacgcgtacgngtaggtcgtcggtcgggacggaaccgacgggtaccgtcggtacccgtacgtccgtccgacgtccgacccgtaacccgaccggtacccggccttaccgggtcccgtcccgtccccggtccgg

SEQ ID NO: 225294 - DNA, 746 bp, Homo sapiens
  misc_feature: GYAE6OF01BN00S.13.22.B11.1.454.CMB.1.raw
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
  modified_base (466)..(466): a, c, t, g, unknown or other
  misc_feature (466)..(466): n is a, c, g, or t
  modified_base (577)..(577): a, c, t, g, unknown or other
  misc_feature (577)..(577): n is a, c, g, or t
tcagtcacgtactacacgaccggtgctcgatttagacgacagctcaggggactttctgagagtcctggacctcctgtgcaagaacatgaaacatctgtggttcttcctcctcctggtggcagctccagatgggtcctgtcccaggtgcagctgcaggagtcgggcccaggactggtgaggtccttnacagaccctgtccctnatctgcagtgtctcgtggtgcctccttcgagtcgtaggttcggttaacgtttccgtagtgggacgtcgtagggtacgttccgggaccgaccgggcccgggacggggtaaacgggtccgtagggtacgtgggtagtttcggggctttacgacgtaagtcggcctaggggtcggggaccacgacgtaccctacccaaccccgtctacgaacggcgaccgtcgtacctactatttcgaacgtacgaccgtacgaaccaaacggaccncgtacctccctacccgagtaaccgtcgtacgtacggttccgtacgggtaccgaccccggtcacgtaacggacccgtaccggtccgtttagtaccgttaaccgtggtaccgnggtaccggtacggtacgggttacggtacccggtcggtaccggggaaccggtacgggtaaccccggtcggtaacccggtccgtcccttaaccggccctcccggttaccccacccgtaacccgggaacccgtcccctaagggtttcccccggtcccgtaccccggtcccgg

SEQ ID NO: 225295 - DNA, 172 bp, Homo sapiens
  misc_feature: GYAE6OF02HGAD6.13.22.B11.1.454.CMB.1.raw
  modified_base (170)..(172): a, c, t, g, unknown or other
  misc_feature (170)..(172): n is a, c, g, or t
tcagtcacgtactacacgaccggtgctcgatttagacgacagctcagggcccatcggtcttcccctggcgccctgctccaggagcacctccgagagcacagcggccctgggctgcctggtcaaggactacttcctagtacgtgactgagcgggctggcaaggcgcatagnnn

SEQ ID NO: 225296 - DNA, 179 bp, Homo sapiens
  misc_feature: GYAE6OF02FSFDB.13.22.B11.1.454.CMB.1.raw
  modified_base (171)..(179): a, c, t, g, unknown or other
  misc_feature (171)..(179): n is a, c, g, or t
tcagtcacgtactacacgaccggtgctcgatttagacgacagctcagggcccatcggtcttccccctggcgccctgctccaggagcacctccgagagcacagcggccctgggctgcctggtcaaggactacttcctagtacgtgactgagcgggctggcaaggcgcatagnnnnnnnnn

SEQ ID NO: 225297 - DNA, 840 bp, Homo sapiens
  misc_feature: GYAE6OF02IZ1XQ.13.22.B11.1.454.CMB.1.raw
  modified_base (210)..(210): a, c, t, g, unknown or other
  misc_feature (210)..(210): n is a, c, g, or t
  modified_base (419)..(419): a, c, t, g, unknown or other
  misc_feature (419)..(419): n is a, c, g, or t
tcagtcacgtactacacgaccggtgctcgatttagacgacagctcaggggactttctgagagtcctggacctcctgtgcaagaacatgaaacatctgtggttcttcctcctctggtgcagctccagagtggtcctgtcccaggtcgcagcgtgcgaggcggtccggccgaggacgtggtggcgtccttcgaacacgtccctcgtcccctntactcgtcgacgtggttctcgttcggttcgggtccgtccttttccctcgacgtcgttaggttcgggttttacgttttacgacggtcgggtaagtccggttaggccgtccggaccgaccggccccggggtaaccggggaaaccgggtcggtaggggtcggttagggtaacggttcgggttactttaacgtacgtaacgtcggtaaccggnggggtcggggtaccaacgtaccgtaccgtaaaccccgtacccgtaccgtaacgaaaccggtcgcccgtacggtacctaaccgtttacgtacgtaacgacgtaaccgtaacccgtaaccgaaaccgtaaccgcgttacctaccgttaccgtaacggtactacgtacggttacgtcgtacgaaccggccgtaccgacgacgtaaccggtccgtacgttacgacgtttacggcgtaccggccggtacggtaaccgggacggtttaccgggccggttacggggaaccgggtaccgggaaccgggtaacccggttcccggtacccggtacccgttcccctacggttacccgacccgttaccccgtacccgtaacccggaccggtaaccccgttcggtacccccggtttccccgtacccgggtcccg

SEQ ID NO: 225298 - DNA, 721 bp, Homo sapiens
  misc_feature: GYAE6OF02I29OX.13.22.B11.1.454.CMB.1.raw
tcagtcacgtactacacgaccggtgctcgatttagacgacagctcaggggactttcgtgagagtcctggacctcctgtgcaagaacatgaaacatctgtggttcttcctcctcctggtgcagctcccagatggtcctgtcccaggtgcagctgcaggagtcggacccaggactggtgaggtcccttcacgacgtaccctgtcccctcatctgacagtcgtcgtcgtggtcgtccttccgttcacgctaggtggttacgtttacagtggacgtcgtaggacgtcccggccgacggaccccgggtaccggggaacggtacgtagggacggtaggtacgtttcgggtactttacgtacgtaacgtcggaccgtacggggtcggggaccaacccgtacggtaaccctaccccgtaacccccgtacctaacggaacgaccgtcccgtaccgttaccaacccgttagttacgaaggttacgaacgaccgtaaccgaaacgaacctacgtcctacctaccgtagacgtctacgttcttccgtgtaccgacccgcgtaccgaacgaccgtaccggtacgttacttacgttccgagccgacgtaccgtaggacgggttccgacgttacgggaccggacgaaccggtaccgaccgtccaccgttctaccgacgaccgttacccaccggaaccggaccggtacctaccgggtcccttacccgtcccgtccgg

SEQ ID NO: 225299 - DNA, 352 bp, Homo sapiens
  misc_feature: GYAE6OF01BJWDM.39.17.B06.1.454.CMB.1.raw
  modified_base (348)..(352): a, c, t, g, unknown or other
  misc_feature (348)..(352): n is a, c, g, or t
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcggggagttatgtctggggccagggaaccctggccaccgtctcctcagcctccaccaagggcccatcggtcttccccctggcgccctgctccaggagcacctccgagagcacagcggccctgggctgcctggtcaaggactacttccactagtgcgactgagcgggctggcaaggcgcatagnnnnn

SEQ ID NO: 225300 - DNA, 354 bp, Homo sapiens
  misc_feature: GYAE6OF01A51FM.39.17.B06.1.454.CMB.1.raw
  modified_base (348)..(354): a, c, t, g, unknown or other
  misc_feature (348)..(354): n is a, c, g, or t
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcggggagttatgtctggggccagggaaccctggccaccgtctcctcagcctccaccaagggcccatcggtcttccccctggcgccctgctccaggagcacctccgagagcacagcggccctgggctgcctggtcaaggactacttccactagtgcgactgagcgggctggcaaggcgcatagnnnnnnn

SEQ ID NO: 225301 - DNA, 353 bp, Homo sapiens
  misc_feature: GYAE6OF01BX632.39.17.B06.1.454.CMB.1.raw
  modified_base (347)..(353): a, c, t, g, unknown or other
  misc_feature (347)..(353): n is a, c, g, or t
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcggggagttatgtctggggccagggaaccctggccaccgtctcctcagcctccaccaagggcccatcggtcttccccctggcgccctgctccaggagcacctccgagagcacagcggccctgggctgcctggtcaaggctacttccactagtgcgactgagcgggctggcaaggcgcatagnnnnnnn

SEQ ID NO: 225302 - DNA, 352 bp, Homo sapiens
  misc_feature: GYAE6OF01A188V.39.17.B06.1.454.CMB.1.raw
  modified_base (348)..(352): a, c, t, g, unknown or other
  misc_feature (348)..(352): n is a, c, g, or t
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcggggagttatgtctggggccagggaaccctggccaccgtctcctcagcctccaccaagggcccatcggtcttccccctggccgccctgctccaggagcacctccgagagcacagcggccctgggctgcctggtcaaggctacttccactagtgcgactgagcgggctggcaaggcgcatagnnnnn

SEQ ID NO: 225303 - DNA, 373 bp, Homo sapiens
  misc_feature: GYAE6OF01CPFAO.39.17.B06.1.454.CMB.1.raw
  modified_base (360)..(373): a, c, t, g, unknown or other
  misc_feature (360)..(373): n is a, c, g, or t
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcgggagttatgtctggggccagggaaccctggccaccgtctcctcagcctccaccaagggcccatccggtcttcccccgtgccgccctgcctccaggcgcacctccgagcgcacagcggccctgggcctgcctggtcaaggactacttccactagtgccgactggaggtccgggctggacgaaggcgacagtagnnnnnnnnnnnnnn

SEQ ID NO: 225304 - DNA, 364 bp, Homo sapiens
  misc_feature: GYAE6OF01BGRS3.39.17.B06.1.454.CMB.1.raw
  modified_base (350)..(364): a, c, t, g, unknown or other
  misc_feature (350)..(364): n is a, c, g, or t
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcggggagttatgtctggggccagggaaccctggccaccgtctcctcagcctccaccaagggcccatcggtcttccccctggcgccctgctccaggagccacctccgagagcacagcggccctgggctgcctggtcaaggactacttccactagtgcgactgagcgggctggcaagggcgcatagnnnnnnnnnnnnnnn

SEQ ID NO: 225305 - DNA, 466 bp, Homo sapiens
  misc_feature: GYAE6OF01BAKW3.39.17.B06.1.454.CMB.1.raw
  modified_base (403)..(403): a, c, t, g, unknown or other
  misc_feature (403)..(403): n is a, c, g, or t
  modified_base (420)..(420): a, c, t, g, unknown or other
  misc_feature (420)..(420): n is a, c, g, or t
  modified_base (430)..(466): a, c, t, g, unknown or other
  misc_feature (430)..(466): n is a, c, g, or t
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaacgacccggccctctatggggtcggggagttatgtcgtggggccagggaccctggccaccgtctcctcacgccctccaaccgaacgggccccagtccggttcccttccccccgtggacccgtcccctgcctccgaggacgcctacccgtcgagacgcaccgacggcccggccctggggacctcggtccgtcgggtacgaaacggtaccttaccttcccgacgtacggtcggaccgtacgttcggaggtccgggtacgnggggtaccaaggggccncgaagtacgnnnnnnnnnnnnnnnnnnnnnnnnnnnnnnnnnnnnn

SEQ ID NO: 225306 - DNA, 359 bp, Homo sapiens
  misc_feature: GYAE6OF02FUVUA.39.17.B06.1.454.CMB.1.raw
  modified_base (354)..(359): a, c, t, g, unknown or other
  misc_feature (354)..(359): n is a, c, g, or t
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaacaggccctctatgggtcggggagttatgtctggggccagggaaccctggccaccgtctcctcagcctccaccaagggcccatccggtccttccccctggccgccctgcctccaggacgccacctccgagagcacagcggccctgggctgcctggtcaaggactacttccactagtgcgactgagcgggctggcaaggcgcatagnnnnnn

SEQ ID NO: 225307 - DNA, 127 bp, Homo sapiens
  misc_feature: GYAE6OF01EMIDY.31.52.E08.1.454.CMB.1.raw
  modified_base (106)..(127): a, c, t, g, unknown or other
  misc_feature (106)..(127): n is a, c, g, or t
tcagcagtagacgtcacgaccggtgctcgatttagtcgagctctcccgcgagagaggcgatacgctgtcagtctctcactgctgatggcgcgagggagcgatacgnnnnnnnnnnnnnnnnnnnnnn

SEQ ID NO: 225308 - DNA, 487 bp, Homo sapiens
  misc_feature: GYAE6OF01C38WK.31.52.E08.1.454.CMB.1.raw
  modified_base (142)..(142): a, c, t, g, unknown or other
  misc_feature (142)..(142): n is a, c, g, or t
  modified_base (170)..(170): a, c, t, g, unknown or other
  misc_feature (170)..(170): n is a, c, g, or t
  modified_base (173)..(173): a, c, t, g, unknown or other
  misc_feature (173)..(173): n is a, c, g, or t
  modified_base (178)..(178): a, c, t, g, unknown or other
  misc_feature (178)..(178): n is a, c, g, or t
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
  modified_base (487)..(487): a, c, t, g, unknown or other
  misc_feature (487)..(487): n is a, c, g, or t
tcagcagtagacgtcacgaccggtgctcgatttagtcgagctctcccgcgagagaggcgatacgctgtcagtctctccgcgagggaggcgagtacgctgtcagtctctcgcgagggacgcgagtacgctgtcagtctctcgngagggacgcgagtacgctgtcagtctcncgngaggngcgagtcgctaggtcagtctcncgcgaggcgcgagtcggctgtccagtctcgcgcgaggcgcgagaccgntacgtcngtctcncgtgcgacgngaacggcgtcgagtcgngtacgcncgtcgacgcgcgngcgcgngcgcgcgtcgtcgcgtcgcgcgcgcgtcgcgcgcgtgcgtcgtcgtcgtacgtacgtacgacgngtacgtacgcgtacgtcgcgtacgtcgcgtcgtcgtacgtcgtcgcgtacgtacgtacgtacgtcgtcgtcgtcgtacgtcgtcgtcgtacgtcgacgtagtacgtcgn

SEQ ID NO: 225309 - DNA, 146 bp, Homo sapiens
  misc_feature: GYAE6OF01BR4I1.31.52.E08.1.454.CMB.1.raw
  modified_base (130)..(146): a, c, t, g, unknown or other
  misc_feature (130)..(146): n is a, c, g, or t
tcagcagtagacgtcacgaccggtgctcgatttagtcgagctctcccgcgagggaggcgatacgctgtcagtctctccgcgagggagcgatacgctgtcagtctctcgatggcgcgagggagcgatacgnnnnnnnnnnnnnnnnn

SEQ ID NO: 225310 - DNA, 187 bp, Homo sapiens
  misc_feature: GYAE6OF01C9QSF.31.52.E08.1.454.CMB.1.raw
  modified_base (164)..(187): a, c, t, g, unknown or other
  misc_feature (164)..(187): n is a, c, g, or t
tcagcagtagacgtcacgaccggtgctcgatttagtcgagctctcccgcgagggaggcgatacgctgtcagtctctccgcgagggaggcgatacgctgtcagtctctccgcgagggaggcgatacgctgtcagtctctcctgatggcgcgagggagcgatacgnnnnnnnnnnnnnnnnnnnnnnnn

SEQ ID NO: 225311 - DNA, 492 bp, Homo sapiens
  misc_feature: GYAE6OF01DXWJB.31.52.E08.1.454.CMB.1.raw
  modified_base (378)..(378): a, c, t, g, unknown or other
  misc_feature (378)..(378): n is a, c, g, or t
  modified_base (413)..(413): a, c, t, g, unknown or other
  misc_feature (413)..(413): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagcagtagacgtcacgaccggtgctcgatttagtcgagctctcccgcgagggaggcgatacgctgtcagtctctccgcgagggagcgatacgctgtcagtctctccgcgagggaggcgatacgctgtcagtctctcgcgaggaggcgagtacgctgtcagtctctcgcgacggcggcgagtacggctggtcagtctctcggcgcgagggacgcgacgtacggcgtcggtacacggtctcgcggcgacggcggaacgcggaacgccggatcgtcgcgtcgtcgtccgaaggcgtcggacggcgtacggtcggcgtgcgtcgtcgtcgtcgtcgtcgcgacgcgcgcgcgtcgacgcgtcgcgcgcgcgcgcgcgcgngcgcgcgcgcgcgcgcgcgcgtcgcgcgcgcgcgngcgtcgcgcgcgcgcgcgacgcgtcgcgcgtcgcgcgcgcgcgngngcgcgagcgcgacgcgcgcgcgngcgngtagcg

SEQ ID NO: 225312 - DNA, 153 bp, Homo sapiens
  misc_feature: GYAE6OF01ALOVU.31.52.E08.1.454.CMB.1.raw
  modified_base (140)..(153): a, c, t, g, unknown or other
  misc_feature (140)..(153): n is a, c, g, or t
tcagcagtagacgtcacgaccggtgctcgatttagtcgagctctcccgcgagggaggcgatacgctgtcagtctcttggcgcgagggaggcgatacgctgtcagtctctcactgctgatggcgcgagggaggcgatacgnnnnnnnnnnnnnn

SEQ ID NO: 225313 - DNA, 407 bp, Homo sapiens
  misc_feature: GYAE6OF01A0HW2.31.52.E08.1.454.CMB.1.raw
  modified_base (105)..(105): a, c, t, g, unknown or other
  misc_feature (105)..(105): n is a, c, g, or t
  modified_base (113)..(113): a, c, t, g, unknown or other
  misc_feature (113)..(113): n is a, c, g, or t
  modified_base (121)..(121): a, c, t, g, unknown or other
  misc_feature (121)..(121): n is a, c, g, or t
  modified_base (132)..(132): a, c, t, g, unknown or other
  misc_feature (132)..(132): n is a, c, g, or t
  modified_base (138)..(138): a, c, t, g, unknown or other
  misc_feature (138)..(138): n is a, c, g, or t
  modified_base (142)..(142): a, c, t, g, unknown or other
  misc_feature (142)..(142): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (357)..(359): a, c, t, g, unknown or other
  misc_feature (357)..(359): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (370)..(371): a, c, t, g, unknown or other
  misc_feature (370)..(371): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (386)..(388): a, c, t, g, unknown or other
  misc_feature (386)..(388): n is a, c, g, or t
  modified_base (390)..(390): a, c, t, g, unknown or other
  misc_feature (390)..(390): n is a, c, g, or t
  modified_base (392)..(394): a, c, t, g, unknown or other
  misc_feature (392)..(394): n is a, c, g, or t
  modified_base (397)..(397): a, c, t, g, unknown or other
  misc_feature (397)..(397): n is a, c, g, or t
  modified_base (402)..(403): a, c, t, g, unknown or other
  misc_feature (402)..(403): n is a, c, g, or t
  modified_base (405)..(405): a, c, t, g, unknown or other
  misc_feature (405)..(405): n is a, c, g, or t
tcagcagtagacgtcacgaccggtgctcgatttagtcgagctctcccgcgagagaggcgattacgctgtcagtctctcgactgggcacgagggagccgatacggntgcagtcnctgatgcncgacgagccanacgctnacgntctctgatgacaatgcgccgatcgctgctntgnctntgngncncanagatgtattnatancgtcgtcgtgngngtcgcgcncnctcgntcncgtagagtanagtgtgtctcncactactancgcgacgcgcgtcacgtctngtgngngngngngcgcgcgcgcgngcgngagngngagngngtgtgngntntntatatctctctctgcncncgcnnnangacgcncgnngcgcngcgngngcgnnngngnnngtnacagnngngc

SEQ ID NO: 225314 - DNA, 451 bp, Homo sapiens
  misc_feature: GYAE6OF01BSHK2.31.52.E08.1.454.CMB.1.raw
  modified_base (142)..(142): a, c, t, g, unknown or other
  misc_feature (142)..(142): n is a, c, g, or t
  modified_base (147)..(147): a, c, t, g, unknown or other
  misc_feature (147)..(147): n is a, c, g, or t
  modified_base (172)..(172): a, c, t, g, unknown or other
  misc_feature (172)..(172): n is a, c, g, or t
  modified_base (177)..(177): a, c, t, g, unknown or other
  misc_feature (177)..(177): n is a, c, g, or t
  modified_base (240)..(240): a, c, t, g, unknown or other
  misc_feature (240)..(240): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (411)..(412): a, c, t, g, unknown or other
  misc_feature (411)..(412): n is a, c, g, or t
  modified_base (415)..(415): a, c, t, g, unknown or other
  misc_feature (415)..(415): n is a, c, g, or t
  modified_base (417)..(420): a, c, t, g, unknown or other
  misc_feature (417)..(420): n is a, c, g, or t
  modified_base (422)..(423): a, c, t, g, unknown or other
  misc_feature (422)..(423): n is a, c, g, or t
  modified_base (425)..(436): a, c, t, g, unknown or other
  misc_feature (425)..(436): n is a, c, g, or t
  modified_base (438)..(451): a, c, t, g, unknown or other
  misc_feature (438)..(451): n is a, c, g, or t
tcagcagtagacgtcacgaccggtgctcgatttagtcgagctctctcgctagggaggcgatacgctgtcagtctctcgcgagggaggcgatacgctgtcagtctctccgcgagggaggcgatacggctgtcagtctctccgngaggngcgatacggctgtcagtctctccgngaggnggcgatacggctgtccaggtctctccgcgaggtgccgatacggctggtacaggtctcgtccgngtacggtcgccgagtacggcctggtaccaggtcctcgtccgaggtagtcggccagtacggctcggtacaggtcttcgccgaggtacgtcgcagtcggngtcgancggtntccagtgntcggcaggagcgatgacggtncgngngngcgngngngngngngngngngngngnncgngnnnngnngnnnnnnnnnnnngnnnnnnnnnnnnnn

SEQ ID NO: 225315 - DNA, 146 bp, Homo sapiens
  misc_feature: GYAE6OF01BYD0Y.31.52.E08.1.454.CMB.1.raw
  modified_base (134)..(146): a, c, t, g, unknown or other
  misc_feature (134)..(146): n is a, c, g, or t
tcagcagtagacgtcacgaccggtgctcgatttagtcgagctctcccgcgagggaggcgatacgctgtcagtctctccgcgagggagcgatacgctgtcagtctctcgctgatggcgcgagggaggcgatacgnnnnnnnnnnnnn

SEQ ID NO: 225316 - DNA, 179 bp, Homo sapiens
  misc_feature: GYAE6OF01DJY2E.31.52.E08.1.454.CMB.1.raw
  modified_base (164)..(179): a, c, t, g, unknown or other
  misc_feature (164)..(179): n is a, c, g, or t
tcagcagtagacgtcacgaccggtgctcgatttagtcgagctctcccgcgagagaggcgatacgctgtcagtctctccgcgagggaggcgatacgctgtcagtctctccgcgagggaggcgatacgctgtcagtctctcctgatggcgcgagggagcgatacgnnnnnnnnnnnnnnnn

SEQ ID NO: 225317 - DNA, 460 bp, Homo sapiens
  misc_feature: GYAE6OF01AX1CG.31.52.E08.1.454.CMB.1.raw
  modified_base (103)..(103): a, c, t, g, unknown or other
  misc_feature (103)..(103): n is a, c, g, or t
  modified_base (115)..(115): a, c, t, g, unknown or other
  misc_feature (115)..(115): n is a, c, g, or t
  modified_base (133)..(133): a, c, t, g, unknown or other
  misc_feature (133)..(133): n is a, c, g, or t
  modified_base (164)..(164): a, c, t, g, unknown or other
  misc_feature (164)..(164): n is a, c, g, or t
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
tcagcagtagacgtcacgaccggtgctcgattttagtcgagctctcccgcgagggaggcgatacgctgtcagtatggcgcgagggagcgatacgctgtcagtntggcgcgagggngcgagtacgctgtcagtntcgcgcgagggcgcgagtacggctgtcagtntcgcgcgaggcgcgagtacgcttaggcgagtgtcgcgcgacggagcgagacgctgcgcgtctggcncgaggcgcgaaagttccggngcgcgcgcgcgcgcgcgcgcgcgcgcgcgcgcgcgcgcgcgcgcgcgngcgngcgcgcgcgcgcgcgngcgcgcgcgcgcgcgcgcgcgngcgngngngngcgtcgcgcgcgngcgngcgcgacgtacgcgtcgcgtgtgtgcgcgacgcgcgtcgtcgngcgcgngcgtacgtacgcgtgacgcgacgcgacgtacgcgagcgngngng

SEQ ID NO: 225318 - DNA, 515 bp, Homo sapiens
  misc_feature: GYAE6OF01BICJ9.31.52.E08.1.454.CMB.1.raw
  modified_base (167)..(167): a, c, t, g, unknown or other
  misc_feature (167)..(167): n is a, c, g, or t
  modified_base (182)..(182): a, c, t, g, unknown or other
  misc_feature (182)..(182): n is a, c, g, or t
  modified_base (191)..(191): a, c, t, g, unknown or other
  misc_feature (191)..(191): n is a, c, g, or t
  modified_base (205)..(206): a, c, t, g, unknown or other
  misc_feature (205)..(206): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (392)..(392): a, c, t, g, unknown or other
  misc_feature (392)..(392): n is a, c, g, or t
tcagcagtagacgtcacgaccggtgctcgatttagtcgagctctcccgcgagagaggcgatacgctgtcagtctctcggcgcgagggagcgatacgctgtcagtctctcggcgcggagggagcgatacgctggtcagtctctcgagagggaggcgagtacgctgtcngtctcgtcgcgaggngcgagacgntgtcagtctcgtgnnggcgcggaggcgactagtcgctgcgtntcncgtagngcgtaggacgcggaagcntcggncgtcnggtcgaacgcgngtaacggtcngtgacgnaagtgtcgcgtcgcgacgcgtcgacgagtcgtagcgtcgtcgcgcgtcgcgtcgacgtacgtagcgtcgtacgtgtcgtcgtcgtcgtcgtgngacgcgcgacgtacgcgtcgtacgtcgacgtcgtgtcgtgtagtacgcgtacgtacgagtcgtacgtcgcgtacgtcggacgtcgcgccggtcgtcgtacgtagtacgtacgtacgtcgtacg

SEQ ID NO: 225319 - DNA, 175 bp, Homo sapiens
  misc_feature: GYAE6OF01EN8V0.31.52.E08.1.454.CMB.1.raw
  modified_base (111)..(111): a, c, t, g, unknown or other
  misc_feature (111)..(111): n is a, c, g, or t
  modified_base (161)..(175): a, c, t, g, unknown or other
  misc_feature (161)..(175): n is a, c, g, or t
tcagcagtagacgtcacgaccggtgctcgatttagtcgagctctcccgcgagagaggcgatacgctgtcagtctctccgcgagggaggcgatacgctgtcagtctctccgngagggagcgatacgctgtcagtctctcgatggcgcgagggagcgatacgnnnnnnnnnnnnnnn

SEQ ID NO: 225320 - DNA, 244 bp, Homo sapiens
  misc_feature: GYAE6OF01CJQ2U.31.52.E08.1.454.CMB.1.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (220)..(244): a, c, t, g, unknown or other
  misc_feature (220)..(244): n is a, c, g, or t
tcagcagtagacgtcacgaccggtgctcgatttagtcgagctctcccgcgagagaggcgatacgctgtcagtctctccgcgagggaggcgatacgctgtcagtctctccgcgagggagcgatacgctgtcagtctctccgcgagggagcgatacgctgtcagtctctcgcgagggagcgagtacgctgtcagtctctcgatggcgngagggngcgatcgnnnnnnnnnnnnnnnnnnnnnnnnn

SEQ ID NO: 225321 - DNA, 574 bp, Homo sapiens
  misc_feature: GYAE6OF01BIYWQ.31.52.E08.1.454.CMB.1.raw
  modified_base (80)..(80): a, c, t, g, unknown or other
  misc_feature (80)..(80): n is a, c, g, or t
  modified_base (141)..(141): a, c, t, g, unknown or other
  misc_feature (141)..(141): n is a, c, g, or t
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (439)..(439): a, c, t, g, unknown or other
  misc_feature (439)..(439): n is a, c, g, or t
tcagcagtagacgtcacgaccggtgctcgatttagtcgagctctcccgcgagggaggcgatacgctgtcagtctctccgngagggaggcgatacgctgtcagtctctccgcgagggagcgagtacgctgtcagtctctcgngagggagcgagtacgctgtcagtctctcggcaggacgcgaagtacgctaggtccagtctctcgngaggcgcgaagtacggctaggtcagtctctcgatggcgacgtaagggncgtaagtccggntcgcncgtgcgcgacgcgacgcgagacgngttacgctacgcgtcncggntacgacngacgtccgngtcgtacgcgtgtcgacgtgcggacgtcgacgttcaggtaccgtcaacgtaacgtacggtacgacgacggtagtccggtaagcgtacgaagcgtactcggaacgtcggnggtacgtacgtacgtacggtacgacgacgtacgtaccgtaccgtaccgtacgtacgtacgtacgtacgtacgtaccgtacgtacggtacgtacgacgtacgacgtacgtacgacgtacgtagtacgtcgtcgtcg

SEQ ID NO: 225322 - DNA, 615 bp, Homo sapiens
  misc_feature: GYAE6OF01BHC3F.31.52.E08.1.454.CMB.1.raw
  modified_base (111)..(111): a, c, t, g, unknown or other
  misc_feature (111)..(111): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (510)..(510): a, c, t, g, unknown or other
  misc_feature (510)..(510): n is a, c, g, or t
tcagcagtagacgtcacgaccggtgctcgatttagtcgagctctcccgcgagagaggcgatacgctgtcagtctctccgcgagggaggcgatacgctgtcagtctctccgngaggacgcgatacgctgtcagtctctcgcgaggagcgatacggctgtacaggtctcgccgcgaggcggccgagtacgcgtgctacggtctcgtccgngtaggcgcgtagtacggcncgtcgacggtcttacgcgtcggaggtcgtacggtacgtacggcgtacgtacgtaagtcgtcgtacgcggtcgtaccggtcggtacggtaacggcggtcggtacgtaggtacgtcgtacgtacgtcgtacgtacgtacggtacgtacgcgtacgtacgcgtcgtacgtacgtacgtacgtcgtacggtacgtacgtgtagtacgcgacgtacgtcgtacgtacgtcgtcgtgtacgcgtggtcgctagacgacgcgtagtacgtcgtacgagtacgcgtaccgnggtaccgtcgagtacgtcgttcgtacggtacgtaccggttacgtacgtaccgtaaccgacgtcgtaccgtacgcgtacgtacgtacgagcgtacggtaggtacgg

SEQ ID NO: 225323 - DNA, 462 bp, Homo sapiens
  misc_feature: GYAE6OF01BLECJ.31.52.E08.1.454.CMB.1.raw
  modified_base (50)..(50): a, c, t, g, unknown or other
  misc_feature (50)..(50): n is a, c, g, or t
  modified_base (80)..(80): a, c, t, g, unknown or other
  misc_feature (80)..(80): n is a, c, g, or t
  modified_base (111)..(111): a, c, t, g, unknown or other
  misc_feature (111)..(111): n is a, c, g, or t
  modified_base (141)..(141): a, c, t, g, unknown or other
  misc_feature (141)..(141): n is a, c, g, or t
  modified_base (147)..(147): a, c, t, g, unknown or other
  misc_feature (147)..(147): n is a, c, g, or t
  modified_base (166)..(166): a, c, t, g, unknown or other
  misc_feature (166)..(166): n is a, c, g, or t
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
  modified_base (411)..(412): a, c, t, g, unknown or other
  misc_feature (411)..(412): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (438)..(440): a, c, t, g, unknown or other
  misc_feature (438)..(440): n is a, c, g, or t
  modified_base (442)..(446): a, c, t, g, unknown or other
  misc_feature (442)..(446): n is a, c, g, or t
  modified_base (448)..(449): a, c, t, g, unknown or other
  misc_feature (448)..(449): n is a, c, g, or t
  modified_base (451)..(451): a, c, t, g, unknown or other
  misc_feature (451)..(451): n is a, c, g, or t
  modified_base (454)..(458): a, c, t, g, unknown or other
  misc_feature (454)..(458): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
tcagcagtagacgtcacgaccggtgctcgattttagtcgagctctcccgngagagaggcgatacgctgtcagtctctcgngagggagcgatacgctgtcagtctctccggngagggaggcgatacgctgtcagtctctcgngagggngcgacgtacggctgtacgngtctctcggacgagggaggtgacacggngtctcgagtcgtcgtagcgaggacgngggtacagccgtagccgttgacgtgtaacgngacgnggcggagtaggcgtacgtgtacgtancgttcacgnggcgtgaacggnggcacggntacgngtgcngcgtgagcgagcagtgcncgntgngngcgngngacgcgcgngngngacgngancgngngagngagacgtcgtagtgagcgncgacgcgtnncgcgcgngngacgtgcgcgtgcgcgnnngnnnnngnnancgnnnnngngn

SEQ ID NO: 225324 - DNA, 559 bp, Homo sapiens
  misc_feature: GYAE6OF01BD7ZH.31.52.E08.1.454.CMB.1.raw
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
tcagcagtagacgtcacgaccggtgctcgatttagtcgagctctctcgcgagggaggcgatacgctgtcagtctctccgcgagggaggcgatacgctgtcagtctctccgcgagggagcgatacgctgtcagtctctccgcggaggaggcatacgctgtcagtctctcgcggagggngcgacacgtctgctgtcncgtacgcgagggacgcgagtcacgtgcagtctcgccgacgaggcggttgatacctgtagttcaacgccgttgaacgccggtaaacggcggaacctctttaaggaccttcgcncgtacgtcgacgngtcggtcggacgacgtcgtcgtcgtcgtacgtcgtcgtcgacgcgtcgcgtacgtcgtgtcgtacgtcgtcgtcgtaccgtacgacgtacgcgtacgtacgtacgtatagtacgtacgcgtcgtcgtactacggtcgacgacgtacgtcagactctacgtacgcgtacgtacgtagacgacgtccgacgtacgtcgcgtacgtacgcgacgtactacgtcaccgacgtactcgtcgtcg

SEQ ID NO: 225325 - DNA, 234 bp, Homo sapiens
  misc_feature: GYAE6OF01EST5R.31.52.E08.1.454.CMB.1.raw
  modified_base (80)..(80): a, c, t, g, unknown or other
  misc_feature (80)..(80): n is a, c, g, or t
  modified_base (144)..(144): a, c, t, g, unknown or other
  misc_feature (144)..(144): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (193)..(197): a, c, t, g, unknown or other
  misc_feature (193)..(197): n is a, c, g, or t
  modified_base (199)..(202): a, c, t, g, unknown or other
  misc_feature (199)..(202): n is a, c, g, or t
  modified_base (204)..(234): a, c, t, g, unknown or other
  misc_feature (204)..(234): n is a, c, g, or t
tcagcagtagacgtcacgaccggtgctcgatttagtcgagctctcccgcgagggaggcgatacgctgtcagtctctccgngagggagcgatacgctgtcagtctctccgcgagggaggcagtacgctagtcgagtctctacggngagggagcgagtacgctgtacagtctcnganggcgngagggncgatcgnnnnngnnnngnnnnnnnnnnnnnnnnnnnnnnnnnnnnnnn

SEQ ID NO: 225326 - DNA, 155 bp, Homo sapiens
  misc_feature: GYAE6OF02GGMKX.31.52.E08.1.454.CMB.1.raw
  modified_base (139)..(155): a, c, t, g, unknown or other
  misc_feature (139)..(155): n is a, c, g, or t
tcagcagtagacgtcacgaccggtgctcgatttagtcgagctctcccgcgagggaggcgatacgctgtcagtctcttggcgcgagggaggcgatacgctgtcagtctctcactgctgatggcgcgagggagcgatacgnnnnnnnnnnnnnnnnn

SEQ ID NO: 225327 - DNA, 146 bp, Homo sapiens
  misc_feature: GYAE6OF02I3GQ3.31.52.E08.1.454.CMB.1.raw
  modified_base (130)..(146): a, c, t, g, unknown or other
  misc_feature (130)..(146): n is a, c, g, or t
tcagcagtagacgtcacgaccggtgctcgatttagtcgagctctcccgcgagggaggcgatacgctgtcagtctctccgcgagggaggcgatacgctgtcagtctctcgatggcgcagggagcgatacgnnnnnnnnnnnnnnnnn

SEQ ID NO: 225328 - DNA, 173 bp, Homo sapiens
  misc_feature: GYAE6OF02INNN9.31.52.E08.1.454.CMB.1.raw
  modified_base (131)..(132): a, c, t, g, unknown or other
  misc_feature (131)..(132): n is a, c, g, or t
  modified_base (134)..(137): a, c, t, g, unknown or other
  misc_feature (134)..(137): n is a, c, g, or t
  modified_base (140)..(140): a, c, t, g, unknown or other
  misc_feature (140)..(140): n is a, c, g, or t
  modified_base (142)..(143): a, c, t, g, unknown or other
  misc_feature (142)..(143): n is a, c, g, or t
  modified_base (146)..(146): a, c, t, g, unknown or other
  misc_feature (146)..(146): n is a, c, g, or t
  modified_base (148)..(148): a, c, t, g, unknown or other
  misc_feature (148)..(148): n is a, c, g, or t
  modified_base (152)..(173): a, c, t, g, unknown or other
  misc_feature (152)..(173): n is a, c, g, or t
tcagcagtagacgtcacgaccggtgctcgatttagtcgagctctcccgcgagggaggcgatacgctgtcagtctctccgcgagggaggcgatacgctgtcagtctctcgatggcgcgagggagcgatacgnncnnnngangnnagngnatcnnnnnnnnnnnnnnnnnnnnnn

SEQ ID NO: 225329 - DNA, 159 bp, Homo sapiens
  misc_feature: GYAE6OF02GNVKB.31.52.E08.1.454.CMB.1.raw
  modified_base (135)..(159): a, c, t, g, unknown or other
  misc_feature (135)..(159): n is a, c, g, or t
tcagcagtagacgtcacgaccggtgctcgatttagtcgagctctcccgcgagagaggcgatacgctgtcagtctctcggcgcgagggaggcgatacgctgtcagtctctctgatggcgcgagggaggcgatacgnnnnnnnnnnnnnnnnnnnnnnnnn

SEQ ID NO: 225330 - DNA, 482 bp, Homo sapiens
  misc_feature: GYAE6OF02FYS0X.31.52.E08.1.454.CMB.1.raw
  modified_base (157)..(157): a, c, t, g, unknown or other
  misc_feature (157)..(157): n is a, c, g, or t
  modified_base (171)..(171): a, c, t, g, unknown or other
  misc_feature (171)..(171): n is a, c, g, or t
  modified_base (183)..(183): a, c, t, g, unknown or other
  misc_feature (183)..(183): n is a, c, g, or t
  modified_base (240)..(240): a, c, t, g, unknown or other
  misc_feature (240)..(240): n is a, c, g, or t
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
  modified_base (452)..(452): a, c, t, g, unknown or other
  misc_feature (452)..(452): n is a, c, g, or t
tcagcagtagacgtcacgaccggtgctcgatttagtcgagctctctcccgcgagggaggcgatacgctgtcagtctctcggatggcgcgagggaggcgatacgctgtcagtctctcgatgcgcgagggaggcgatacgctgtcagtctctccgatgngcgagggaggcggngtacgcgtgtcngtctctcgtgagtggcgcgagggtggacgagtacctgtcgtgtacttctcgactcgngtcgcgaggtgagacgtctcgtcgngtactagctcgagtcggngcgacgacgacgtgcgacgtatcgngctcgtgtgtgtcgcgngcgcgcgacgacgacgtcgcgtcgtcgcgtcgtcgtcgtcgcgtcgcgcgcgacgngcncgcgcgcgtcgtcgcgcgcgcgcgcgcgcgngcgacgacgacgacgctcgtcgcgcgcgcgtggtcgngcgtcgtcgtgcgtcgtgtcgtcgtgtgcg

SEQ ID NO: 225331 - DNA, 150 bp, Homo sapiens
  misc_feature: GYAE6OF02FY1ZK.31.52.E08.1.454.CMB.1.raw
  modified_base (136)..(150): a, c, t, g, unknown or other
  misc_feature (136)..(150): n is a, c, g, or t
tcagcagtagacgtcacgaccggtgctcgatttagtcgagctctcccgcgagagaggcgatacgctgtcagtctctcggcgcgagggaggcgatacgctgtcagtctctcctgatggcgcgagggaggcgatacgnnnnnnnnnnnnnnn

SEQ ID NO: 225332 - DNA, 174 bp, Homo sapiens
  misc_feature: GYAE6OF02IDTHE.31.52.E08.1.454.CMB.1.raw
  modified_base (130)..(137): a, c, t, g, unknown or other
  misc_feature (130)..(137): n is a, c, g, or t
  modified_base (139)..(174): a, c, t, g, unknown or other
  misc_feature (139)..(174): n is a, c, g, or t
tcagcagtagacgtcacgaccggtgctcgatttagtcgagctctcccgcgagggaggcgatacgctgtcagtctctccgcgagggagcgatacgctgtcagtctctcgatggcgcgagggagcgatacgnnnnnnnngnnnnnnnnnnnnnnnnnnnnnnnnnnnnnnnnnnnn

SEQ ID NO: 225333 - DNA, 177 bp, Homo sapiens
  misc_feature: GYAE6OF02GPS7T.31.52.E08.1.454.CMB.1.raw
  modified_base (165)..(177): a, c, t, g, unknown or other
  misc_feature (165)..(177): n is a, c, g, or t
tcagcagtagacgtcacgaccggtgctcgatttagtcgagctctcccgcgagagaggcgatacgctgtcagtctctccgcgagggaggcgatacgctgtcagtctctccgcgagggaggcgatacggctgtcagtctctcctgatggcgcgagggagcgatacgnnnnnnnnnnnnn

SEQ ID NO: 225334 - DNA, 175 bp, Homo sapiens
  misc_feature: GYAE6OF02IMBW9.31.52.E08.1.454.CMB.1.raw
  modified_base (162)..(175): a, c, t, g, unknown or other
  misc_feature (162)..(175): n is a, c, g, or t
tcagcagtagacgtcacgaccggtgctcgatttagtcgagctctcccgcgagggaggcgatacgctgtcagtctctccgcgagggaggcgatacgctgtcagtctctccgcgagggagcgatacgctgtcagtctctcgatggcgcgagggaggcgatacgnnnnnnnnnnnnnn

SEQ ID NO: 225335 - DNA, 175 bp, Homo sapiens
  misc_feature: GYAE6OF02FPRZK.31.52.E08.1.454.CMB.1.raw
  modified_base (130)..(130): a, c, t, g, unknown or other
  misc_feature (130)..(130): n is a, c, g, or t
  modified_base (136)..(136): a, c, t, g, unknown or other
  misc_feature (136)..(136): n is a, c, g, or t
  modified_base (138)..(138): a, c, t, g, unknown or other
  misc_feature (138)..(138): n is a, c, g, or t
  modified_base (141)..(142): a, c, t, g, unknown or other
  misc_feature (141)..(142): n is a, c, g, or t
  modified_base (144)..(144): a, c, t, g, unknown or other
  misc_feature (144)..(144): n is a, c, g, or t
  modified_base (146)..(146): a, c, t, g, unknown or other
  misc_feature (146)..(146): n is a, c, g, or t
  modified_base (148)..(148): a, c, t, g, unknown or other
  misc_feature (148)..(148): n is a, c, g, or t
  modified_base (150)..(150): a, c, t, g, unknown or other
  misc_feature (150)..(150): n is a, c, g, or t
  modified_base (152)..(175): a, c, t, g, unknown or other
  misc_feature (152)..(175): n is a, c, g, or t
tcagcagtagacgtcacgaccggtgctcgatttagtcgagctctcccgcgagggaggcgatacgctgtcagtctctccgcagggaggcgagtacggctgtcagtctctcggcgcgagggagcgatacggntgcatntncgnngngngngngnnnnnnnnnnnnnnnnnnnnnnnn

SEQ ID NO: 225336 - DNA, 413 bp, Homo sapiens
  misc_feature: GYAE6OF02JFGMO.31.52.E08.1.454.CMB.1.raw
  modified_base (118)..(118): a, c, t, g, unknown or other
  misc_feature (118)..(118): n is a, c, g, or t
  modified_base (134)..(134): a, c, t, g, unknown or other
  misc_feature (134)..(134): n is a, c, g, or t
  modified_base (140)..(140): a, c, t, g, unknown or other
  misc_feature (140)..(140): n is a, c, g, or t
  modified_base (146)..(146): a, c, t, g, unknown or other
  misc_feature (146)..(146): n is a, c, g, or t
  modified_base (155)..(155): a, c, t, g, unknown or other
  misc_feature (155)..(155): n is a, c, g, or t
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (403)..(413): a, c, t, g, unknown or other
  misc_feature (403)..(413): n is a, c, g, or t
tcagcagtagacgtcacgaccggtgctcgatttagtcgagctctcccgcgagagaggcgatacgctgtcagtctctcggcgcgagggagcgatacgctgtcagtctctcgcgcgaggngcgatcgctgcagtcnctcgcncgaggngcgatacgntcgcagtcntcgatggacgcgaggagcggattcggctggcattcgntcgaagcggcgaagcggagttgcgcgcgcgcgcgtcgcgcgngcgngngcgngngngcgcgncgcgtcgcgcgcgcgngcgcgcgcgcgcgcgcgcgcgcgcgcgngcgngcgcgcgngcgcgngcgcgtcgcgcgtgcgacgngcgngcgngtacgngcgtcgtcgcgtcgacgcgacgcgtcgtcgtagtcgtcgtacgnnnnnnnnnnn

SEQ ID NO: 225337 - DNA, 162 bp, Homo sapiens
  misc_feature: GYAE6OF02IG5DE.31.52.E08.1.454.CMB.1.raw
  modified_base (139)..(139): a, c, t, g, unknown or other
  misc_feature (139)..(139): n is a, c, g, or t
  modified_base (141)..(162): a, c, t, g, unknown or other
  misc_feature (141)..(162): n is a, c, g, or t
tcagcagtagacgtcacgaccggtgctcgatttagtcgagctctcccgcgagagaggcgatacgctgtcagtctctcgatggcgcgagggaggcgatacgctgtcagtctctcctgatggcgcggagggagcgatacgntnnnnnnnnnnnnnnnnnnnnnn

SEQ ID NO: 225338 - DNA, 372 bp, Homo sapiens
  misc_feature: GYAE6OF02HRNQS.31.52.E08.1.454.CMB.1.raw
  modified_base (84)..(84): a, c, t, g, unknown or other
  misc_feature (84)..(84): n is a, c, g, or t
  modified_base (101)..(101): a, c, t, g, unknown or other
  misc_feature (101)..(101): n is a, c, g, or t
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
tcagcagtagacgtcacgaccggtgctcgatttagtcgagctctcccgcgagagaggcgatacgctgtcagtctctcgatggcncgagggaggcgatacgntgtcagtctctgatggcgcgaagggagcgatagctgtgactntctacgngtgcggacgagggaaggcgactaacgtcgcgtgtgtacgtctcgtacgtacgtcggcggacggaggacggacgtacgtacgtcgcgagtacgtctcgtcgtgcgcgacgaggagacgagacncgcgtgtagtacngtcgtagtacgngngagaggacgtanacgacgcacgtagtacgtagtcgcgacgacgacgacgacgagtacgacgagacgagtgngt

SEQ ID NO: 225339 - DNA, 527 bp, Homo sapiens
  misc_feature: GYAE6OF02FKOSY.31.52.E08.1.454.CMB.1.raw
  modified_base (113)..(113): a, c, t, g, unknown or other
  misc_feature (113)..(113): n is a, c, g, or t
  modified_base (137)..(137): a, c, t, g, unknown or other
  misc_feature (137)..(137): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
tcagcagtagacgtcacgaccggtgctcgatttagtcgagctctcccgcgagagaggcgatacgctgtcagtctctcggcgcgagggagcgatacgctgtcagtctctcggcncgaggagcgatacgctgcagtctntcgcgcgaggagcggagtacggctggacagtctactcgatcggacgtcggacggtagcggaatcggctgtcngtcgatcgcgngcgagcgagtcgagcgcngcgtacgcgcngtgcgngcgngacgcgacgtagcgngtcgcgtcgcgcgngngcgcgngcgtacgntcgtcgtcgtcgtgtcgcgcgcgngtacgacgtagtacgcgtcgtacgcgcgtcgcgtacgtcgtgtcgtcgtcgtcgtacgtcgcgtcgtcgtacgtacgtcgtacgtacgtacgtacgtacgacgtacgtacgtacgtacgtcgtacgtacgacgtacgacgtcgacgacgtacgtacgtagtacgacgtacgtacgtcgtacgtacgtcgtcgtcgtacg

SEQ ID NO: 225340 - DNA, 218 bp, Homo sapiens
  misc_feature: GYAE6OF02H9Q9K.31.52.E08.1.454.CMB.1.raw
  modified_base (117)..(117): a, c, t, g, unknown or other
  misc_feature (117)..(117): n is a, c, g, or t
  modified_base (140)..(140): a, c, t, g, unknown or other
  misc_feature (140)..(140): n is a, c, g, or t
  modified_base (145)..(145): a, c, t, g, unknown or other
  misc_feature (145)..(145): n is a, c, g, or t
  modified_base (153)..(153): a, c, t, g, unknown or other
  misc_feature (153)..(153): n is a, c, g, or t
  modified_base (158)..(158): a, c, t, g, unknown or other
  misc_feature (158)..(158): n is a, c, g, or t
  modified_base (181)..(181): a, c, t, g, unknown or other
  misc_feature (181)..(181): n is a, c, g, or t
  modified_base (190)..(193): a, c, t, g, unknown or other
  misc_feature (190)..(193): n is a, c, g, or t
  modified_base (195)..(218): a, c, t, g, unknown or other
  misc_feature (195)..(218): n is a, c, g, or t
tcagcagtagacgtcacgaccggtgctcgattttagtcgagctctcccgcgagagaggcgatacgctgtcagtctctcggcgcgagggagcgatacgctgtcagtctctcgcgaggngcatcggctgtcagtctctccgngaggngcgatcgntgtcntctctctagctggcgagagggcncgtatacgnnnntnnnnnnnnnnnnnnnnnnnnnnnn

SEQ ID NO: 225341 - DNA, 107 bp, Homo sapiens
  misc_feature: GYAE6OF02G3ZR4.31.52.E08.1.454.CMB.1.raw
  modified_base (107)..(107): a, c, t, g, unknown or other
  misc_feature (107)..(107): n is a, c, g, or t
tcagcagtagacgtcacgaccggtgctcgatttagtcgagctctcccgcgagggaggcgatacgctgtcagtctctcactgctgatggcgcgagggaggcgatacgn

SEQ ID NO: 225342 - DNA, 508 bp, Homo sapiens
  misc_feature: GYAE6OF02G6ZS5.31.52.E08.1.454.CMB.1.raw
  modified_base (143)..(143): a, c, t, g, unknown or other
  misc_feature (143)..(143): n is a, c, g, or t
  modified_base (173)..(173): a, c, t, g, unknown or other
  misc_feature (173)..(173): n is a, c, g, or t
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
  modified_base (413)..(413): a, c, t, g, unknown or other
  misc_feature (413)..(413): n is a, c, g, or t
  modified_base (447)..(447): a, c, t, g, unknown or other
  misc_feature (447)..(447): n is a, c, g, or t
tcagcagtagacgtcacgaccggtgctcgatttagtcgagctctcccgcgagagaggcgatacgctgtcagtctctccgcgagggagcgatacgctgtcagtctctccgcgaggaggcgatacgctgtcagtctctccgacgnggaggcgagtacgctgtcagtctctcgcgnggacggngacgtacgcgtcgtacngtctctcgcgacgaggcgtcgacgtcgagctcgtncgctgcgngacggcgagtgcncgtacgtcagtcctnccggngcggagngcgacgtcgtcgtacngtcgtcgcgtacgcgcgngcgacgcgcgcgtcgtcgtcgtcgcgtcgngcgcgcgtcgacgcgcgtacgtacgtcgtcgtcgcgtcgtcgtcgcgtcgacgtcgtcgacgtacgacncgcgtcgtcgagcgacgcgtcgtcgtcgcgtcgngtcgcgtacgtcgtcgcgcgtacgtacgtacgtcgcgtcgtacgtacgtacgtgcgtgacg

SEQ ID NO: 225343 - DNA, 266 bp, Homo sapiens
  misc_feature: GYAE6OF02GHXFA.31.52.E08.1.454.CMB.1.raw
  modified_base (148)..(148): a, c, t, g, unknown or other
  misc_feature (148)..(148): n is a, c, g, or t
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (206)..(207): a, c, t, g, unknown or other
  misc_feature (206)..(207): n is a, c, g, or t
  modified_base (210)..(213): a, c, t, g, unknown or other
  misc_feature (210)..(213): n is a, c, g, or t
  modified_base (219)..(220): a, c, t, g, unknown or other
  misc_feature (219)..(220): n is a, c, g, or t
  modified_base (223)..(266): a, c, t, g, unknown or other
  misc_feature (223)..(266): n is a, c, g, or t
tcagcagtagacgtcacgaccggtgctcgatttagtcgagctctcccgcgagggaggcgatacgctgtcagtctctcgatggcgcgagggaggcgatacgctgtcagtctctccgcgagggaggcgatacggctgtcagtctctccgngagggaggcgatacgctgtacaggtctctaccgtgatggccgngagggngtcgatcgnngcnnnnagtgannagnnnnnnnnnnnnnnnnnnnnnnnnnnnnnnnnnnnnnnnnnnnn

SEQ ID NO: 225344 - DNA, 470 bp, Homo sapiens
  misc_feature: GYAE6OF02IRPVO.31.52.E08.1.454.CMB.1.raw
  modified_base (141)..(141): a, c, t, g, unknown or other
  misc_feature (141)..(141): n is a, c, g, or t
  modified_base (147)..(147): a, c, t, g, unknown or other
  misc_feature (147)..(147): n is a, c, g, or t
  modified_base (171)..(171): a, c, t, g, unknown or other
  misc_feature (171)..(171): n is a, c, g, or t
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (317)..(318): a, c, t, g, unknown or other
  misc_feature (317)..(318): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (466)..(466): a, c, t, g, unknown or other
  misc_feature (466)..(466): n is a, c, g, or t
tcagcagtagacgtcacgaccggtgctcgatttagtcgagctctcccgcgagggaggcgatacgctgtcagtctctccgcgagggaggcgatacgctgtcagtctctccgcgagggagcgatacgctgtcagtctctccgngagggngcgatacgctgtcagtctctccgngagggagcgatcgctgtcagtcnctcggacgnggaggcgacacgctgtccagtctcgacgcgaggtaggccgtagacncgtntcgngtctcgngcgaggacggnggactagacgtcngacncgtncgngaacgngngngngcgcgnngcgcgcgngngngngngcgcgngngcnctcgcngcgacgngcgngngcgcgcgcgngcncgcgacgcgcgcgacgcgacgcgcgtactgtcgacgacgcgagacgngcgagcncgtcgcgacgacgcgcgacgcgacgtacgacgagngtcg

SEQ ID NO: 225345 - DNA, 283 bp, Homo sapiens
  misc_feature: GYAE6OF02INFDE.31.52.E08.1.454.CMB.1.raw
  modified_base (148)..(148): a, c, t, g, unknown or other
  misc_feature (148)..(148): n is a, c, g, or t
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (245)..(283): a, c, t, g, unknown or other
  misc_feature (245)..(283): n is a, c, g, or t
tcagcagtagacgtcacgaccggtgctcgatttagtcgagctctcccgcgagggaggcgatacgctgtcagtctctccgcgagggaggcgatacgctgtcagtctctccgcgaggggaggcgatacgctgtcagtctctcgcgagggngcgatacggctgtcagtctctacgcgagggngcagtacggctagtcngtctctcgatggcgcgagggcgcaagtccgtngtcagnatgngnagnagnnnnnnnnnnnnnnnnnnnnnnnnnnnnnnnnnnnnnnn

SEQ ID NO: 225346 - DNA, 150 bp, Homo sapiens
  misc_feature: GYAE6OF02FUDEL.31.52.E08.1.454.CMB.1.raw
  modified_base (131)..(150): a, c, t, g, unknown or other
  misc_feature (131)..(150): n is a, c, g, or t
tcagcagtagacgtcacgaccggtgctcgatttagtcgagctctcccgcgagagaggcgatacgctgtcagtctctccgcgagggaggcgatacgctgtcagtctctcgatggcgcgagggaggcatacgnnnnnnnnnnnnnnnnnnnn

SEQ ID NO: 225347 - DNA, 646 bp, Homo sapiens
  misc_feature: GYAE6OF02HR15U.31.52.E08.1.454.CMB.1.raw
  modified_base (140)..(140): a, c, t, g, unknown or other
  misc_feature (140)..(140): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
tcagcagtagacgtcacgaccggtgctcgatttagtcgagctctcccgcgagggaggcgatacgctgtcagtctctccgcgagggaggcgatacgctgtcagtctctcgatggcgcgagggacggcgacgtacgcgtctntagcgtctccgtagagtcggacggaggagggcgacgtagtaccgngtncgtatcgtacgcgngacggcgacgggagcgtacaagtatcggtacngtacgtactcgtagtacgcggacgtacggaggacggtanaactgtacgtactcgtacgactacgacgtagtacgagacgacgacgacgtacgacgacgtacgtacgtagtatacgtagtacgagacgacgacgacgtacgtacgtacgtacgtacgtacgacgacgtacgacgacggtacgtagtaagtacggtacggtacgtaacgacgtacgtacgtaccgtacgtacgtaggaacgtaagtaagaagtaagacgtaacgaaccgtactagtactctacggtaacgtacggtacgtaacggtacgaacgtaccgtaacgtaacgacgtacgtaagtacgactacgtacgtaacgtacggacggtacgtacgtacgtacgacggtagtaggttaacgtacgtacgtaaccg

SEQ ID NO: 225348 - DNA, 554 bp, Homo sapiens
  misc_feature: GYAE6OF02G5YYV.31.52.E08.1.454.CMB.1.raw
  modified_base (110)..(110): a, c, t, g, unknown or other
  misc_feature (110)..(110): n is a, c, g, or t
  modified_base (140)..(140): a, c, t, g, unknown or other
  misc_feature (140)..(140): n is a, c, g, or t
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
tcagcagtagacgtcacgaccggtgctcgatttagtcgagctctcccgcgagagaggcgatacgctgtcagtctctccgcgagggagcgatacgctgtcagtctctccgngagggagcgatacgctgtcatcgtctccgngaggacgcgatacgctgtnacgttctacgtcgcgnggagcgagtacgctagtacgagtctcgtcgcgagggcgacgagtaggccgtntacagtcnctcggacgtggcgagacgagtccgtgaactcgcgtcgcgtacgacggtgaacgcgacgtaccgntaacgngtacgtcgtacgngacgtggaccngngtagacgtgactcgagtnccggtaangtacgtacggacgtcgacgtacgacgtctaggtccaggtancgngcgtacgtacgtgtacgtacgtcgtacgtacgtacgtcgcgcgtacgacgacgtacgagcgcgtacgacgacgtacgtcgtcgngtcgtcgngagtacgtaacgtacgtacggacgtacgtagtagtacgtacgtcgtacgacgttacgtacg

SEQ ID NO: 225349 - DNA, 457 bp, Homo sapiens
  misc_feature: GYAE6OF02F9LB7.31.52.E08.1.454.CMB.1.raw
  modified_base (114)..(114): a, c, t, g, unknown or other
  misc_feature (114)..(114): n is a, c, g, or t
  modified_base (291)..(291): a, c, t, g, unknown or other
  misc_feature (291)..(291): n is a, c, g, or t
  modified_base (375)..(376): a, c, t, g, unknown or other
  misc_feature (375)..(376): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (397)..(399): a, c, t, g, unknown or other
  misc_feature (397)..(399): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (412)..(413): a, c, t, g, unknown or other
  misc_feature (412)..(413): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (423)..(425): a, c, t, g, unknown or other
  misc_feature (423)..(425): n is a, c, g, or t
  modified_base (427)..(428): a, c, t, g, unknown or other
  misc_feature (427)..(428): n is a, c, g, or t
  modified_base (430)..(431): a, c, t, g, unknown or other
  misc_feature (430)..(431): n is a, c, g, or t
  modified_base (433)..(436): a, c, t, g, unknown or other
  misc_feature (433)..(436): n is a, c, g, or t
  modified_base (438)..(439): a, c, t, g, unknown or other
  misc_feature (438)..(439): n is a, c, g, or t
  modified_base (441)..(457): a, c, t, g, unknown or other
  misc_feature (441)..(457): n is a, c, g, or t
tcagcagtagacgtcacgaccggtgctcgattttagtcgagctctcccgcggagggaggcgatacgctgtcagtctctccgcggagggaggcgatacgctgtcagtctctccgngagggaggcgatacgctgcagtctcgtcgcggaggggaggtcggtatacgctgtactagtccgtctacggcggacgggaggcgtagtaccgcttgtctaacggtccttccggtcgggcgagggaaggcctaacgtccgcgtcgtatacgtccagtcggacggtgagcggactgacgntcgtatccgtgagcctgccagcttgccgtgagctgcgttagccgaagttgcgtagctatcgatcatcgactgcgaattcaaagnngtnacgntgancgttntcaannngacnagncgnacnncgcngnctcnnngnngnngnnnngnngnnnnnnnnnnnnnnnnn

SEQ ID NO: 225350 - DNA, 383 bp, Homo sapiens
  misc_feature: GYAE6OF01CUPMK.15.41.D08.1.454.CMB.1.raw
  modified_base (376)..(383): a, c, t, g, unknown or other
  misc_feature (376)..(383): n is a, c, g, or t
tcagtctacgtagccacgaccggtgctcgatttagtcacgcgagaaagggaaagggccgatttaccgtctccagagacaacaccaagaactcactctttctccacatgaacagcctgagagccgacgacacggctgtttattactgtgcgagagacaacgaggttcttagtcttgagacggctacagtttttgactactttgactactggggccagggaactctggtctccgtctcctcagcctccaccaaggcccatcggtctccccctggccacctcctccaagacgcacctctgggggcacagcggccctgggctgcctggtcaaggactacttccgctacgtagacctgagcgggctggcaaggcgcatagnnnnnnnn

SEQ ID NO: 225351 - DNA, 399 bp, Homo sapiens
  misc_feature: GYAE6OF01CBZQM.15.41.D08.1.454.CMB.1.raw
  modified_base (388)..(399): a, c, t, g, unknown or other
  misc_feature (388)..(399): n is a, c, g, or t
tcagtctacgtagccacgaccggtgctcgatttagtcacgcgagaaagggaaagggccgatttaccgtctccagagacaacaccaagaactcactctttctccacatgaacagcctgagagccgacgacacggctgtttattactgtgcgagagacaacgaggttcttagtcttgagacggctactagtttttgacttactttgactactgggccagggactctggtcctccgtctcctcagcctccaccaacggcccatcggtccttccccctggccaccctccctccaagagccacctcgtcgggggcacagccggccccgtgggctcgcctggtcaaggacctcttccgctacgtagactgagcgggctggcgaaggcgcatagnnnnnnnnnnnn

SEQ ID NO: 225352 - DNA, 543 bp, Homo sapiens
  misc_feature: GYAE6OF01C56JV.15.41.D08.1.454.CMB.1.raw
  modified_base (487)..(487): a, c, t, g, unknown or other
  misc_feature (487)..(487): n is a, c, g, or t
  modified_base (493)..(543): a, c, t, g, unknown or other
  misc_feature (493)..(543): n is a, c, g, or t
tcagtctacgtagccacgaccggtgctcgatttagtcacgcgagaaagggaaagggccgatttaccgtctccagagacaacaccaagaactcactctttctccacatgaacagcctgagagccgacgacacggctgtttattactgtgcgagagacaacgaggttcttagtcttgagacggctactagtttttgacttactttgactacgtggggccagggactcgtggtcctccgtctcctcacgccctccgaccaacgggccccagtccggtccttcccccgtggcccacccctccctccgaagcgccacccgtcggtcgggggaccacgacggcccgggcccgtcggggtctccggccgttagggtacccgaaaggtacccgtttaccccgttacccggtaccttaaccgggtaactacccggtagggtaaccgggccgggggtacgtacgggaccggaacgggttaccgaccgtaaagtcggntagctnnnnnnnnnnnnnnnnnnnnnnnnnnnnnnnnnnnnnnnnnnnnnnnnnnn

SEQ ID NO: 225353 - DNA, 448 bp, Homo sapiens
  misc_feature: GYAE6OF01ED6A2.15.41.D08.1.454.CMB.1.raw
  modified_base (424)..(448): a, c, t, g, unknown or other
  misc_feature (424)..(448): n is a, c, g, or t
tcagtctacgtagccacgaccggtgctcgatttagtcacgcgagaaagggaaagggccgatttaccgtctccagagacaacaccaagaactcactctttctccacatgaacagcctgagagccgacgacacggctgtttattactgtgcgagagacaacgaggttcttagtcttgagacggctactagtttttgacttactttgactacgtggggccagggaactcgtggtctccgtctcctcacgccctccaccaacgggccccatccggtccttccccctggccacccctcctaccgaacgacgccaccgtcggtcggggccacgcggccggccgtggctcgccgtggtacgaacggtacctccgtccgtcgtacgtacgacgtggcggccgggtcgtcgggacgaacggccgacgagtagnnnnnnnnnnnnnnnnnnnnnnnnn

SEQ ID NO: 225354 - DNA, 377 bp, Homo sapiens
  misc_feature: GYAE6OF02G1F7M.15.41.D08.1.454.CMB.1.raw
  modified_base (373)..(377): a, c, t, g, unknown or other
  misc_feature (373)..(377): n is a, c, g, or t
tcagtctacgtagccacgaccggtgctcgatttagtcacgcgagaaagggaagggccgatttaccgtctccagagacaacaccaagaactcactctttctccacatgaacagcctgagagccgacgacacggctgtttattactgtgcgagagacaacgaggttcttagtcttgagacggctacagtttttgactactttgactactggggccagggaactctggtctccgtctcctcagcctccaccaagggcccatcggtcttccccctggcaccctcctccaagagcacctctgggggcacagcggccctggctgcctggtcaaggctacttccgctacgtagactgagcgggctggcaaggcgcatagnnnnn

SEQ ID NO: 225355 - DNA, 379 bp, Homo sapiens
  misc_feature: GYAE6OF02FSRTD.15.41.D08.1.454.CMB.1.raw
  modified_base (375)..(379): a, c, t, g, unknown or other
  misc_feature (375)..(379): n is a, c, g, or t
tcagtctacgtagccacgaccggtgctcgatttagtcacgcgagaaagggaaagggccgatttaccgtctccagagacaacaccaagaactcactctttctccacatgaacagcctgagagccgacgacacggctgtttattactgtgcgagagacaacgaggttcttagtcttgagacggctacagttttgactactttgactactggggccagggaactctggtctccgtctcctcagcctccaccaagggcccatcggtcttccccctggcaccctcctccaagagcacctctgggggcacagcggccctgggctgcctggtcaaggactacttccgctacgtagactgagcgggctggcaaggcgcatagnnnnn

SEQ ID NO: 225356 - DNA, 390 bp, Homo sapiens
  misc_feature: GYAE6OF02H61DN.15.41.D08.1.454.CMB.1.raw
  modified_base (383)..(390): a, c, t, g, unknown or other
  misc_feature (383)..(390): n is a, c, g, or t
tcagtctacgtagccacgaccggtgctcgatttagtcacgcgagaaagggaaagggccgatttaccgtctccagagacaacaccaagaactcactctttctccacatgaacagcctgagagccgacgacacggctgtttattactgtgcgagagacaacgaggttcttagtcttgagacggctacagtttttgactactttgactacgtggggccagggaactctggtctccgtctcctcagcctccaccaacgggcccatcggtccttcccctggcaccctcctccaagagccacctcgtgggggcacagcggcccgtgggctcggcctggtcaaggactacttccgctacgtagactgagcgggctggcaaggcgcatagnnnnnnnn

SEQ ID NO: 225357 - DNA, 381 bp, Homo sapiens
  misc_feature: GYAE6OF02FTVNX.15.41.D08.1.454.CMB.1.raw
  modified_base (376)..(381): a, c, t, g, unknown or other
  misc_feature (376)..(381): n is a, c, g, or t
tcagtctacgtagccacgaccggtgctcgatttagtcacgcgagaaagggaaagggccgatttaccgtctccagagacaacaccaagaactcactctttctccacatgaacagcctgagagccgacgacacggctgtttattactgtgcgagagacaacgaggttcttagtcttgagacggctacagtttttgactactttgactactggggccagggaactctggtctccgtctcctcagcctccaccaagggcccatcggtcttccccctggcaccctcctccaagagcacctctgggggcacagcggccctgggctgcctggtcaaggactacttccgctacgtagactgagcgggctggcaaggcgcatagnnnnnn

SEQ ID NO: 225358 - DNA, 702 bp, Homo sapiens
  misc_feature: GYAE6OF01DRRON.37.19.B08.1.454.CMB.1.raw
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
tcagtagtgtagatcacgaccggtgctcgatttagtgagtcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtaataacacaggctatgcacagaagttccgaggcagagtcaccttgaccaggaaccacctaccataaccacacgcctacatggagctgagcagccgtgagatcgtgaggacgacggccgtggtattcgtgtgacgagacgcatctanacgnagtggctaggtacagtccgtcgggtacccctacgttactaccgtactacgagtcggtacgtcgtacggggacgaaacgggaccgaccggtctaacccgtccgttcctcaccgttaccctacccgaaccgtaacccgggaccctaaccgttcccgggtcccctttcccccgtacgggtacccctaccccgttacccgtaccccgaacgacccgtaccctaccccgttagggttacccgggggacccgttaacccggaccgggtcccccgggttacccccggggtccggggtacccgtttcccgggtaccccggtttaaccggggtacccggttaaaacccggggtacccttttaaacccccgg

SEQ ID NO: 225359 - DNA, 806 bp, Homo sapiens
  misc_feature: GYAE6OF01ERSBG.37.19.B08.1.454.CMB.1.raw
tcagtagtgtagatcacgaccggtgctcgatttagtgagtcagtaaagggaaagggggaggaactgctcagttaggacccagagggaaccatggaagccccagctcagcttctcttcctcctgctactctggctcccagataccaccgcaagaaattgtgttgacacagtctccagccaccctgtctttgtcctcgaggggagagagcccaccctctcctgcagggccagtcaagtaatgtagcagtctacttagcctaggtaaccaacagacgaccgtcggcccgaccggcccccaggcctcctacacttcgtatcgccttcgtcctttcccgtcggacgggtccctaccgtcggacctaccgtaccccacggtccccgtagggttccacgggtcggacgtaggtcggggtcgtaggaacggaacgtacggttacctttaccgtaccttcctaccgtaaaccctacttaccgaacgacccgttacggtaaccttaagggtaccgtacccgttaaggtaaacggtttagttttttaccggaaccttttaacgtttttaacttacgttttaccgttaccggttaaccctaaaccggtaccggttacccgttaacccgtaaccgttacccgggttaccggggtttaccggtaacccccggtttaccggggaaacccggtaaacggggtaacccggtaaggggtttaccggtaaccttttaacccggtaacggtaacgtttcgggtcggtaccgtggtaccctaacccgttacttccgttacggtttaccttccgtaccgtttcccccg

SEQ ID NO: 225360 - DNA, 1042 bp, Homo sapiens
  misc_feature: GYAE6OF01DPH53.37.19.B08.1.454.CMB.1.raw
  modified_base (193)..(193): a, c, t, g, unknown or other
  misc_feature (193)..(193): n is a, c, g, or t
tcagtagtgtagatcacgaccggtgctcgatttagtgagtcagtaaggggctgaggtgaagaagcctggggcctcagtgaaggtctcctgcaaggcttctggatacaccttcaccaattatgatatcaacgtgggtgcgacaggccactggacaagggcttggagtggagtgggatggatacgaaaccctaanaagtaaactaacacaggctatgacacaagtaacgtccgagggacagacgtcaccgttcgaccgaaggaaccacctccaactaaccacacgcctacagtcggagctagacgctacgcccgtaggacgtacgtcgtagggacggaccggtaacccgggtaccgttaggttaacttttaaccgttggtacgggaccggtaaaggacgggtacctaagtttacccgttaaagtaacgggacgtaacgggttcgggtaccgttacgggtaaccgttacggttccccggggttaccggggttaaccccccccttaaaccggtttaaacccgttaacccgtttaaaccgttaacccgttaaacggggtacccggggttaaaccgggttacggggttaaacccggggggggtaaaacccggttaaaaacccgggggaaccccggttaaacccggggtttacccccgttaacccccgggtttacccgtttaccccccggttaacccgtaacccccgtttacccccgtaaacccccggaaacccccggttaaccccggggtaaccccgtttaaccccgggtttaacccccgggtttccccccgttttaccccccccgggttaacgggtcccccccttaacccccgttacccccgttaacccggtaaaccggtaccccgtaccccggtacccgttaccccgggggtaaccggggaaccccgtaaacccggggtacccgggtccccccggggtaacccccgggttcccggggttacccggtttaccccgggtaaccccgggtttaaccgggggttttaaaccccggaaacccgggtttaccccgttttaaaaaccccccgg

SEQ ID NO: 225361 - DNA, 546 bp, Homo sapiens
  misc_feature: GYAE6OF02GSBWY.37.19.B08.1.454.CMB.1.raw
tcagtagtgtagatcacgaccggtgctcgatttagtgagtcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtaataacacaggctatgcacagaagttccagggcagagtcaccttgaccaggaacacctccataaccacagcctacatggagctgagcagcctgagatctgaggacacggccgtgtattactgtgcgagaggcatctatagcagtggctggtacatctggggtccccactactactactacatggacgtcgtggggcaaagggaccacggtcaccgtctcctcactcctccaccacgggcccagtccgtaccttccccgtggccacccctcctaccaacgacgccacccgttcgtcgggggcaccgacgcccggcccgtgggtcctcggccttcgggtcgaacggtaccttaacccg

SEQ ID NO: 225362 - DNA, 553 bp, Homo sapiens
  misc_feature: GYAE6OF02H5COX.37.19.B08.1.454.CMB.1.raw
tcagtagtgtagatcacgaccggtgctcgatttagtgagtcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtaataacacaggctatgcacagaagttccagggcagagtcaccttgaccaggaacacctcataaccacagcctacatggagctgagcagcctgagatctgaggacacggccgtgtattactgtgcgagaggcatctatagcagtggctggtacatctggggtcccccactactactactacatggacgtctggggcaaagggaccacggtcaccgtctcctcactccctccaccaacgggcccactccgtccttccccctggcctaccctccctccaacgacgccaccgtccgtcgggggccaccgacggccggtccccgtcggggcctcggcccgttgggtaccgaacgggtacttaaccccg

SEQ ID NO: 225363 - DNA, 561 bp, Homo sapiens
  misc_feature: GYAE6OF02FMTI8.37.19.B08.1.454.CMB.1.raw
  modified_base (346)..(346): a, c, t, g, unknown or other
  misc_feature (346)..(346): n is a, c, g, or t
tcagtagtgtagatcacgaccggtgctcgatttagtgagtcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtaataacacaggctatgcacagaagttccagggcagagtcaccttgaccaggaaccacctccataaccacagcctacatggagctgagcagcctgagatctgaggacacggccgtgtattacgtgtgcgaggaggcatctatagcagtggctggtanagtctcggggtccccactactactactacatcggacgtcgtgggacaaagggaccacgggtccaccgtcctccgtcactccctccaccgaacggccctagtcccggtccctttccccgcggtacccacccctcctaccgaacgcgacctacccgtcgtcggggccaccgacggcccggcccgtgggctcgcccgttggacgtacggcttaacccg

SEQ ID NO: 225364 - DNA, 617 bp, Homo sapiens
  misc_feature: GYAE6OF02GICMZ.37.19.B08.1.454.CMB.1.raw
  modified_base (272)..(272): a, c, t, g, unknown or other
  misc_feature (272)..(272): n is a, c, g, or t
  modified_base (347)..(347): a, c, t, g, unknown or other
  misc_feature (347)..(347): n is a, c, g, or t
tcagtagtgtagatcacgaccggtgctcgatttagtgagtcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtaataacacaggctatgcacagaagttccagggcagagtcaccttgaccaggaacacctccataaccacacgcctacatgganctgagcagcctgagatctgacggacacggccgtgtattactgtgcgagaggcatctatagcagtggcgtggtacntcgtcgggtccccactactactactacagtcggctcgtgggacgaaagggacccgtacggtacctaccggtcttcctctactccctcccaccggtaacggcccacgttccggtacccgttcccccgtcggacccctaccccttcccgtacccgaaacgaccgaccctaccgttccgggtaccgggggtaccaccggtaaccggcccgggtccccgtcggggcccttccgggtaccccggtaggtacccgaaccggttaccgttaaccccg

SEQ ID NO: 225365 - DNA, 737 bp, Homo sapiens
  misc_feature: GYAE6OF02HVVT5.37.19.B08.1.454.CMB.1.raw
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
tcagtagtgtagatcacgaccggtgctcgatttagtgagtcagtaaggggctgaggtgaagaagcctggggcctcagtgaaggtctcctgcaaggcttctggatacacctttcacctaatttatgatatcaagtgggtgcgacaggccactggacaagggtcttggagtggattgggatggatcgaaccctaacagtaaataacacgaggctagtcgacacgagtaacgttccgagggcagcgtacctaccttgaccaaggtaaccaccgtcaactaaccaaccacgaccctaacacgtcggacgtcctaggacncgacgcctagagtacttcgtacggaggtaccgaacggtccgttgttacttacgtgnggtacgtacggaggtctaattacgtagttacgcgtaggtcgtacgttaggactacgtccgtccgggtaccctataacctcctaacgtactagtcggtacgttcggtacgggtacgtaaacgggaccacggttacccgccgttccgtacctcctacgttccctaaccgacccgaccggtccttaccggttcccggtaccccgtttaccccgacggttaccctaccccttcccgtaaaccggaccgtaacgacccgttaccggtccggtaccgggaaccctaccggtaccggtcccgggttaccccggtcggtacccgttaccggtccggttaccgggtaccgttaaccgggtacctttaacccccgg

SEQ ID NO: 225366 - DNA, 927 bp, Homo sapiens
  misc_feature: GYAE6OF01CEUI4.42.28.C06.1.454.CMB.1.raw
  modified_base (116)..(116): a, c, t, g, unknown or other
  misc_feature (116)..(116): n is a, c, g, or t
tcagtgacgtatgtcacgaccggtgctcgatttagagctcacgtattgggtttggggagcagagctctggggagtctgcaccatggcctggaccccactcctccctcctcttcccnctcctcctccactgcacagggtctctctcccagcctgtgctgactcaactcatcctctcgcctctgccttccgtgggactcctcggtcacctcacctcgcactctgacgcagtcggtcacgagtcgtctacatcactcgcagtcggcactcagcagcagccgaggacgccgtgtctgacgtcgaacgtgaacgtaagtacgggaacctacgaacggaacggggtacgacggtaacgtcccgtaggtacgtcggtacgttcgacgtacggtacctaccgacggtccgtccggtcgggggtacctaccgggtacccgtccgttaaccccgtcgtaaacccgtaccgtttacccgaacccgttaaaaccccgtccggtaacccggttacccggttaacgggtaaccgggttaaaccgttcggggaaaccgggtttcccgtttaaacgggttaaacgtttttaacccggtttaaaccggggttaccggttttaacggggaaaccccgggtttaaacccggggtttaaacggggttaaaaccccgttaaaacgggggttttaaaaaaccggtttaacccgggggtttaaacggggggttttaaaccccggggtttttaaacccgggggggaaccggggggttaaaacccggggggttaaaccccgggtaaagggggtttaaccccggggttaaaccccggggttaaacccggtttaaaccggggggttacccccggttaaaacccggggtaaaccccccggggttaaaccccgggggttcccccccgggtacccccccgggttttaaacccggggg

SEQ ID NO: 225367 - DNA, 734 bp, Homo sapiens
  misc_feature: GYAE6OF01ANIG5.42.28.C06.1.454.CMB.1.raw
  modified_base (116)..(116): a, c, t, g, unknown or other
  misc_feature (116)..(116): n is a, c, g, or t
  modified_base (189)..(189): a, c, t, g, unknown or other
  misc_feature (189)..(189): n is a, c, g, or t
tcagtgacgtatgtcacgaccggtgctcgatttagagctcacgtattgggtttggggagcagagctctggggagtctgcaccatggcctggaccccactcctcctcctctttcccnctcctcctccactgcacagggtctctctccagcctgtgctgactcaatcactcctctcgcctctgccttcccngggactcctcggtcaccctcacctgccactctgacgctaggtcggtccacgtaggtcgtctaacacttcaactcgccagtcggcactcagccagcacggccgaaggggaacggccccgttacggttcttacggacgttacggtaaccggttacggaaccgtaaacgttaacgggggaaacccttaaccgaacggtaaacgggggacggaccgggtaacggttacccgtaggaacgttccggtaccgtttaccgtacgaacgggtcctacccgtaacggtcccgttaccgggtcggggtaccgtaccggtacccggtaccttacccggtaccacccgtaacgttcccgtacccgaaacccgttcccgacgttaccgtacggaacggtactcggacggtcttacggtaactttacgtacgttggtacgtacgtaccgtagggaactaagttaacgttacgagggttcggtacgggacggtacgggtacgtaacgggtcgaccggtacgtacggtaccgacgacccgacgggtcccgcccggtaccgg

SEQ ID NO: 225368 - DNA, 779 bp, Homo sapiens
  misc_feature: GYAE6OF01B46SR.42.28.C06.1.454.CMB.1.raw
  modified_base (122)..(122): a, c, t, g, unknown or other
  misc_feature (122)..(122): n is a, c, g, or t
  modified_base (143)..(143): a, c, t, g, unknown or other
  misc_feature (143)..(143): n is a, c, g, or t
  modified_base (191)..(191): a, c, t, g, unknown or other
  misc_feature (191)..(191): n is a, c, g, or t
  modified_base (241)..(241): a, c, t, g, unknown or other
  misc_feature (241)..(241): n is a, c, g, or t
  modified_base (358)..(358): a, c, t, g, unknown or other
  misc_feature (358)..(358): n is a, c, g, or t
  modified_base (544)..(544): a, c, t, g, unknown or other
  misc_feature (544)..(544): n is a, c, g, or t
  modified_base (564)..(564): a, c, t, g, unknown or other
  misc_feature (564)..(564): n is a, c, g, or t
  modified_base (573)..(573): a, c, t, g, unknown or other
  misc_feature (573)..(573): n is a, c, g, or t
  modified_base (610)..(610): a, c, t, g, unknown or other
  misc_feature (610)..(610): n is a, c, g, or t
tcagtgacgtatgtcacgaccggtgctcgatttagagctcacgtattgggtttgggggagcagacgctctgggggagtctgcaccagtggcctgggaccccactcctccctcctccttcccncgtcctcctccactgccacgngggtcctcctcgtccacgtcctgtcgctcgactcatccactcctctcncctctcgtccttccgtggctccgtcggtcacccgtcacctcgctactcgngacgtcgtacggtcggtactacgtacggtcgtactaacgttctacgtaactccggctaggttacgacaacgtaccgaagcgaacggccaacggccggaaggtaccgcccgttcggtntacgacgtacgtaacgttacgaacgtaacggtaccgggaaacctaccggaacggaacggggtacgtaaccggttacgacccggtagaacgttcgacgttacgacggacggacttccgaagttccgtacggtcgggactaccgaaccgtctaacccgacgttaccacttacccgtacccaaccgttnacggttcctaggaaccgttntacgggtcncgttaagtaacctttttaggaaccgtaggttaaaccncgggtaaccgttagggtaaaacccgttaaggttaaacggtccggggtaaggtttaccgggtacgggaccgggtaaacggtaaccggtaaaggtccggttaaccccgttacgggtaacgggaccccgaaaccgacccggttacccgggccccgtttcccggtaaacccgg

SEQ ID NO: 225369 - DNA, 841 bp, Homo sapiens
  misc_feature: GYAE6OF01COGA6.42.28.C06.1.454.CMB.1.raw
  modified_base (115)..(115): a, c, t, g, unknown or other
  misc_feature (115)..(115): n is a, c, g, or t
  modified_base (193)..(193): a, c, t, g, unknown or other
  misc_feature (193)..(193): n is a, c, g, or t
tcagtgacgtatgtcacgaccggtgctcgatttagagctcacgtattgggtttggggagcagagctctggggagtctgcaccatggcctggaccccactcctcctcctcttcccntcctcctcactgcacaggtctctctcccagcctgtcgctcgactcaatcactcctctcgtcctctcgtcctttcccgngggtactccgtccggtaccaccctcaccgttcgcctaccgttcgtcggacgtcctaggtcggtaccacgtaggtcgtacctacctatcctaacgtccggtactagttcggctaactacgacgaccaagccgacggaccggaacggggaaccggtccccgttacgggtttaccgtacggtacgttacggtaacggttacgaaacggtaaacggtaaccggggaacccttaaaccggaacgggaacggggacgtacggtaaccggtcccgtaggtaaccgttcgtaccgttccgacggacggtccgtaccgacggttcctcgggtacgggtcctacgggtaccccgtactaccgtaccgtaccgtaaccgttcccgtacccaaacccgttccgtaacggttccgtaccgggtaacggtacgttaccgggaacggtcctttaaacgtacgtttaacgtttacggtacggtttaacggtaccggttaccggttaacgggtaacttaagggttaaaccgttcgggttacggggttaaccggttcggggaaacgggtaaccgggtaacgttaaggggtcccggtaacccgttaaggtaccggtaccggaaccgggtaccccggaaacccgggtcccccggtacccggtaaccgg

SEQ ID NO: 225370 - DNA, 935 bp, Homo sapiens
  misc_feature: GYAE6OF01DZJE4.42.28.C06.1.454.CMB.1.raw
  modified_base (115)..(115): a, c, t, g, unknown or other
  misc_feature (115)..(115): n is a, c, g, or t
  modified_base (176)..(176): a, c, t, g, unknown or other
  misc_feature (176)..(176): n is a, c, g, or t
tcagtgacgtatgtcacgaccggtgctcgatttagagctcacgtattgggtttggggagcagagctctggggagtctgcaccatggcctggaccccactcctcctcctcttcccnctcctcctccactgcacaggtctctctccacgcctgtcgctgactcaactcactcctctcncctctcgtccttccgtgggtaccttccgtcggtcctaccctcctaccgtcgacctactcgtcgacgtccgtagtcggtccaacgtacgtcgtaccttacacgttacctacgtccggtacctaagttcggaccttaacgtccgaaacgtccaacggaccgaacggacccggtaacgggggaaacccgggtcccccgtttacggggtttaccgttacgggtaaccggttacgggttaaaccggtttacggtaaaccggtaaaccgggttaaaccgggggtaaacccgttaaaccggaaccggggtaaaaccgggggacggtaccgggtaaccggttacccggtaacggtaacccgttccggtaccgtttaccggtaccggtaacgggtcccgttacccgtaacgggtcccgttaccggggtcgggggttaccctaccggttaacccggtccccttaaccgtacccgtaaccgttacccttccccgaaaccccgttaaccgttccccggtaggttaccggtaaccgggtacggttaacgtaccgggtaacggttacgtttaaccggttaattttaaccgggttacgtacgggttaggtaacccggttacggttacgggaaacttttaacgggtaaaacgttccggtagggttacgggtaccgggtaacggggaaccgggttaacgtaggggtcccggttaacccggtaggtaacggtacccggaccgggtacccgaacccgggtcccgtcccggtaaccggg

SEQ ID NO: 225371 - DNA, 775 bp, Homo sapiens
  misc_feature: GYAE6OF01AO0P0.42.28.C06.1.454.CMB.1.raw
  modified_base (115)..(115): a, c, t, g, unknown or other
  misc_feature (115)..(115): n is a, c, g, or t
  modified_base (598)..(598): a, c, t, g, unknown or other
  misc_feature (598)..(598): n is a, c, g, or t
tcagtgacgtatgtcacgaccggtgctcgatttagagctcacgtattgggtttggggagcagagctctggggagtctgcaccatggcctggaccccactcctcctcctcttcccnctctcctcactgcacaggtctctctccacgcctgtcgcgtcgactcgaactccaactccgtctcgccttcgtcgtcctttcccgtgggtacttcccgtcgggtccacccgttccgacccgtcgtcctacctcgtcgtacgctacggtcggtcctacgtacgtcgtcctacacgtcaacgtccgtcgtacgtggacctacgtcgaagccgtacggaccgaacgccgaacggggaaccgtccccgtcgggttacgttagacgttacggtaaccgttacggaaccgtaaggtaaccggggtaaaccctaccggtaaacggaacggggacgtaaccgggtacgtacccgtaggtaaccgtccggtacgttccgtacgtacggcctaccgaacggtccgtcggtacgggtaccttcggacccgttcggtaccctcgtacccacttacccgtaccccgtaactccggaccgttacgtaacgacggtacnggtacggtcttacgtagttacgtacgtcggtacgtaccggtacgttacgggaacctacggttaaacgtcggtacgggttacggtaccggggacggtaaccgggtacgacgggttaccggtacccgttacggtaacggtaccgaaccgtcccgggaaccgtccccggtcgtaacccgg

SEQ ID NO: 225372 - DNA, 1199 bp, Homo sapiens
  misc_feature: GYAE6OF01D5N5Z.42.28.C06.1.454.CMB.1.raw
  modified_base (116)..(116): a, c, t, g, unknown or other
  misc_feature (116)..(116): n is a, c, g, or t
tcagtgacgtatgtcacgaccggtgctcgatttagagctcacgtattgggtttggggagcagagctctggggagtctgcaccatggcctggaccccactcctcctcctctttcccnctcctcctccactcgcacacggtcctctcctcccacgtccctgtcgccttcgactcaacttccacttccctctcgtcccttcttcgtccctttcccgtacgggtaccttccccgttccggttccctaccccgttcctacccgttcgtccctaccttcccgtacggaacgtccgtacggttccggtacctaacgtacggttcgttacctaacgtacttactaacgtccgtacgtaacgttcggacctaacgttaccgtaacgtcccgaacgaccgtaaccggacccgggtaaacgggggtaaccccgggtccccccgttttacggggtttaccgttacggtaaccgttaccgggttaaacccggtttaccgggtaaaaccgtaaaccgggttaaaccgggggtaaacccttaaaccccggaagggtaaaccggggaaccggtaaccggtaaccggttacccgtagggtaaccgttaccggttacccgttaccggtacccgaacgggttcccttacccgggaacggtttacccgttcccggggtttaacgggcccggttttacccgaaaccccgggttccccgtttaaaccccgtcccgtaaacccgtttaccccggtttaccctaacccccggtaaaccccgttttcccggtaaaccgggtttaccccgtaccggggtaaacgggtttacccggttaccggggttaaaccgttacccgtttaacggggttttaaacccgttttttaacttaaccccggggtttacgggttaaacccgggtttacccgggtttaaaaccccgggggtttaaacggttaaacccgggttttaaaagggtttttaaaaccgggttaaacccgggtttttaaagggggggggttaccccgggtttaaacccgggggggtaaaccgggggtttaacccgggttaaaaaaccgggggttttcccggggggttaaaaccccgttaaaccccccgggggtttttaacggggaaaacggggttttccccccggaaaaacccggtccccccggggggtttaaaacccccgggacccccccgggtttccccccggttttaaaccc

SEQ ID NO: 225373 - DNA, 784 bp, Homo sapiens
  misc_feature: GYAE6OF01C4VM2.42.28.C06.1.454.CMB.1.raw
  modified_base (116)..(116): a, c, t, g, unknown or other
  misc_feature (116)..(116): n is a, c, g, or t
tcagtgacgtatgtcacgaccggtgctcgatttagagctcacgtattgggtttggggagcagagctctggggagtctgcaccatgggcctggaccccactcctcctcctcttcccnctcctcctcactgcacgacggtctctctcccacgcctgtcgctcgacctcaactcgactcctctcgccttctcgtccttcccgtgggtacctccgtccggttaccaccctcctaccctcgtcctaccttctacggtacgtccgtaggtcgtcaacgtcgttacgtactacatccagtaccacgatcggacagtcgagccagccacggacgaacgggacctacccgtcggttactcggaacgttacggtaacgttcgaacgtaacggttaaccgggaacctaaccggaacggtaaggggtacgaccggtaacttaccggtacgtacgttaccggcttacgccggtaccgtcgtaccgacggttccgtaccgggtcggggcctaacccgggtaccctaccccgttaaccgtacccgtaaaccctacccgttaccccgtaacccgtaaacccgtccgttacgtacccgtaacggtacggtacgtaccgggtaacgtacttaacgggttaactttaacgttacggtacggtaccgttaacggaccggttaacggtaacttaggtaaccgttcggtacgggtcggtaccgggacggttaacgggacggttacgggccttaaccgtcggaacggtaccgaccggtaacccgaccgggtccccgtccgtaacggg

SEQ ID NO: 225374 - DNA, 772 bp, Homo sapiens
  misc_feature: GYAE6OF01EHL19.42.28.C06.1.454.CMB.1.raw
  modified_base (115)..(115): a, c, t, g, unknown or other
  misc_feature (115)..(115): n is a, c, g, or t
  modified_base (612)..(612): a, c, t, g, unknown or other
  misc_feature (612)..(612): n is a, c, g, or t
  modified_base (693)..(693): a, c, t, g, unknown or other
  misc_feature (693)..(693): n is a, c, g, or t
tcagtgacgtatgtcacgaccggtgctcgatttagagctcacgtattgggtttggggagcagagctctggggagtctgcaccatggcctggaccccactcctcctcctcttcccnctcctctccactgcacacggtctctctccacgcctcgtcgctcgactcaactcacttcctcgtcgccttctcgtcctttccgtgggtacctccgtcggtccaccctctaccgtcgcctactcgtacgacgtcgacgttcggtcacgtacggttcgtcctaactactccgtaacgtccgtactacgtacggtcaactccgaacgtcacggaccaacggtaccggaacgggggtaaccggtccccgttacggggtttccttaggaccggttacggtaacggttacgaaccgtaaggtaaccgggaaaccctaacggaacgaaacggggtacgaccggtaaccgtaccgtagaccgttcgtacgttaccgtaacggcgggtaccctaccgtacggtcccgttacgggtcgggtaccgttaccggtacccgttacccgtaccgtaccgtaacccgtcttaacccgtaacccgtaaccgtccgtacgttccgtagaccggtntaccggacgttccgtagtcttaagtccgtggtacgtacgttacgtaggtaactaagtaacgtgtacggtcggttaacgggnggtaaccggacgttaacgggtccgtaccgggttacgtaacggtccgaaccggaccgtaccggtcccggtacccgtacgg

SEQ ID NO: 225375 - DNA, 829 bp, Homo sapiens
  misc_feature: GYAE6OF01CLK67.42.28.C06.1.454.CMB.1.raw
  modified_base (115)..(115): a, c, t, g, unknown or other
  misc_feature (115)..(115): n is a, c, g, or t
tcagtgacgtatgtcacgaccggtgctcgatttagagctcacgtattgggtttggggagcagagctctggggagtctgcaccatggcctggaccccactcctcctcctcttcccnctcctcctccactcgcacacggtctcctctccacgcctgtcgctacgactcaactcactcctctcgcctctcgtccttccgtcggtcttccgtccggtaccctacccgtcctacccgttcgtccctaccgttcgttacggacgtccgtacggtcggtacctaaccgttcggttcgtacctaacctatccgtaactccggtacaacgttcggaacctacgtaccgaacgcgtaacggcaaccggaccggtaacgggggtaacccgtaccccgttcggggtttaaccttaacggtacgtttaacgggtaaaccggttacggtaaaaccggtaaaacgggttaacccggggtaaacccttaccgggaaaaacgggtaacgggtaccggtaccggtaaccgttaccggtacggtaaccgtcgttccgttacgaccggtacggtccctacggtacggtcgtcgggtacggccgtaccggccgtaccgtccgtaccgtaccgtaacgtccctaaccgaccgttaccgtacgtaccgtacggtacgtacgtacgacgtctacgttacgttaacgtacgtacgtacggtactacggtcgtaaacgttagtaacggtacgtacggttacggtacgggaacggtaccgggtaaggtaccggtcggtaacccgtacggtacgtaaccggaccgtaccgaaaccggtcccgtaacccggttcccgg

SEQ ID NO: 225376 - DNA, 838 bp, Homo sapiens
  misc_feature: GYAE6OF01AM44D.42.28.C06.1.454.CMB.1.raw
  modified_base (117)..(117): a, c, t, g, unknown or other
  misc_feature (117)..(117): n is a, c, g, or t
  modified_base (154)..(154): a, c, t, g, unknown or other
  misc_feature (154)..(154): n is a, c, g, or t
  modified_base (479)..(479): a, c, t, g, unknown or other
  misc_feature (479)..(479): n is a, c, g, or t
  modified_base (534)..(534): a, c, t, g, unknown or other
  misc_feature (534)..(534): n is a, c, g, or t
  modified_base (737)..(737): a, c, t, g, unknown or other
  misc_feature (737)..(737): n is a, c, g, or t
tcagtgacgtatgtcacgaccggtgctcgatttagagctcacgtattggggtttggggagcagagctctgggggatctgcaccatggcctggaccccacttcctcctcctcttcccnctcctcctccactgccactacgggtcctctccttccncgtccttcgtcgtctacgtactctaactctacgtcctcgtcctccttactcgtccttccgtacggtacctcccgtccggttaccctccgtccgtcctcgtcctctaccgtcgacgtgtacggtccgtacgtacgtcggtcttaccgtaatccgtactaccgtcgtaacttcggactacacggtacgcgaacggccttacgaaccggaaccgggtaccgggtaccgtcccgtttcggtactacggttacggtaaccggtacgtaaacgggtacggtaaaccggtaaccggtaaacgacgggtaaacggacggtacggggtaaaccnccggtagtacggtacctcgtcgttacgaccgtcgtaccgtcggtaccggttaccncgggttacctaccggtaccgtcccgttaccgtaacctaccgttaccgtaccctacccgtaccgttacccgtaacggtccggtaacggttctaccgggtaactcccgggtaacttacggtactttaacggtacggtttaggcgtaaccggtacggtagttaaacgttggttaaaccgtagggtacggttaccggtaaaccgggngttaaaccgggggaactacgggtaacggttaccggtaaccggtacgggtacccggtacggacccccgggttaagtaccccgggtcgttacccggtacccgg

SEQ ID NO: 225377 - DNA, 908 bp, Homo sapiens
  misc_feature: GYAE6OF01AKRL9.42.28.C06.1.454.CMB.1.raw
  modified_base (115)..(115): a, c, t, g, unknown or other
  misc_feature (115)..(115): n is a, c, g, or t
tcagtgacgtatgtcacgaccggtgctcgatttagagctcacgtattgggtttggggagcagagctctggggagtctgcaccatggcctggaccccactcctcctcctcttcccnctcctcctccactcgccacacggtctctcctccacgtcctcgtcgtctcgactcgtaactcctacgtcttctcgtccttcgtccgtccttccgtcggtacctccgtccggtacctacccgtcctaccgtcgtacctaccttccgtacgtaccgtacgtacggtcggtactacggtcgttacgtacttaactctacctacgtacgacgtacgtaccggtactacgtaccgacgtaccgacggaccgtaaccggaacccgggaaccgggtaacccggttcccgtacggttaccgttaacggaccgttaacggtaacggttaacggaaacggttaaaccgggtaaccgggtaaacccctaaacggggaaaccgggtaaacgggggtaccgtaaacccggttaccgggtaccgtaaggtacccggttacggttacccgttaccgggtaacggtaaccggtccctacccgggtaacggtccccgttacgggtcccggtaccgtaccgtaccccgttaccctaccgtaacccggtacctaccccgtttacccgaaaccccttaccggttaaccgaccggttacgtacggtacgttaacgcgggttaactacggtaccttaaggttaccgtaacgtacggttacgaccggttacggaagttaacttaacgggtaacgtcggaacggtttacgggtacggtaaccgggtaacggtacgtaaccgggtcgggtacccgttacggtacccggtaaaccggtaccccggaacccgggttacccgtcccggtacccgtacccggg

SEQ ID NO: 225378 - DNA, 885 bp, Homo sapiens
  misc_feature: GYAE6OF01AR7Z7.42.28.C06.1.454.CMB.1.raw
  modified_base (115)..(115): a, c, t, g, unknown or other
  misc_feature (115)..(115): n is a, c, g, or t
tcagtgacgtatgtcacgaccggtgctcgatttagagctcacgtattggggtttggggagcagagctctggggatctgcaccatggcctggaccccactcctcctcctcttcccnctcctcctccactcgcacgacgggttcctcctctcccgtacgtccgtcgttcgtccgtacgtaccttactaaacttccgtaactcccttcgtaccggtcccgttccttcggtccctttaacccggtccggggtacctttcccgttacccgggtcctaacccgtccgtaccgttcgacctaccgttccgtacgtacggtcctaggttaccggttacctacggtacggttcgtacctaacgtcttaccgtaactccgtacgtaacgtcgtaccatacgacgaccaggtaccaacggttacccggaacgggaaccgtccccggtttcggttacgttaaccggaggttaaccggttacgttaaccggaacgttaaacggggttaaaccgggaaccctttaacgggaaaacggtaccggggggtacgtaaaccgggtaaccgttcccggtaggtaaacccggtccgtaccggtaacgtacccgtacggggttacccctcggaacggtttcccgggacggttacccgggtacgtaccgtacccggtaccgtaccgtcccgtaccgtaccgtaccgtacccgtaacgttacccgacgttaccgtacgtacgtaacgtacgtacggtacgtaacgttacgttaacgttcgtaggtacgtacgtacggtacgtaacgtaacgtacgtacgacggttacgtcggggtaacggaccggtaagtacgggtacgtacgggtaactacggtaccgacggaccgtccggcccgtacggtacccgg

SEQ ID NO: 225379 - DNA, 856 bp, Homo sapiens
  misc_feature: GYAE6OF01A6UMN.42.28.C06.1.454.CMB.1.raw
  modified_base (116)..(116): a, c, t, g, unknown or other
  misc_feature (116)..(116): n is a, c, g, or t
  modified_base (127)..(127): a, c, t, g, unknown or other
  misc_feature (127)..(127): n is a, c, g, or t
  modified_base (133)..(133): a, c, t, g, unknown or other
  misc_feature (133)..(133): n is a, c, g, or t
  modified_base (139)..(139): a, c, t, g, unknown or other
  misc_feature (139)..(139): n is a, c, g, or t
tcagtgacgtatgtcacgaccggtgctcgatttagagctcacgtattgggtttggggacgcagagctctggggagtctgcaccagtggcctggaccccactcctcctcctcttccnctctcctcacngtccancggtcnctctccagtcctgtcgctagacctactactcgtactcctactcgtccttccgtaccgttccttccggtacggtaccttcccggtaccggtacctccccgttactccgtcgacctacgtcgtacgacgtccgagtccggacctacgcgtcgttaccactagtctacgcgtacgtagccggtactacgtcgtaacgctacggccgaacgaccgggaacgggtacccggttcctaccggttcgtacgtaacggttacgtacggtagtaacggtaacggtaccggtaaccacgggtaacggaacgggtccgaacgtaccgtacgtacggtaacggtccgacgttacgcgtccgtacgtaccgtagtcccggtaggtacccggagtacccgcccgttacgacccgtaccacccgttaaccgttaccccgtaacccgtaccgtaccgtccgttaaccgggtaacgggtccgtaaccgtcgggtaacgttaccgttaagtttaccgttacgggttaactttcggggaaaccttccgggtaaaccgggttacggtaaaccttaacgggttaaccggtcgggggttaaggtttaccccgggtagggggtaacccggttaaacgggccggttaaaccgggttacccggttaacggtacccgggttaccggtaccggaacccggggttacccgaaaccccgggtccccggtttacccggaaccccggg

SEQ ID NO: 225380 - DNA, 654 bp, Homo sapiens
  misc_feature: GYAE6OF02IZU22.42.28.C06.1.454.CMB.1.raw
tcagtgacgtatgtcacgaccggtgctcgatttagagctcacgtattggggtttggggagcagagctctggggagtctgcaccatggcctggaccccactcctcctcctcttccctctcctcctccactcgcacagggtctctctcccagcctgtgctgactcaatcatcctctgcctctcgcttcctgggactcctcggtccaccctcacctgccacctctcgacgcctaggtcggtcactagtcgtctacatcaatcgcaactcggcaatcacgcagcagccaggggaacggccctacgggttcttcggatacggtaacgttgaacgaacgtacggggaaacctacgaacgaaagggacgcggaagtccgtaggactcggcttacgtcgaacggtcctcagcgttcgtggggtctcggtaccggcctaccgtacgacctaacgttccgaccctaacctccacgttccgtagacggtactcggtacggtcctagtaattacgttacgtgtacgaacggtccgtacgggaactaacggttaaacgttacgagggttacggttacgggtacgggtaacggggtaacgtaagggttacggacccggttcgtaacgggtcgtaaccgggacccgtacgggcccgaccccgttacggg

SEQ ID NO: 225381 - DNA, 600 bp, Homo sapiens
  misc_feature: GYAE6OF02I11MY.42.28.C06.1.454.CMB.1.raw
  modified_base (219)..(219): a, c, t, g, unknown or other
  misc_feature (219)..(219): n is a, c, g, or t
tcagtgacgtatgtcacgaccggtgctcgatttagagctcacgtattgggtttggggagcagagctctgggggagtctgcaccatggcctggaccccactcctcctcctctttccctctcctcctccactgcacaggtctctctcccagcctgtcgctgactcaatcatcctctgcctctgcttcctggctcctcggtcacctcacctgcactctgacncagtcggtcactagtcgtcacactcatcgcatcggcatcagcagcagcgaagggacgcccgtgggttctaggagtacggtaacgttgaacgaacggtaacgggaacctacggaacgaacggggacgacggacgtccgtagacgtcgtcttcgacgacggtctacgacgctcggtgggctcggacccgtcactcgacacgttccaccacctcgacttcgcgtagtactcgacgtctagtattacgtacgtgtagacgtcgtaggaactaagttaaactacggtcggttaggttacgggtaggaacggtaccgtaagggtccgtaaccggttacggtacggtaccgaccggtacccggtaacggtccccggacccgttacggg

SEQ ID NO: 225382 - DNA, 1004 bp, Homo sapiens
  misc_feature: GYAE6OF02FEXGC.42.28.C06.1.454.CMB.1.raw
  modified_base (115)..(115): a, c, t, g, unknown or other
  misc_feature (115)..(115): n is a, c, g, or t
tcagtgacgtatgtcacgaccggtgctcgatttagagctcacgtattgggtttggggagcagagctctggggagtctgcaccatggcctggaccccactcctcctcctcttcccnctcctcctccactgcacacgggtctctctccagcctgtcgctgactcaactcactcctctcgcctctcgtccttccgtgggtactccgtcggtccaccctcaccgtcgcctactctacggacgtccgagtcggtaccacgtacggtcgtactaacacgttccaagttccggactaacgttcgggacctaacgttaccgaaggaccgaacggccgaacggcccgggaaacggggggtaaacccgggtccccccgtttacggggttttaccgtttacggaaccggttacggggttaaaccggtttacgggaaaccgttaaaaacggggtttaaacccggggggtaaaacccctttaaaccccggggaaaacgggtaaaaccgggggggtaaccggtaccggggtaacgttaccccgggtaaggtaaccggttaccggtaccgtttaccggtaccggaccgggtacccgtacccggtacggtacccgttcgggtaccgggggaccttaccggtacccggtacccgtttacccgaccgtaacccggttaaccttcccgtaaccccgttaaacccgtaccgtaaccgggttaccgttacggaaccgggttaagtccgggtaacggttaccttaccgggttaaacgtttttaccgaaccgggtttacggttaaaccggtaaccgggtttaaccggttaacgggggaaacctttaaaaggggttaaccggttaacgggtaaccggggtttttacgggaccgggggtaaccggggttaaacggggtaacccgtaaaacggggggttcccgtaacccgggtttacggtaccggggttaacccggaacccggggtaccccggacccggggttacccccggttaccccgggtaacccggg

SEQ ID NO: 225383 - DNA, 612 bp, Homo sapiens
  misc_feature: GYAE6OF02FMOM8.42.28.C06.1.454.CMB.1.raw
tcagtgacgtatgtcacgaccggtgctcgatttagagctcacgtattgggtttggggagcagagctctggggagtctgcaccatggcctggaccccactcctcctcctcttccctctctcctccactgcacaggtctctctcccagcctgtgctgactcaatcatcctctgcctctgccttccctgggactcctcggtccaccctcacctgcctactctgacgcagtcggtcacagtcgtctacatcatcgcatggcatcagcagcagccagggacgccctggtctgatgaacgttgacaagtacgggaacctacgacgaagggacgcggagtcccagatcggcttacgcaggcctacgacgtccgtcgtcggggctcggacccgctaccgcacccagtccctacccaacctccgacgtcctagacggtactggaacgtctaggtatttacttacgtgtagacgtacgttagggaacctaaggttaaacgttacgaaggggtttacggttacgggacgggttaaacgggaacccgtaaggggtccggtacccggttacgtaagggtaccgtaccggaccccgtaaacggggtccccgtcccccggttacggg

SEQ ID NO: 225384 - DNA, 677 bp, Homo sapiens
  misc_feature: GYAE6OF02HD0N2.42.28.C06.1.454.CMB.1.raw
tcagtgacgtatgtcacgaccggtgctcgatttagagctcacgtattgggtttggggagcagagctctggggagtctgcaccatggcctggaccccactcctcctcctcttccctctcctcctccactgcacaggtctctctcccagcctgtcgctcgactcaatcatcctctgcctctcgcttcctgggactcctcggtccacctcacctcgcaccttctgacgccaggttcggtccacgtacggtcgtctacatcattccgcatcggcatcagcagcagccgaggggaacgccctcggttctggatcgaacgttgacaagtacggggaacctacgacgaaggggacgacggacgtccgtaggacgtcggcgttcgtacgacggccgtccgagtccgtcggtcgggtcgtcgaccggtccgtaccgtccgaaccgacgttccgaccctaaacccttcccgtaacgtccgttacggacggtactacggacggtccgtacgtaacgtttaacttacgtcggtacgtaacggtaccgttaggggaacttaaaggttaaacggttacggggttagttaccggggacgggtaacggggtaaccggtaagggtccggtaacggtccgttaacggggtaccgacggtacccggtaacgggtcccggtaccccggtggtacccg

SEQ ID NO: 225385 - DNA, 670 bp, Homo sapiens
  misc_feature: GYAE6OF02G6SRV.42.28.C06.1.454.CMB.1.raw
  modified_base (115)..(115): a, c, t, g, unknown or other
  misc_feature (115)..(115): n is a, c, g, or t
  modified_base (327)..(327): a, c, t, g, unknown or other
  misc_feature (327)..(327): n is a, c, g, or t
tcagtgacgtatgtcacgaccggtgctcgatttagagctcacgtattgggtttggggagcagagctctggggagtctgcaccatggcctggaccccactcctcctcctcttcccnctcctcctccactgcacaggtctctctcccagcctgtcgctgactcaatcatcctctcgcctctgcttccctggactcctcggtccacctcacctcgcactctgacgcagtcggtcacgagttcgtctacatcatcgcatggcatcagcagcagccagggacgccctcggttctgatgaacgttgaacatacgggactacgacaaggggacncggacgtccgtagacgtcgcgttacgtcgaacggtccgtaccaggtccgttacggtcgggggtacctcggacccgtccgtaaccgtccaaccggacttcccgtaacccgaaacccttccgtaacgtccgtacgaacgggtactggaacgtccttggaaatttacgtaacgttggtacgtacggtaacccgtttagggaaaccttacggttaaaaacgtttaccggaaggtttaccggtttaccgggacggggtaaggggaacccgttaaagggtccggtaacccggttacgtaacgggtaccggaccggaaccccggtaagggccccggtaccccgtaccggg

SEQ ID NO: 225386 - DNA, 666 bp, Homo sapiens
  misc_feature: GYAE6OF02IZ2UD.42.28.C06.1.454.CMB.1.raw
  modified_base (466)..(466): a, c, t, g, unknown or other
  misc_feature (466)..(466): n is a, c, g, or t
tcagtgacgtatgtcacgaccggtgctcgatttagagctcacgtattgggtttggggagcagagctctggggagtctgcaccatggcctggaccccactcctccctcctcttccctctcctcctccactgccacacgggtctctctcccagcctgtcgctgactcaatcatcctctcgcctctcgtcttccctgggactcctcggtcctaccctcaccgtcgctactcctgacgcagtcgtcacagtcgtctacgatcatcgcagtcggactatcgagcagccaagccgaaggggaccgccccgtaggttcttacggactcggaacgttcgacgtaaggtacgggaacctaccgacggaaggggcgacggtacgtccgtagacgtccgtcgttcgacgtagcctacgagcctcgtcgggctcggacccgtctaccgtcacctacgtccaccgacctccgagttccnggtagtcgtcggacgtctagtacttacgttacgtggtgtaacgtaccgttagggaactaacgttaaaacggttcgaaggggttacgttaccgggaacggggtaacgggccgtaaacgggttccggtaacccggttaccggtaacgggttcccgtaaccgggaccccgtaaaccggggtcccccgtaccccggtaaccggg

SEQ ID NO: 225387 - DNA, 996 bp, Homo sapiens
  misc_feature: GYAE6OF02GUXS1.42.28.C06.1.454.CMB.1.raw
  modified_base (115)..(115): a, c, t, g, unknown or other
  misc_feature (115)..(115): n is a, c, g, or t
tcagtgacgtatgtcacgaccggtgctcgatttagagctcacgtattgggtttggggagcagagctctggggagtctgcaccatggcctggaccccactcctcctcctcttcccnctcctcctccactgcacacggtctctctcccagcctgtcgctcgactcatcactcctctcgcctctcgtccttcccgtggacttcccgttccggtccctacccgttccgtacccttcgtccctaccttccgtcggaccgtccgtacggttcggtaccaaccgtaggttcgtacccttaacgacttaccgtaacgttccggacctacgttcggtacctaacttccgaaccggccgtaaggacccgtacggaccccgggaacgggggtaacccggtcccccccggtttaaccgggtttcccgtttacgggtaacgttaccggtaaaacccgggtttacggtaaaccgtaaacgggttaaaccggggggtaaacccccttaacccggaaacgggtaacgggggtaacgtacccgggtaaccggttaccccgtagggtaacctaccgggttaaccgtttccggtaccgtaacggggttcccttaccggaaccggtcccggttaccgggtcggggggttacctaccgggtacccggttacccgttaaccccgtaccgtaaccccgtacgttaccccgttaccccgtaaaccccgttccctacccggttccgttaaccggtacgggttaaccgtcggaacggttacccgttacggtaaacgtttaaccgttacggttaggttaccggtaacgggttaaccgttaccggggtaaacgttaacggttaaaacgttaccgggtaagggtttacgggtttaaccggggtaccgggtaacggggtaccggttaaacggggtaccggttaacccggtaccggttaacgggttaacccgggtaccgggtaccccggtaacccggggtaccccggttccccggttaaccccgggg

SEQ ID NO: 225388 - DNA, 997 bp, Homo sapiens
  misc_feature: GYAE6OF02IJCTV.42.28.C06.1.454.CMB.1.raw
  modified_base (118)..(118): a, c, t, g, unknown or other
  misc_feature (118)..(118): n is a, c, g, or t
tcagtgacgtatgtcacgaccggtgctcgatttagagctcacgtattggggtttggggagcagagctctggggagtctgcaccatgggcctggaccccactcctcctcctctttcccnctcctctccactcgcacacggtctctctcccagcctgtcgctgactcaatcactcctcgtcgcctctcgtccttcccgtgggtacttccgtccgggtcctaccccgttcctacccgttcgacctaccttccgttcggacgtccgtaaggttccgggtaccaacgtacggttcgttacctaaccgtacttccaacgttaccggactaacgttcgggtacctaacgttaccgaacggtcctaacggtaccgaaccggtacccggaacggggggtaaaaccgggtccccccggtttacggggtttacccgttacgggtaacgtttaacgggttaaaccggttttaacgggaaaccgtaaacgggtaaaccgggggtaaaccccgttaaaccggaacgggaaaacgggggtacgaaccgggtaacggttacccgttaagggaaccgttccggtaccgtttacgtaccggtaacgggtaccgttaccgaaccggtccggttacgggtacggggtccgttaccgggtaacccggtcccgttaaacccgttcccgtaaacccgtaccgttacccgtaccccgtaaacccgttacccgttaaccggttaccggttaccggtaaaccgggtacgttacgggacgggttacgttaacggttaactttaacggttacgttaggttaacgtaaccggttaaccggttaacggggtaaacttaaacggttaaaacgtttacggggtaaccgggttacgggttccggggtaacggggtaacggggtaacccggtaaaggggttacccggtaacccgggttaaccggttacgggttacccgaaccggggttaaccccggaaccgggtaccccccgggtacccggttaacccggg

SEQ ID NO: 225389 - DNA, 841 bp, Homo sapiens
  misc_feature: GYAE6OF02H2EE6.42.28.C06.1.454.CMB.1.raw
  modified_base (115)..(115): a, c, t, g, unknown or other
  misc_feature (115)..(115): n is a, c, g, or t
tcagtgacgtatgtcacgaccggtgctcgatttagagctcacgtattgggtttggggagcagagctctggggagtctgcaccatggcctggaccccactcctcctcctcttcccnctcctcctccactgcacacggtctctcctcccacgcctcgtcgctcgacctcaactcactcctctcgtcctctcgtccttcccgtcggaccttccgtcggtacctaccctcctaccgtcgtcctacttccgtcggtacgtcgtacggttcggtacctacgtacgttcgttacctaacctacgttaccaacgtccggtacctaacggtcggtaccaacgttccgacgtaccgacgccgtaacggaccggaacggggtaaccggtccccgttcgggttacttcggtaacgtacggtaaccggttacgaaacgttaaacgggtaaccggggtaaaccctacggaacgggtaaaggggaccgtaccggaacggttacccgtaggtaactccggtccttacgacgtacgccgtacgacggttcgtcgggtacggtctcggacccgtccgtaccgtacaccgtactacctacccgacctaccgaccgttaccgcggtagtacgtacggacgttacgtacgttaactttacgtaaccgttcggtaacgtaaccggtaccgttacggggaaactttaaaacgggttaacgttaccgggtaacggtttacgggttaaccgggaccggggtaaacggtaaccggttaacggggtaaccgtacccgggtaaccggtttacgggaccgtaacccggtaaccccgtaacccggggttccccggtaccccggttacccgg

SEQ ID NO: 225390 - DNA, 961 bp, Homo sapiens
  misc_feature: GYAE6OF02HPCFX.42.28.C06.1.454.CMB.1.raw
  modified_base (115)..(115): a, c, t, g, unknown or other
  misc_feature (115)..(115): n is a, c, g, or t
tcagtgacgtatgtcacgaccggtgctcgatttagagctcacgtattgggtttggggagcagagctctggggagtctgcaccatggcctggaccccactcctcctcctcttcccntcctcctccactgcacaggtctctctccagcctgtcgctgactcaatcatcctctgcctctgtccttccgtcggtacttccgtcggtacctacccgtccaccgtcgacctacttccgtacgtacgccgtaaggttcggtacctacgtacggttcgtaccttaccaacgttcctaacgtcgtacgtaacgtcgggtacacgttaccgaacggaccgtaacggaccggacggacccggaacgggggtaaacccgggtcccccgtttacgggtttaccgttacggtaacgtttaccgggtaaaccgggtttacgtaaaccggtaaaacgggttaaccgggggtaaaacccgttaaacccgggaaaacgggtaaacggggggtaaccggtaaccggggtaacggttaccccgggtaaacggtaccggttaccggtaacctttaccgggtacccggtaacggtacccgttacccggtacgttaccgggttaccggttcggggtacgtacccgggacccgtaccgttaccccgtacccgtaacccgttacctccgttaaccccgaacccgttacggtaacccggtccgtaacgggtaaccggtaccgtacgggtacgtccgtttaacggttaacgtttaaccggttacgttagggtaccggtaacggtaacccgggttacgggttaaacgtaaacggttaaagttacccggtaagggttaccgggttacggggaacgggtaaccggggtaacgttaacgggggttaaccggtacccgggtaaccggttaaccggggtaacccgaccgggttaaccccggtacccggggtccccggtttacccgtacccgggg

SEQ ID NO: 225391 - DNA, 805 bp, Homo sapiens
  misc_feature: GYAE6OF02IK66A.42.28.C06.1.454.CMB.1.raw
tcagtgacgtatgtcacgaccggtgctcgatttagagctcacgtattgggtttggggagcagagctctggggatctgcaccatggcctggaccccactcctcctcctctttccctctcctcctccactcgcacacggtcctctcctcccagccttgtcgctgactcaactcatctctgcctctcgccttccgtggacttccgtcggtccaccctcgacctcgctacctcgtcgacgcctaggtcgtacactacggtcgtacctacagtctactcgctagtcgcctatcagcacgcacgaccgaggggaaccgtccccgttggtttccgtaggtacgtacggtaaccggttcgaaacgtaacggtacggggaacctacggaacggtaaacggggactacggtacgtacccggtagtaacggtccgtacgttacgtacgtaacggggtccttaccggacggttccgttaccgggtcggggaccttacgggaaccccggtacctaacccgtcccgtaaaccgtccgttaccgtaccccgtaaacccgttcccgacggttacccgttgggtaaaccggtacgtacgaacgggtctaacgtaacgtttaacgtttacggtacgttacggtaaacggtcccggtaacggttaaacgaacggttttaaaaacgttacgggtcgggtttacggtcccggggtaaggtaacgggggtaacccgtaagggttaaccgggaccccggtttaacggtacgggtaaccggtacccgggtaaccccgtacggggtacccccggttcccgtaacccgggg

SEQ ID NO: 225392 - DNA, 870 bp, Homo sapiens
  misc_feature: GYAE6OF02IJPFL.42.28.C06.1.454.CMB.1.raw
tcagtgacgtatgtcacgaccggtgctcgatttagagctcacgtattggggtttggggagcagagctctggggagtctgcaccatggcctggacccccactcctcctcctccttcccgtctcctctccactcgcacgtacggtctctctcccagcctgtcgtctgtacctctaactctacttcctcgtcgtcctctcgtccttccgtcgggtactccgtccggtcctacccgtctaccttcgacctacctcgttacggacgtccgaaggtcggtacacgtacggtctacctactataccgtagtacgtacgtagtaccggacgtaactacgacgaccgtacgtacgaaccggttaccgaacgggggtaacccgtcccggtttaccggttacgtacggtacgtaaccggtaacggttaacgaaacggtaaacggttaaccgggtaacctaacggaacgggtaacgggacgaccggtacgtaccgttaagcggttaccgtacgttaccggaacgtcggtacctacgtacggtccgtacggtcgggtaacctaccggtaccgttacccgttaaacccggtacctaacccgttacgtaccctacccgttaacccgtaaccgttaccggtacgttaaccgggtagttaccgggaggttaaccgtaccgttaacggtaacttttacggtaacccgggttgttaaccggaacggttaaccgggtaaccgggttaaacgtaaaggtttaaaaccgtgggttaaccgtacggggttaacgggtacggggtaacggtaaaccggacgggttaaccgtaccggtacgggttaaccgcgggtaaccgaacccgggttaaccgccccgggtaccctaccgggg

SEQ ID NO: 225393 - DNA, 721 bp, Homo sapiens
  misc_feature: GYAE6OF02JYECT.42.28.C06.1.454.CMB.1.raw
  modified_base (116)..(116): a, c, t, g, unknown or other
  misc_feature (116)..(116): n is a, c, g, or t
  modified_base (149)..(149): a, c, t, g, unknown or other
  misc_feature (149)..(149): n is a, c, g, or t
  modified_base (495)..(495): a, c, t, g, unknown or other
  misc_feature (495)..(495): n is a, c, g, or t
tcagtgacgtatgtcacgaccggtgctcgatttagagctcacgtattgggtttggggagcagagctctgggggagtctgcaccatggcctggaccccactcctcctcctcttcccnctcctcctccactcgccacaggtctctctcccncgcctgtcgctcgactcaactcactcctctcgtcctctcgtccttccctgggtacttccgtccggtcctacccgtcctaccgtcgctacctccgtcggactccgtaggtcggtacaacgtcggtcgtacctaacgactcactcgctatcggctactacgacgcgcgacgacgccgaacgggacggcccgtcggttacgtcggtaacgtcggtacggtacgtaacgtaacgtaacggggaacctaaacgaacggaacgggtacggacggaacggtccgtacgacgtccggtacgtcgtacgtacgtcgtacgacgtcgtcgggtacggcgtacggacgtcccgtacncccgtaccgtacctcctacccgaacctccgtacgtccgtaacgtacggactcggacggtacgtacggttaacgttactacggtgttacgtaacggtaccggtaggtaaaccgtaagtaacgttacggtaggtacggttcggaacgggtaacggtaaccggtagggtaccgtaccggtacggtaacggtaccgtaccggacccgtaccgggcccgtcccggtaccgg

SEQ ID NO: 225394 - DNA, 776 bp, Homo sapiens
  misc_feature: GYAE6OF02H9ZOV.42.28.C06.1.454.CMB.1.raw
  modified_base (59)..(59): a, c, t, g, unknown or other
  misc_feature (59)..(59): n is a, c, g, or t
  modified_base (114)..(114): a, c, t, g, unknown or other
  misc_feature (114)..(114): n is a, c, g, or t
  modified_base (179)..(179): a, c, t, g, unknown or other
  misc_feature (179)..(179): n is a, c, g, or t
  modified_base (249)..(249): a, c, t, g, unknown or other
  misc_feature (249)..(249): n is a, c, g, or t
tcagtgacgtatgtcacgaccggtgctcgatttagagctcacgtattgggtttggggancagagctctgggggagtctgcaccatggcctggaccccatcctcctcctcttccntcctcctccactgcacacggtctctctcccagcctcgtgctgactcaatcactcctctcgtcctntcgtcttcccgtagggctccgtcgtacaccctcgacctcgcactcctagacgcaggtcgcaacgtcggtntactactatctactcgacctagtggcctagtcgagaccgagctaacgcccggtaagggaaccggtcccccggttacggttaccgtggtacttacggtaaccggttagaaccgtaaggtaaaccgggtaccgtaaccgaagggaacggggacggacggtaaggttcccacggtagtccggttacttcgtacgtcgggtcctaccggtacgtaccggttcgggtacggggtctaccgggtaccggtaacccgtccgtaacccgtaccttaaccggttcccgaaccctaacccggtacccgttacgtacccggttacgaaacggttcgaccgggttagacgtacggtttacttaacggttcgtacggtacgtacggtacccggtaaggtacgtaaaacggttaacgtaacggtacggtacgggttccggggtacggtaaacggaacccgggttaggaaccgggttaacccggtcggttacggtaacggtaaccgggaccccttacggggcccccttaccgggttacccgg

SEQ ID NO: 225395 - DNA, 791 bp, Homo sapiens
  misc_feature: GYAE6OF02HRIZR.42.28.C06.1.454.CMB.1.raw
  modified_base (117)..(117): a, c, t, g, unknown or other
  misc_feature (117)..(117): n is a, c, g, or t
tcagtgacgtatgtcacgaccggtgctcgatttagagctcacgtattggggtttgggggagcagagctctgggggagtctgcaccatggcctggaccccatcctcctcctcttcccntcctcctccactcgctacagggtcctctctacccacgtcctgtcgctcgacctacaactcactcctcgtcgccttctcgtcctttcccgtagggtccttccgttaccggtccctaccccgttccgtaacccttccgtacctaccgtttcccgtaacggtaccgtaccgtacgggttccgggtacctaaccggttcggttccggttacctaacgtacgtacctaaccgtaccggtactacgtccgggacctactacgacgtcgacggacgtacgaccggaacggacccgtcccgttacggtacgttacggagttacggtacggttagtaacgtacggtaacgggaaccctacggtaacggaacgggtacggacggtacggtcccgtaggtacgtacggtccgttacgaccgacgtccgtacgtacgtccggtacggtccgggtacgtacggtacccgtcgtacccgtacacccgtactacccgtaaccctcgtacccgtagtaccggtcgtacgacgttacgaagtcctaggtacttacgttacgtagtcgtaacgtacgtaacgggtataacgacgttagccgtacgggttacgggaacggacgggtaacgtacgggtacgaccgggttagtacgggtaccgacggcccggtaacgggtcccgtacgtacccgg

SEQ ID NO: 225396 - DNA, 626 bp, Homo sapiens
  misc_feature: GYAE6OF02H6ZBI.42.28.C06.1.454.CMB.1.raw
  modified_base (117)..(117): a, c, t, g, unknown or other
  misc_feature (117)..(117): n is a, c, g, or t
  modified_base (159)..(159): a, c, t, g, unknown or other
  misc_feature (159)..(159): n is a, c, g, or t
  modified_base (230)..(230): a, c, t, g, unknown or other
  misc_feature (230)..(230): n is a, c, g, or t
  modified_base (519)..(519): a, c, t, g, unknown or other
  misc_feature (519)..(519): n is a, c, g, or t
tcagtgacgtatgtcacgaccggtgctcgatttagagctcacgtattggggtttggggagcagagctctgggggatctgcaccatgggcctggaccccactcctcctcctcttcccnctcctctccactcgcacaggtctctcctacccagcctggtcnctcgactcaactctacgtcctctcgtcctcgtctccttcgtcggtactccgtccggtccacctccacgtcncctactaccgtagcgcgtaggtccgacacgtacgtacgtactcactactacgaccgtcacgtcgactacgtaccgcgctacggaccgagtaccgacggggacctcccggtaggttccacggtagtcgtacgtacgaacgtacgggaaccgtacgacgtacggagggtcgacggtcgacgtctaggtctactacgacgcgtcacgtgcgtacgacgtcgacgtcgactaccgctacctcgtcctaccgtacgcgtaccagtacgacgtacgacgtactcgtattacgttntacggacgtacgtgtacggtatacgtaagtaacgtacggtagacggttcggacgtagtaacggacgtcggactacggcgacgtacggacctacggtcccgcgtacgg

SEQ ID NO: 225397 - DNA, 904 bp, Homo sapiens
  misc_feature: GYAE6OF02HL743.42.28.C06.1.454.CMB.1.raw
  modified_base (116)..(116): a, c, t, g, unknown or other
  misc_feature (116)..(116): n is a, c, g, or t
tcagtgacgtatgtcacgaccggtgctcgatttagagctcacgtattgggtttggggagcagagctctggggagtctgcaccatggcctggaccccactcctcctcctctttcccnctcctcctccactcgccacgacggtcctcctcctcccacgtcctcgtcggcctcgacctccgaacttcacttcctcgtcgtcccttcgtcgtaccttcccgtagggtccttcccgtaccggttccctacccttccacccgttcgtaccctaccgttcctaggacgtacctacggttccggtaccaacgtacggttcgtacctaacgtaccgttacctaacgtcggtacctaagtccggtacctaacttaccgaacggtaccgtaacgcccggaacggtacccgggtaaacggggaaccccgggttacccccgtttacggggtttaaccgttacggaaccgttaccgggttaaaccgggtttaacgaaccgtaaaacggggttaacccgggtaaccccttaaccggaaggggtaaaccggggtacggtacccggtaaccggttacccgtacggtaaccgtacccgggttaccttaccgggaccgtaccggtacccttacccggacgtccggttaccggtcgggttccgtaccggtacccggtcctaacccgtccgtaaccgttaccgttcccgtaacccgttaacccggtccgtaacgttcccgaacggtaacgtaccggttacgtaccggttctaacggttaacttacggtaccgtacgtacgtaccggtacgtacggtaactacgttaagtacgtacgggttcgttacgggacggtaacggtacgtaacggtccggacggttaccgtacgggaccgacgtacccgggtacgcccggtacccgtacgg

SEQ ID NO: 225398 - DNA, 1006 bp, Homo sapiens
  misc_feature: GYAE6OF02G3XM2.42.28.C06.1.454.CMB.1.raw
  modified_base (115)..(115): a, c, t, g, unknown or other
  misc_feature (115)..(115): n is a, c, g, or t
tcagtgacgtatgtcacgaccggtgctcgatttagagctcacgtattgggtttggggagcagagctctggggagtctgcaccatggcctggaccccactcctcctcctcttcccnctcctcctccacctcgccacacggtcctctcctcccacgtccgtcgtcgtcctcgacctacaactccacttccgtctcgcccttctccgtccttaccgtcggtcctcccgtcggtacctacccgtcctacccgtcgacctaccgtcgtacgaccgtacgacggttccggtactaacgtacgttacgttaccgtaacgtaccttacgtaacgtccggactaagtccgggtacacctacaacgggtccacggaacctcggtaacccgaacggggggtaaccccgttccccgttaccggggtttaaccctttagggaaccgtttcggttaaaaccggttcggtaaaacgtaacggggttaacccggggtaaaccctaacccggaaaggggaaacccggggtccgacgggtaacgtacccgtagggttacctaccggtttacccgtacgtacccggaacgtccccgtaggtaccggtacgttccggggtacgggtcccgtaaccgggtacccgtacccggtaccccgttaaccgaccccgttaaccgttacctaaccccgttaaccggacccgttacgttaaccggtaacggtaaccgggtactaccgggttaccggtacgtttaacgggtaacgttttaaccggtaaacgtttaccggtaaccgggtttaacggttaccccggggttaacggtaaacggttaaaaccgggttaaaacggtttaccgggttaacggggttttacgggtaaccggggtcgggggtttaaacccgggaaacgggtaacccgggggttaaccggttaaccccgggttaccgggtaacgggttaacccggaaccccgggtttaaccccgggaaccgggttaccccccggttaccccgttaaccccgggg

SEQ ID NO: 225399 - DNA, 725 bp, Homo sapiens
  misc_feature: GYAE6OF02JP9E7.42.28.C06.1.454.CMB.1.raw
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
  modified_base (563)..(563): a, c, t, g, unknown or other
  misc_feature (563)..(563): n is a, c, g, or t
tcagtgacgtatgtcacgaccggtgctcgatttagagctcacgtattgggtttggggagcagagctctggggagtctgcaccatggcctggaccccactcctcctcctcttcccatcctcctccactcgcacgaggtctctcctccctagccttgtcgactcgactacaatcactccgtctcgcctctgtaccttccgtgggaacttccgtcgtcctaccnctaccntccaccgtntacggactacgtcgtacgtacaccgtagtctactaccgntactacnccgtacagtcgaacgtntaccacgctacgcgtaacggcgaacgggaccggtcccgttcggtacgttacgacgttacgtaaggtctaaacgtacgtaacggtacaacgacggacggtacgacgtaccgacgtcgtactcggtactcggtacncgttacnccgtacgtccgtacgtccgggtcacggtccgtaaccgtccgtaccgtactccgtaccctctaacccgtcgtacgttaccacggtacggtacgtacgacgttacgtacgttacttacggttacncggttaacgtaccggtacgtaacgttaggaaaccgttacgttaggttaccgggttcggaacgggtaccgggtaaacgggtccgggttaagacccgttaaccggggtataccccgggttaacgaccgaacccgggttacccggacccggtacccggttacccg

SEQ ID NO: 225400 - DNA, 384 bp, Homo sapiens
  misc_feature: GYAE6OF01B4PXU.36.33.C11.1.454.CMB.1.raw
  modified_base (380)..(384): a, c, t, g, unknown or other
  misc_feature (380)..(384): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcagcctccaccaagggcccatcggtcttcccctggcgccctgctccaggagcacctccgagagcacagcggccctgggctgcctggtcaaggactacttccagacagcgtactgagcgggctggcaaggcgcatagnnnnn

SEQ ID NO: 225401 - DNA, 511 bp, Homo sapiens
  misc_feature: GYAE6OF01DMLCV.36.33.C11.1.454.CMB.1.raw
  modified_base (447)..(447): a, c, t, g, unknown or other
  misc_feature (447)..(447): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagtacgctgtctcacgaccggtgctcgatttagagtgagctcgttgggtttgggagggttggtacagcctgggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcagctccacaggcccatcggtctcccctgcgccctgctccagagcacctccganagcacagcggccctggctgcctgtcaaggactacttccagacagcgtacngagcgggntggacg

SEQ ID NO: 225402 - DNA, 194 bp, Homo sapiens
  misc_feature: GYAE6OF01BYHPB.36.33.C11.1.454.CMB.1.raw
  modified_base (194)..(194): a, c, t, g, unknown or other
  misc_feature (194)..(194): n is a, c, g, or t
tcagtacgctgtctcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccagacagcgtactgagcgggctggcaaggcgcatagn

SEQ ID NO: 225403 - DNA, 398 bp, Homo sapiens
  misc_feature: GYAE6OF01DEXT3.36.33.C11.1.454.CMB.1.raw
  modified_base (391)..(398): a, c, t, g, unknown or other
  misc_feature (391)..(398): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcagcctccaccaagggcccatcggtcttccccctggcgccctgctccacggagcacctccgagagcaccagccggcccgtcgggcgtcgcctcggtcaaggactacttccagacagcgtactgagcgggcgtggcgaaggcgcatagnnnnnnnn

SEQ ID NO: 225404 - DNA, 387 bp, Homo sapiens
  misc_feature: GYAE6OF01C3N6L.36.33.C11.1.454.CMB.1.raw
  modified_base (381)..(387): a, c, t, g, unknown or other
  misc_feature (381)..(387): n is a, c, g, or t
tcagtacgctgtctcacgaccggtgctcgatttagagtgagctcgttgggtttgggtgccgaagttgctggaggggccggttcaccatctccagagacaattccaagagcacgcctgtatctacaaatgaacaacctgagagccgaggacacggccttatattactgtgcgaaatattctgacgtcgtagcacctcgcccctattttgactactggggccagggaaccctggtcaccgtctcctcagcctccaccaagggcccatcggtcttcccctggcgccctgctccaggagcacctccgagagcacagcggccctgggctgcctggtcaaggactacttccagacagcgtactgagcgggctggcaaggcgcatagnnnnnnn

SEQ ID NO: 225405 - DNA, 560 bp, Homo sapiens
  misc_feature: GYAE6OF01CGQ3G.36.33.C11.1.454.CMB.1.raw
  modified_base (341)..(341): a, c, t, g, unknown or other
  misc_feature (341)..(341): n is a, c, g, or t
  modified_base (386)..(386): a, c, t, g, unknown or other
  misc_feature (386)..(386): n is a, c, g, or t
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacagtgganctgacaccgtggggccagggccacccgtggtcctacccgtttccncgacgccctccaccgaacgggccccacgtccggtccttcccccgtggccgcccctgcctccgaggcgccacctccgagacgcacgacgccggcccgtgggcctcgccgtggtacgaacggacctaccgttccgagacgacgcgtacgtcggacggcgggcgtcggcgaaggccg

SEQ ID NO: 225406 - DNA, 379 bp, Homo sapiens
  misc_feature: GYAE6OF01AF33N.36.33.C11.1.454.CMB.1.raw
  modified_base (374)..(379): a, c, t, g, unknown or other
  misc_feature (374)..(379): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctatttgactactggggccagggaaccctggtcaccgtctcctcagcctccaccaagggcccatcggtcttcccctggcgccctgctccaggagcacctcgagagcacagcggccctgggctgcctggtcaaggctactcagacagcgtactgagcggctggcaaggcgcatagnnnnnn

SEQ ID NO: 225407 - DNA, 616 bp, Homo sapiens
  misc_feature: GYAE6OF01DXGYH.36.33.C11.1.454.CMB.1.raw
tcagtacgctgtctcacgaccggtgctcgatttagagtgagctcgttgggtttgggggagggttggtacagcctggggggtccctgagactctcctgtgcagcctctggattcaccttttagcagctatggcatgagctgggtccgccaggttccagggaagggactgcagtgggtctcatctattagtgctagtggtggtactacattctacgcagactccctgaggggccgttcaccatctccagagacaattccaagagcacgctgtatctaacaaatgaacaacctgagagccgaggacacggccttatattactgtgacgaaaatattctgacgtcgtaagcacctcgccccttatttcgactacgtcgggccacgggaccctggtccaccgtctcctcacgccctccaccgaacgggcccctagtccggtccttcccccgtcgggcccgtcccctcgcctccgacggacgccaccctccggacgacgccaccgacggccggcccgtcgggccgtcggcccgtcggtaccgaaacgggtacccttaccgttacccaacggaccgaacggtcccgttaacgtcgggaacgggtccggggccgtcgggaccgg

SEQ ID NO: 225408 - DNA, 547 bp, Homo sapiens
  misc_feature: GYAE6OF01EABTP.36.33.C11.1.454.CMB.1.raw
  modified_base (539)..(539): a, c, t, g, unknown or other
  misc_feature (539)..(539): n is a, c, g, or t
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcagccctccaccaagggccccatccggtcttccccctggccgccctcgctccaggcgccacctccgagacgccacgagccggcccgtcgggctcgcctcggtacaacggtctaccttccagaccagccgtactgaggccgggngtggaccg

SEQ ID NO: 225409 - DNA, 591 bp, Homo sapiens
  misc_feature: GYAE6OF01ALGPC.36.33.C11.1.454.CMB.1.raw
  modified_base (235)..(235): a, c, t, g, unknown or other
  misc_feature (235)..(235): n is a, c, g, or t
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccgttnaccatctccagagacaattccaagagcacgctgtatctacaaatgaacaacctgagagccgaggacacggccttatacttactgtgacgaaatattctgacgtcgtagcacctccgccctattttgactacgtggggaccagggaccctggtccaccgtcctcctcacgcctccaccgaacgggccccaagtccgggtccttcccccgnggcccgccctcgcctcgacggcnccaccgtccgagacgccacgtacggccggcccgtgggcctcggcccttacgggtacaacgggtacctaccgttacccgacgaccacggtaccgtacgtacgaggggccggtcggtgggaaccgg

SEQ ID NO: 225410 - DNA, 457 bp, Homo sapiens
  misc_feature: GYAE6OF01DUQJM.36.33.C11.1.454.CMB.1.raw
  modified_base (444)..(457): a, c, t, g, unknown or other
  misc_feature (444)..(457): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactacgtggggccagggaaccctggtccaccgtctcctcacgccctccaccaacgggcccatccggtccttccccctggccgcccctgcctcccaggacgccacctcccgagacgccacaggcccggccccgtggggcctcggcccgttcgggtacaaacgggtacctttaccgttacccgaagaccgaggtccgtaacgtggacggcggggcgtgggccgaaagggcgacgatagnnnnnnnnnnnnnn

SEQ ID NO: 225411 - DNA, 600 bp, Homo sapiens
  misc_feature: GYAE6OF01EGF4Q.36.33.C11.1.454.CMB.1.raw
tcagtacgctgtctcacgaccggtgctcgatttagagtgagctcgttgggtttgggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccgttcaccatctccagagacaattccaagagcacgctgtatactaacaaatgaaacaacctgagacgccgaggacacggtccttaatacttactgtagacgtaaattattctagacgtcgtagcctaccgtccgccccttattttgactacgtcggggccaacgggaccctggtcctaccgtcctcctcacgccctccaccgacgggcccctagtccgtccgttcccccgtcggcccgtccctcgcctccgagacgcctaccgtccgagacgcgaccgacgccggcccgtgggcctcggccgttcggacaacggtaccttaaccttcccgacgaccgacgccgttacgtacggacggcgggctcgggaacgg

SEQ ID NO: 225412 - DNA, 518 bp, Homo sapiens
  misc_feature: GYAE6OF01AXCSZ.36.33.C11.1.454.CMB.1.raw
tcagtacgctgtctcacgaccggtgctcgatttagagtgagctcgttgggagggttggtacagcctgggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttatattactgtgcgaaatattctgacgtcgtagcacctcgcccctatttgactactgggccagggaaccctggtcaccgtctcctcagcctccaccaagggcccatcgtctcccctggccgccctgctccaggcgcacctccgagacgcacagcggccctgggctgcctggtcaaggacctacttccagacagcgtactgagcgggctgggcaacggg

SEQ ID NO: 225413 - DNA, 612 bp, Homo sapiens
  misc_feature: GYAE6OF01BWNBG.36.33.C11.1.454.CMB.1.raw
  modified_base (454)..(454): a, c, t, g, unknown or other
  misc_feature (454)..(454): n is a, c, g, or t
  modified_base (478)..(478): a, c, t, g, unknown or other
  misc_feature (478)..(478): n is a, c, g, or t
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctggacggggccgttcaccatcctccagagacaattccaagagcacgctgtatctacaaatagaacaacctgagagccgaggacacggtccttatattactgtgacgtaaatattctagacgtcgtagcacctccgccccttatttcgactacgtcggggccacgggtaaccctggtccaccgtctcctcacgccctccgaccgaacgggcccacgtccggtccttcccccgnggccgccctcgcctaccgaggacnccaccgtccgagacgcaccgacggccggcccgtcgggcctcggccgttcgggtaccgaaacggtcccttaccgtacccgaacggaccgtaacggtccgttacgtcggaacgggtccgggtaccgtgggaaccgg

SEQ ID NO: 225414 - DNA, 386 bp, Homo sapiens
  misc_feature: GYAE6OF01BLQ7U.36.33.C11.1.454.CMB.1.raw
  modified_base (381)..(386): a, c, t, g, unknown or other
  misc_feature (381)..(386): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgccctattttgactactggggccagggaaccctggtcaccgtctcctcagcctccaccaagggccccatccggtcttccccctggcgccctgctccaggagcacctccgagagcacagcggccctgggctgcctggtcaaggctacttccagacagcgtactgagcgggctggcaaggcgcatagnnnnnn

SEQ ID NO: 225415 - DNA, 654 bp, Homo sapiens
  misc_feature: GYAE6OF01CGOPQ.36.33.C11.1.454.CMB.1.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagtacgctgtctcacgaccggtgctcgatttagagtgagctcgttgggtttgggggagggttggtacagcctggggggtccctgagactctcctgtgcagcctctggattcacctttaacaactactggatgtcctgggtccgccaggctccgaggggaaggggctggaatgggtggccaacatgaagccagatggaagtcagacatactatgtggactctgtgaaggccgattcacatcnccagagacagcnccaatcactcactgtatctagacaaatagaacagcctaggagacgccgaagaccgacggtcttagttttactacgtgtcgcgaagaggaggcttacgttttaggagttggttatcgtaccctttagaccgtacggtcggggacctaacgggtaacccttggtccctccggttctccgtcgtcgtccttacccgaccgaaccggtcccctacgttccccgttcccgttcccccgtggtcccgtccccgtcgtaccctcccgacggaccgccctacccgtccgaacgacgaccgaccgaccggccccgtcccggtcgggccttccggcccgtcggtaccgaacggtacccttaccttccgacgaccgacggtccgtacgtaggacggtccgggtcgtacgg

SEQ ID NO: 225416 - DNA, 738 bp, Homo sapiens
  misc_feature: GYAE6OF01EAYXO.36.33.C11.1.454.CMB.1.raw
  modified_base (355)..(355): a, c, t, g, unknown or other
  misc_feature (355)..(355): n is a, c, g, or t
tcagtacgctgtctcacgaccggtgctcgatttagagtgagctcgttggggtttgggggagggttggtacagccgtggggggtccctgagactctcctgtgcagcctctggattcacctttagcagctatggcatgagctgggtccgccaggttccaggggaagggactgcaggtggtctcatctattagtgctagtggtgtactacattcacgcagacctccgtggacggggccgttcaccatcctccagagaacaacttccgaagagccaacgtctagtaactactaacaaatacgaaaccaaccgtgaagacgaccggaggaaccgacggtaccttaattacttactggtanaacgtaaattacttcgtaggtaacgttcgtaacgcctaaccctcctaacccctttatttacgaactaccggtcggggacccgtaacgggtaccctggtaccctacccggttcctccctcgacccgtccctacccgaaacccggaccgggaccccctaacggttcccggttccccgtttaccccccggcgggtcccctcccccgtgacccctcggaacggccgaccctaacccgccggaacgaccgccgtaaccgacgggcccggtcccgtacggggtccttaccgggcccgttacgggtaacccgtaacgggtaccctttaccgtaccggaacggtacccaccggttacggtacctagggacgggccgggcgtacgggaacgg

SEQ ID NO: 225417 - DNA, 614 bp, Homo sapiens
  misc_feature: GYAE6OF01DKQSP.36.33.C11.1.454.CMB.1.raw
  modified_base (352)..(352): a, c, t, g, unknown or other
  misc_feature (352)..(352): n is a, c, g, or t
  modified_base (595)..(595): a, c, t, g, unknown or other
  misc_feature (595)..(595): n is a, c, g, or t
tcagtacgctgtctcacgaccggtgctcgatttagagtgagctcgttggggtttgggggagggttggtacagccgtggggggtccctgagactctcctgtgcagcctctggattcacctttagcagctatggcatgagctgggtccgccaggttccaggggaagggactgcaggtgggtctcatctattagtgctagtggtggtactacattctacgcagacctcccgtggacggggtccgttacaccatctccagagacaattccaagagcacgctgtatactaacaaatgaaacacctagagacgaccggaggaccacggtaccttaatacttactgtagacgtaaattnttctaggaccgtcgtacgcctacctccgtccccttattttcgactacgtcggggaccacgggtaccctggtacctaccgtcctcctcaccgcctccgaaccgacggtcccacgtccggtcccttccccgcgcccgtcctcgcctccgacggacgccctaccgtcgacgacgccaccgacggccggcccgtcgggctcggtcccgtcggtacgaacggtcctacctacgacgacacgcgtacgnggacggcggcgtggaccgg

SEQ ID NO: 225418 - DNA, 396 bp, Homo sapiens
  misc_feature: GYAE6OF01ETYY9.36.33.C11.1.454.CMB.1.raw
  modified_base (386)..(396): a, c, t, g, unknown or other
  misc_feature (386)..(396): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcagcctccaccaagggcccatcggtccttcccctggccgccctgcctccaggagcacctccgagagcacgagccggccctgggctgcctggtcaaggctacttccagacagcgtactgacgcgggctggcaaggccgcagtgnnnnnnnnnnn

SEQ ID NO: 225419 - DNA, 387 bp, Homo sapiens
  misc_feature: GYAE6OF01D97B7.36.33.C11.1.454.CMB.1.raw
  modified_base (304)..(304): a, c, t, g, unknown or other
  misc_feature (304)..(304): n is a, c, g, or t
  modified_base (380)..(387): a, c, t, g, unknown or other
  misc_feature (380)..(387): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacaaggccttatattactgtgcgaaatattctgacgtcgtagcacctcgcccctattttgactactggggccagggaaccctggtcaccgtctcctcagcctccaccaagggcccatcggtcttcccctggcgccctgctccaggagcacctccganagcacagcggccctgggctgcctggtcaaggactacttccagacagcgtactgagcgggctggcaaggcgcatagnnnnnnnn

SEQ ID NO: 225420 - DNA, 541 bp, Homo sapiens
  misc_feature: GYAE6OF01BAFT7.36.33.C11.1.454.CMB.1.raw
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
  modified_base (526)..(526): a, c, t, g, unknown or other
  misc_feature (526)..(526): n is a, c, g, or t
  modified_base (535)..(535): a, c, t, g, unknown or other
  misc_feature (535)..(535): n is a, c, g, or t
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttatattactgtgcgaaatattctgacgtcgtagcacctcgcccctatttgactactggggccagggaccctggtccaccgtctcctcacgcctccaccgaagggccccagtccggtccttcccccgtggccgccctcgctccaggacgcaccctccgagacgcacacgccggccctgggctcgcctcggtcaaggtctactccngaccngccgtacnggagcgggntggacg

SEQ ID NO: 225421 - DNA, 391 bp, Homo sapiens
  misc_feature: GYAE6OF01DP0SP.36.33.C11.1.454.CMB.1.raw
  modified_base (388)..(391): a, c, t, g, unknown or other
  misc_feature (388)..(391): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgccccttattttgactacgtggggccagggaaccctggtccaccgtctcctcacgcctccaccaagggccccatccggtcttccccctggccgccctgctccaggagcacctccgagagcacagcggccctgggctgcctggtcaaggactacttccagacagcgtactgaggcggctggcaaggcgcatagnnnn

SEQ ID NO: 225422 - DNA, 439 bp, Homo sapiens
  misc_feature: GYAE6OF01A7LFW.36.33.C11.1.454.CMB.1.raw
  modified_base (411)..(411): a, c, t, g, unknown or other
  misc_feature (411)..(411): n is a, c, g, or t
  modified_base (419)..(439): a, c, t, g, unknown or other
  misc_feature (419)..(439): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacaaggccttatattactgtgacgaaatattctgacgtcgtagcacctcgccctattttgactactggggccagggaaccctggtcaccgtctcctcacgcctccacaagggcccatcggtccttccccctggccgccctgcctccaggacgcacctccgagacgccacgaggccggccctgggctcggccctgggtaccaagggactaaccttccgaacgacacggtccgtacgtggacgggtccggcgtgggcaagggcganacgtaggnnnnnnnnnnnnnnnnnnnnn

SEQ ID NO: 225423 - DNA, 772 bp, Homo sapiens
  misc_feature: GYAE6OF01BB4JK.36.33.C11.1.454.CMB.1.raw
  modified_base (274)..(274): a, c, t, g, unknown or other
  misc_feature (274)..(274): n is a, c, g, or t
tcagtacgctgtctcacgaccggtgctcgatttagagtgagctcgttggggtttgggggagggttggtacagcctggggggtccctgagactctcctgtgcagcctctggattcacctttagcagctatggcatggagctgggtccgcaggttccaggggaaggactgcaggtggtctcatctattagtgctagtggtggtactacatttccacgcagacctcccgtggacgggggccgtttcaacctatcctacagagacaattccgaagacncgaacgctagttaataccgtaacaaatcgaacctaaccgtaggagacggaccggagggaaccacggtcctttaagtacttaacgtcggttacgaacgttaaaattcttacgtcggaacggttcgtaacgtctaccgttccggtaaccccttgttttacgacgttaaaccggtggggtacccgtaaacgggtaacccctttgggtaccctaccgtttcccgtaccctacggaccgtcccgttaccccgaaaccggtaaccgggtccccttacgtacccgggtttccccttaccccggttccgggcccgtcccgtacgccttacccggacggacctccgtacccgtccggaaccggacgacccgtacggaaccggtccggaccccggtggacccggttagcccggttacggtaacccgtaaacgggtacccttacccgttaccgaacccggacgtacggtcccgttaacgcgggtaacgggcggtccgtacggaaccggg

SEQ ID NO: 225424 - DNA, 674 bp, Homo sapiens
  misc_feature: GYAE6OF01D4BPK.36.33.C11.1.454.CMB.1.raw
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccaggggaagggactgcaggtggtctcatctattagtgctaggtggtgtactacattcacgcagacctcccgtggacggggccgtttacactcagtcctaccgaagacgaacaacttaccgaaagacgccacgcttagtaactactaacaaatacgaacaaccgtgaagacgccggaaggacaccggtaccttatattactgtagacgtaaatattactagtacgtcgtacgccaccgtcgtacccttatttcgaacgttaccggtcggggaccgaacggggtaacccgttggtacccaccgttcctcccgtcaccgtccctaccgaacccgacgggtccctacgtcccggtcccttcccccgtcggcccgtccctcgcctccgaggacgaccgaccgtccggagacgtaccaccggacggcccggacccgtggtccgtcgcccgttacggtaaccgaacggtaccttaaccgttccgagtaaccacggtaccgtacgtacggacggcgggtacgtaccggg

SEQ ID NO: 225425 - DNA, 593 bp, Homo sapiens
  misc_feature: GYAE6OF01A5TA3.36.33.C11.1.454.CMB.1.raw
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (456)..(456): a, c, t, g, unknown or other
  misc_feature (456)..(456): n is a, c, g, or t
tcagtacgctgtctcacgaccggtgctcgatttagagtgagctcgttgggtttgggggaggggttggtacagccgtggggggtccctgagactctcctgtgcagcctctggattcacctttagcagctatggcatgagctgggtccgccaggttccagggaagggactgcagtgggtctcatctattagtgctagtggtggtactacattctacgcagactccctggaggggccgttcacatcncagagacaattccaagagcacgctgtaatctaacaaatgaacaacctgagacggccgaggacncggaccttatatactganacgaaatattcgngacgtcgtagccacctccgcccttatttcgaactacgtcggggccacgggtaaccctggtaccaccgtctacctcgacgtcctaccaccgaacggtccccagtccgttccttccccgngtccgccctcgcctaccaggcaccaccgtccgacgcgtacaccgaggcccggtcccgaggcccgtagccgtacggtacgaacggtaccttcctaccacggacacggtcgtaaccgtggaccggcggtcgtggaacgg

SEQ ID NO: 225426 - DNA, 592 bp, Homo sapiens
  misc_feature: GYAE6OF01CG9MU.36.33.C11.1.454.CMB.1.raw
  modified_base (267)..(267): a, c, t, g, unknown or other
  misc_feature (267)..(267): n is a, c, g, or t
  modified_base (447)..(447): a, c, t, g, unknown or other
  misc_feature (447)..(447): n is a, c, g, or t
  modified_base (468)..(468): a, c, t, g, unknown or other
  misc_feature (468)..(468): n is a, c, g, or t
  modified_base (580)..(580): a, c, t, g, unknown or other
  misc_feature (580)..(580): n is a, c, g, or t
tcagtacgctgtctcacgaccggtgctcgatttagagtgagctcgttggggtttgggggagggttggtacagcctggggggtccctgagactctcctgtgcagcctctggattcacctttagcagctatggcatgagctgggtccgccaggttccagggaagggactgcaggtgggtctcatctattagtgctagtggtggtactacattctacgcagacctccctggacggggccggttcaccatcctccagagacaattccaagngcacgctgtatctaacaaatgaacaacctgagagccgaggacacggccttatattactgtgacgaaatattctgacgtcgtagcacctccgccccttatttcgacttacgtcgggccacgggaccctggtaccaccgtctcctcacgccctccacgacgggcccagtccgtcctccccgnggcctccctcgctccgaggcnccaccgtccgagcgccacgacggccggcccgtgggcctcggccgttgggtaccaacggtaccttaccgttacccgagtaaccgcggtaccgtaacgtgggaacggccggggngtcgggaaccgg

SEQ ID NO: 225427 - DNA, 646 bp, Homo sapiens
  misc_feature: GYAE6OF01BPSPL.36.33.C11.1.454.CMB.1.raw
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagacctccctggacggggccggttcaccatcctccagagacaattccaagacgcacgctgtatactaacaaatagaacaacctgagagccgaggacacggccttaatattactgtagacgtaaattattctagtacgttcgtagccacctccgtaccccttatttcgaccgttacgtcggggaccgacgggtaacccgtggtacctacccgttctccctcgacgcccctaccgaacccgaacgggccccctacgttcccggttaccctttccccccgtgggcccgtcccctcgccctccgacggacgcctacccgtccgagacgccacgacggccggaccgtcggcgtcgccgtggtaccgaacgggtacccttacgttccgaacgaccgtacgtccggttacgacggacgggccgggtcgtcgggaaccgg

SEQ ID NO: 225428 - DNA, 397 bp, Homo sapiens
  misc_feature: GYAE6OF01BNY1K.36.33.C11.1.454.CMB.1.raw
  modified_base (293)..(293): a, c, t, g, unknown or other
  misc_feature (293)..(293): n is a, c, g, or t
  modified_base (382)..(397): a, c, t, g, unknown or other
  misc_feature (382)..(397): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcagcctccaccaagggcccatcggtcttccccctggcgccctgctccagngcacctccgagagcacagccggccctgggctgcctggtcaaggactacttccagacagctactgagcgggctggcaagggcgcatagcnnnnnnnnnnnnnnnn

SEQ ID NO: 225429 - DNA, 449 bp, Homo sapiens
  misc_feature: GYAE6OF01DHVAX.36.33.C11.1.454.CMB.1.raw
  modified_base (436)..(449): a, c, t, g, unknown or other
  misc_feature (436)..(449): n is a, c, g, or t
tcagtacgctgtctcacgaccggtgctcgatttagagtgagctcgttgggtttgggtgccgaagttgctgggaggggccggttcaccatctccagagacaattccaagagcacgctgtatctacaaatgaacaacctgagagccgaggacacggccttatattactgtgacgaaatattctgacgtcgtagccacctcgccccttattttgactacgtggggccagggaaccctggtccaccgtctcctcacgccctccaccgaacgggccccagtccggtccttccccccgtgggccctccccgtgccctccgagggacgccaccctcggagagcacgacgccggcccgtgggctcgccgtggtaccaaggtaccttacctccagaccagccgtacgtggacggccgggctggggacaacgggccgactagtagnnnnnnnnnnnnnn

SEQ ID NO: 225430 - DNA, 878 bp, Homo sapiens
  misc_feature: GYAE6OF01EAKAR.36.33.C11.1.454.CMB.1.raw
  modified_base (662)..(662): a, c, t, g, unknown or other
  misc_feature (662)..(662): n is a, c, g, or t
  modified_base (773)..(773): a, c, t, g, unknown or other
  misc_feature (773)..(773): n is a, c, g, or t
tcagtacgctgtctcacgaccggtgctcgatttagagtgagctcgttgggtttgggagggttggtacagccgtggggggtccctgagactctcctgtgcagcctctggattcacctttagcagctatggcatggagcgtgggtccgccaggttccgaggggaagggactgcgaggtgggtctcatctattagtgctaggtggtcgtactacattctaacgcagtacctcccgtgggacggggtccgttacaaccgacttcctaccagaacgtaactaaacttaccgaaagacgaccgaacgtcttacgttaacttaaccttaaaactaaaacgtaacgaaaaccaaacccgttaggaacggaacggacccggaagggaaccgtaaccgggtaccttttaattaacgtttaaccgtaggttacgaaacgttaaaatttacgtttacgttacggtaacggttaccggtacgacccgtaccccgttcccgtaccccgtttaacgttttacgaaccgttaccgggtaccgggggtacccgtaaaccggggtaaccccgttcgggtaccccttacccggttacccttacccgtacgacccgtacccctacccgaaaccggtaaccggggtccccctaacggttccccggtttccccgttacccccgngggtacccccgtcccgttcgacccgttacccggaacggtccgtaacccgtacccggtacgaacggacccacccgaaccggcccgggtcccgggttcccgacggggttcccnccggtaccgttacgggtaaccgaaacggttaccccttacggtacccaaacggacccaacgggtaccggttaacgtcgggagggtccccgggtgtacgggaacccg

SEQ ID NO: 225431 - DNA, 928 bp, Homo sapiens
  misc_feature: GYAE6OF01D6BNT.36.33.C11.1.454.CMB.1.raw
tcagtacgctgtctcacgaccggtgctcgatttagagtgagctcgttgggtttgggggagggttggtacagccgtgggggtccctgagactctcctgtgcagcctctggtattccacctttagcagctagtggcagtggagcgtcgggtcccgccgtaaggttccggaaggggaagggactggacgaggttcggtcctactattcgttaagttaggtgtacgttaggtggttacggtactactacttcgacgccaacgtccgtccggtagggaccggggtccgttaccaaccgtacttcccgaccgaaggaacgtaacttaaaccgttaccgaaagaccgtaccgtaccgtgttaacgtaactaaccgtaaaacgtaaaacgtaccgaaaacctaaccggtaggaaacggtaccgggaacccggaacggtaacccgttaaaccggtttacctttaaacgttaacgtttaccgttacggtaacgtaaaacggttaaaactttcgtttaccgtaacgggttaaccgttaccggtaacctaaccccgttaaccgtttaccccggtaccctttttaacggttacggtaacccggttaccgggttaacccggggaacccgttaaacccgggtaccccgttacggtaaccccttcccggtaccctacccgtaaccgaccccgtacccgttaccccgaaaccgggtacccggtaccccgttaccggtttccccttacccgttcccccggcgtacccccgtccgtcccgtaccgtaccggaacggtcccaccgtaacccggtcgaacgaccgaccggtaccgacccgggtccggcgtacgggctaccggtaccgtacgtaacgaaccgtcccttacgaccggtaaggaccgtaccgggtcccgtaaggcccgggaggtcccggtgaaccggtacgg

SEQ ID NO: 225432 - DNA, 825 bp, Homo sapiens
  misc_feature: GYAE6OF01EMC21.36.33.C11.1.454.CMB.1.raw
tcagtacgctgtctcacgaccggtgctcgatttagagtgagctcgttggggtttgggggagggttggtacagcctggggggtccctgagactctcctgtgcagcctctggattctacctttagcagctatggcatgagcgtgggtccgccaggttccaggggaagggactggcaggttgggtctcattcttattagtgcgttaggtggtggtactactattcgtacgcagaccttcccgtgggacgggtccgttaccaacctacttccgtaccaggaacgtaacctaaacgttacccgaaagtagacaccggtcttaggtaactacttaaaccaaatacgaaacctaaccgttaggacggacgaccggaacggacctaaccgggtacctttaatttaacttacgttgtacggtaacgtaaatttacttcgttacggaccgttaccgtaggtaccctacccgttcccgtaccctttaacgtttttcgaacccgttacggtacgggggtaccggtaaaccgggtaacccggtttccggtaccgttaccccgtccgtttacccgtaccacccggttacccctacccgaacccggtaaccggtaccccgtacgtttccccggttaccccgttcccccggtcggtccccgtccccgtcggtacccgtaccggtaacggaccgtcccgtaacccgtaccggaaccggttaccgaaccgtaaccgaccgggtcccggtacccgggtcgtaccggtcccggtcgtacggtaccgtaaacggtacctacgtacgacgacgagtacccgtcgaggtacggccggtggtacgacgg

SEQ ID NO: 225433 - DNA, 823 bp, Homo sapiens
  misc_feature: GYAE6OF01DA6B9.36.33.C11.1.454.CMB.1.raw
tcagtacgctgtctcacgaccggtgctcgatttagagtgagctcgttgggtttgggagggttggtacagccgtggggggtccctgagactctcctgtgcagcctctggattcaccttttagcagctatggcatgagcgttcgggtcccgccgtagggttccgaaggggaagggactgcgaggttggtctcattcttattagtgtcgttaggtggtgtactactattcgtacgcacgtaccttccgtgggtacggggtcccgttcaccgtactcctacgaagacgtaactaacgttacccaaagacgtaccacgtctagtactacgtaacaatacgaaccaacgtagacggacgacggtaaggaccgtaccgtactttaacgtattacgtagtacgtaataaagtcttacgtacggtaccgtacgaccgtaccctacccgttccgtaccctttagtttacggaacgttaccgggtccgggtaccggaaccgggttacccgcggttcccgtaaccgtccgttcccgaccgtacccgtaccctacccgaaaccgccgggtacccccgttcgtacccgggttccccgttcccgtccggaccccgttccgtaccgtccctacggacgggtactaccccgtaaccggtacccggaacgaacccggtaccggaaccggtacccgggtccccgggtaccgggttcccggggcttacccggttacccggttacgggaacccgttaaaccgggtaaacccctttacgttacccggaacggtaacccgcggtaacccgttacggagggtacccgggccgggcgtacggaacggg

SEQ ID NO: 225434 - DNA, 718 bp, Homo sapiens
  misc_feature: GYAE6OF01BDY61.36.33.C11.1.454.CMB.1.raw
  modified_base (626)..(626): a, c, t, g, unknown or other
  misc_feature (626)..(626): n is a, c, g, or t
tcagtacgctgtctcacgaccggtgctcgatttagagtgagctcgttgggtttgggggagggttggtacagccgtggggggtccctgagactctcctgtgcagcctctggattcacctttagcagctatggcatggagcgtcgggtccgcctaggttccgaaggggaagggctgcgaggtgggtctcattcttaattagtgcttaggtggtgtactactattctacgcagacctcccgtggacggggtccgttacacctatcctccgaagacgaactaacttaccgaaagacgaccgaacgtcttagttaactacctaaactaaactacgaaaccaaccgtaggaacgacggaccggaaggacctaccggtacctttaatacgtttacgtgtaagacgtaaattagttctagaccgtcgtacgacctaccttccgtaccctttaagtttcgaaccggttacggtcggggtaacccacggggtaacctcggtacctaccgttcctcctaccgacgtcccctaccaacggtaccggccctacggttcccgtaccctcccgcggcccgccctgtcccaccggacggaccgccctaccggtcgaagccggacctacgcgggccctccggngtccgtcggtcggtacggtaaccgaccgtccgttaccgtaacccgagacccgtaggtaaccgtacgagggaccgggcgcggtagggaacccg

SEQ ID NO: 225435 - DNA, 793 bp, Homo sapiens
  misc_feature: GYAE6OF01AHHKV.36.33.C11.1.454.CMB.1.raw
tcagtacgctgtctcacgaccggtgctcgatttagagtgagctcggttgggtttgggggagggttggtacagccgtggggggtccctgagactctcctgtgcagcctctggattcaccttttagcagctagtggcatggagcgtcggggtcccgccgtacgggttccgaaggggaagggactggccaggtgggtctcattctagtttagtgtcgtaggttggtaggttacctactattcctaacgctaacgacctcccgtagggaccggggtccgttaccaaccgtagtcccgtaccgaaggacgtaacctaacttaccgaagacgccacgtcttagtaactacctaacaaagtacgaaaccaccgtagacgacgaccggaggaccgtacgtacgttatacgttactggtacgaacgtaaattcgttcgtacggtacgtcgtacgccctaccgttcctacccgtttaagtttccgaacgtccggtcgggaacccgtacgggtaacccttggtacccgtccgttcccgtaccgtaccgacccgtaccccgtaccgaccggaccggtaccccttacggtcccgttcccgttccccgacgcccgttaccctcggtccaccggtacggacgcccgtaacccgccggtaacgcggtacccgtaaccgccgggtcccgggtaccccggtcgggtaccttacccggtccggttacggtaacccggtaacgtaccccgttacgttacccgacgttaacgacccggtacgttacggacgggaggcccggtcggtcggaacgg

SEQ ID NO: 225436 - DNA, 197 bp, Homo sapiens
  misc_feature: GYAE6OF02GX5XN.36.33.C11.1.454.CMB.1.raw
  modified_base (194)..(197): a, c, t, g, unknown or other
  misc_feature (194)..(197): n is a, c, g, or t
tcagtacgctgtctcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccagacagcgtactgagcgggctggcaaggcgcatagnnnn

SEQ ID NO: 225437 - DNA, 591 bp, Homo sapiens
  misc_feature: GYAE6OF02JA9KO.36.33.C11.1.454.CMB.1.raw
  modified_base (350)..(350): a, c, t, g, unknown or other
  misc_feature (350)..(350): n is a, c, g, or t
  modified_base (442)..(442): a, c, t, g, unknown or other
  misc_feature (442)..(442): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (473)..(473): a, c, t, g, unknown or other
  misc_feature (473)..(473): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (588)..(588): a, c, t, g, unknown or other
  misc_feature (588)..(588): n is a, c, g, or t
tcagtacgctgtctcacgaccggtgctcgattttagagtgagctcgttggggttttgggtgccgaagttgctgggaggggcccggtttcacccagtctcccaaggacgtaccaatttccgaagagcacgctgtatctacaatgaaccaacctgaggagccggaggacacggccttagtttacttacttgtgtacgttaaagtagtttctcgaacgttcgttagcgtacctcgaccccttagtttttggacttactggggaccagggaaccctggtccacgtctccgtcagccctcaccaaggcccatcggtcttcccctggccgccctgcttccaggtagctactccgangcacaggccgcctgggctcgccgtggtcaagggacttacgttccgagacagaccgtatgaggacgggactaaggcaagggcgactagtaggngagcgatcgacatcncagnacacgacacganacactatatctnacanacgacacgacacgacgacgacgacgacgacgtcgtagtactacgtacgtcgtcgtacgacgagtacgtacgtacgtacgtacgttacgtacgttacgtntcg

SEQ ID NO: 225438 - DNA, 561 bp, Homo sapiens
  misc_feature: GYAE6OF02IUFSX.36.33.C11.1.454.CMB.1.raw
  modified_base (317)..(317): a, c, t, g, unknown or other
  misc_feature (317)..(317): n is a, c, g, or t
  modified_base (449)..(449): a, c, t, g, unknown or other
  misc_feature (449)..(449): n is a, c, g, or t
tcagtacgctgtctcacgaccggtgctcgatttagagtgagctcgttgggtttgggggagggttggtacagcctgggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttatattacngtgacgaaatattctgacgtcgtagcacctcgcccctattttcgactactgggccagggaaccctggtcaccgtctcctcagcctccaccaaggcccatccggtcttcccctggccgccctgctccaggacnccacctccgagacgccacacgccggcccgtggcctcgcccgtggtaccgaacggaccttaccttccgaacggaccacggccgttacgtcggacggccgggtctgggaaccgg

SEQ ID NO: 225439 - DNA, 556 bp, Homo sapiens
  misc_feature: GYAE6OF02H16CD.36.33.C11.1.454.CMB.1.raw
  modified_base (314)..(314): a, c, t, g, unknown or other
  misc_feature (314)..(314): n is a, c, g, or t
tcagtacgctgtctcacgaccggtgctcgatttagagtgagctcgttgggtttgggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccgttcaccatctccagagacaattccaagagcacgctgtatctacaaatgaacaacctgagagccgagacacggccttatattacngtgcgaaatattctgacgtcgtagcacctcgccctattttgactactgggccaggaaccctggtcaccgtctcctcacgcctccaccaacgggcccatcggtccttcccctggccgccctgctcccaggcgaccacctccgacgacgccacgacgccgcccgtgggcctcgcctcggtccgaacggccttaccttccaacgtaccgacggtcgtaccgtgaacggccgggtccgtggaccgg

SEQ ID NO: 225440 - DNA, 512 bp, Homo sapiens
  misc_feature: GYAE6OF02GEKSY.36.33.C11.1.454.CMB.1.raw
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
tcagtacgctgtctcacgaccggtgctcgatttagagtgagctcgttgggtttgggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaccctggtcaccgtctcctcagcctcaccaggcccatcggtctccccnggccgcctgctccagcncacctccgagacgcacagcgccctgggctgcctgcaggactacttccagacagcgtactgagcgggctggacg

SEQ ID NO: 225441 - DNA, 566 bp, Homo sapiens
  misc_feature: GYAE6OF02HPJAL.36.33.C11.1.454.CMB.1.raw
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttatattactgtgcgaaaatattctgacgtcgtagcacctcgcccctattttgactactggggcagggaccctggtcaccgtctcctcagcctccaccaacgggcccactccggtccttcccccgtcggccaccctccctacaaacgacgccacctcgtcgggggcaccgacgccggcccctggggcctgccctggtaccaacgggtacctaccgttccaagaccagccgtactcggacgccgggctggcgaaggccg

SEQ ID NO: 225442 - DNA, 387 bp, Homo sapiens
  misc_feature: GYAE6OF02JFDYH.36.33.C11.1.454.CMB.1.raw
  modified_base (377)..(387): a, c, t, g, unknown or other
  misc_feature (377)..(387): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcagcctccaccaagggcccatcggtctcccctggcgccctgctccaggagcacctccgagagcacagcggccctgggctgcctggtcaaggctactccagacagcgtactgagcgggctggcaaggcgcatagnnnnnnnnnnn

SEQ ID NO: 225443 - DNA, 540 bp, Homo sapiens
  misc_feature: GYAE6OF02HOQTY.36.33.C11.1.454.CMB.1.raw
  modified_base (312)..(312): a, c, t, g, unknown or other
  misc_feature (312)..(312): n is a, c, g, or t
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttanattactgtgcgaaatattctgacgtcgtagcacctcgcccctatttgactactgggccaggaaccctggtcacgtctcctcacgcctccaccaacgggcccatccggtccttccccctggccgccctgcctcccgaggacgccaccctccgagacgccacacgccggcccgtggcctgcctggtcaacggactacttccagacagcgtactgaggcgggctggaccgg

SEQ ID NO: 225444 - DNA, 390 bp, Homo sapiens
  misc_feature: GYAE6OF02JGZ7I.36.33.C11.1.454.CMB.1.raw
  modified_base (381)..(390): a, c, t, g, unknown or other
  misc_feature (381)..(390): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaacccctggtcaccgtctcctcagcctccaccaagggcccatcggtcttcccctggcgccctgctccaggagcacctccgagagcacagcggccctgggctgcctggtcaaggactacttccagacagcgtactgagcgggctggcaaggcgcatagnnnnnnnnnn

SEQ ID NO: 225445 - DNA, 387 bp, Homo sapiens
  misc_feature: GYAE6OF02F47C0.36.33.C11.1.454.CMB.1.raw
  modified_base (380)..(387): a, c, t, g, unknown or other
  misc_feature (380)..(387): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaccctggtcaccgtctcctcagcctccaccaagggcccatcggtcttccccctggcgccctgctccaggagcacctccgagagcacagcggccctgggctgcctggtcaaggactacttccagacagcgtactgagcgggctggcaaggcgcatagnnnnnnnn

SEQ ID NO: 225446 - DNA, 542 bp, Homo sapiens
  misc_feature: GYAE6OF02F7NHA.36.33.C11.1.454.CMB.1.raw
  modified_base (526)..(526): a, c, t, g, unknown or other
  misc_feature (526)..(526): n is a, c, g, or t
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttatattactgtgcgaaatattctgacgtcgtagcacctcgccctatttgactactgggccagggaaccctggtcaccgtctcctcacgcctccaccaacgggcccatccggtccttcccctcggccgccctcgcctcccaggacgccacccgtccgagacgcacacgtcggccctgggcctgcctggtcgaaggctacttccgagacgacgcgtacngacggcgggctggacg

SEQ ID NO: 225447 - DNA, 609 bp, Homo sapiens
  misc_feature: GYAE6OF02HG8FV.36.33.C11.1.454.CMB.1.raw
tcagtacgctgtctcacgaccggtgctcgatttagagtgagctcgttgggtttgggagggttggtacagcctggggggtccctgagactctcctgtgcagcctctggattccccttcagtgactactggatgcactgggtccgccaagctccagggaaggggctggtgtgggtctcacgtattagtagtgatgggagttacacaactaatgtggagtccgtggagggccgattcaccatctccagagacaacgccaaagaacacgctgtatctgcaaaatgaacagtctgagagccgaggacacggctgtgtattattgtgactaacgtttcgggatttaggttggacccgacgcgacaagtggggaccacggggaaccctggtccaccgtctccctcacgccctccaaccgaacgggcccacgtccggtccttcccccgtcggcccgccctcgcctcccgaggaccgccacccgtccgacgacgccacgacgccggcccgtcgggcctcggccgtggtaccgaaacggtaccttaccttcccgacgaccgacggccgtaacgtcggacggccgggacgtcgggaccgacgggaccggacgacgtagcg

SEQ ID NO: 225448 - DNA, 392 bp, Homo sapiens
  misc_feature: GYAE6OF02IVMV9.36.33.C11.1.454.CMB.1.raw
  modified_base (380)..(392): a, c, t, g, unknown or other
  misc_feature (380)..(392): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcagcctccaccaagggcccatcggtcttcccctggcgccctgcctccaggagcacctccgagagcacagcggccctgggctgcctggtcaaggctacttccagacagcgtactgagcgggctggcaaggcgcatagnnnnnnnnnnnnn

SEQ ID NO: 225449 - DNA, 543 bp, Homo sapiens
  misc_feature: GYAE6OF02G8WP2.36.33.C11.1.454.CMB.1.raw
  modified_base (455)..(455): a, c, t, g, unknown or other
  misc_feature (455)..(455): n is a, c, g, or t
tcagtacgctgtctcacgaccggtgctcgatttagagtgagctcgttgggtttgggggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccggttcaccatctccagagacaattccaagagcacgctgtatctacaaatgaacaacctgagagccgaggacacggccttatattactgtgcgaaatattctgacgtcgtagcacctcgcccctattttcgactactgggccagggaaccctggtccaccgtctcctcacgcctccaccaacgggcccatccggtccttccccctggccgccctgcctccaggcnccaccctccgagacgccacacgccgccctgggcctgcccgtggtcaacgggctaccttccagacagcgtactgacggcgggctggacg

SEQ ID NO: 225450 - DNA, 485 bp, Homo sapiens
  misc_feature: GYAE6OF02JV3YJ.36.33.C11.1.454.CMB.1.raw
  modified_base (242)..(242): a, c, t, g, unknown or other
  misc_feature (242)..(242): n is a, c, g, or t
  modified_base (325)..(325): a, c, t, g, unknown or other
  misc_feature (325)..(325): n is a, c, g, or t
  modified_base (431)..(431): a, c, t, g, unknown or other
  misc_feature (431)..(431): n is a, c, g, or t
  modified_base (433)..(434): a, c, t, g, unknown or other
  misc_feature (433)..(434): n is a, c, g, or t
  modified_base (436)..(485): a, c, t, g, unknown or other
  misc_feature (436)..(485): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccaggaccctggtcaccgtctcctnacgccctccaaccgaacgggcccagtccggttcccttcccccgtggcccgcccgtgcctccgaggacgccacccgtccgagcnccacacggccgtcccgtgggcctcggcctgggtaccaaagggtcccttacgttccagacacggtcgtactggacggcgggactgggacgaagggccacgagtagcngnngnnnnnnnnnnnnnnnnnnnnnnnnnnnnnnnnnnnnnnnnnnnnnnnnnn

SEQ ID NO: 225451 - DNA, 648 bp, Homo sapiens
  misc_feature: GYAE6OF02IQMZF.36.33.C11.1.454.CMB.1.raw
  modified_base (259)..(259): a, c, t, g, unknown or other
  misc_feature (259)..(259): n is a, c, g, or t
  modified_base (328)..(328): a, c, t, g, unknown or other
  misc_feature (328)..(328): n is a, c, g, or t
tcagtacgctgtctcacgaccggtgctcgatttagagtgagctcgttgggtttgggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctgaggggccgttcaccatctccagagacaattccaagancacgctgtatctaacaaatgaacacctgagagccgaggacacggccttatacttactgtgacgtaaatnttctagaccgttcgtagctacctccgtccccttattttacgacttacgtcggggaccaacggggaacccttggtcctacccgtctccctcacgtccctccaaccgacgggccctacgtccgttccttccccccgtggcccgtcccgtcgtcctacccgaggaccgcccacccgtccgaagacgtccaccgaccggaccggtcccgttcggggcccttcgggcccgttcgggtaaccgtaaacgggtaccctttaacccgttccgaaccggtaccgacggtaccggttaccgtggaaccggtcgggtccgtaggaacccgg

SEQ ID NO: 225452 - DNA, 537 bp, Homo sapiens
  misc_feature: GYAE6OF02F8PSP.36.33.C11.1.454.CMB.1.raw
  modified_base (441)..(441): a, c, t, g, unknown or other
  misc_feature (441)..(441): n is a, c, g, or t
tcagtacgctgtctcacgaccggtgctcgatttagagtgagctcgttgggtttgggggaggcttggtacagcctggcaggtccctgagactctcctgtgcagcctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgcaaaagattttgagtttagagtagtaagggtctactactacggtatggacgtcgtgggccaagggaccacggtcaccgtctcctcagcctccaccaaggcccatccggtctcccctggccnccctgcctccgaggacgccacccgtccgagacgcacgagccgggccctgggcctagcccgtggtccaaggccttacgttcccagaccaggcgtacg

SEQ ID NO: 225453 - DNA, 624 bp, Homo sapiens
  misc_feature: GYAE6OF02IHXUA.36.33.C11.1.454.CMB.1.raw
tcagtacgctgtctcacgaccggtgctcgatttagagtgagctcgttgggtttgggggagggttggtacagcctgggggggtccctgagactctcctgtgcagcctctggattcaccttttagcagctatggcatgagctgggtccgccaggttccagggaagggactgcagtgggtctcatctattagtgctagtggtgtactacattctacgcagactcctgaggggccgttcaccatctccagagacaatccaagagcacgctgtatctaacaaatgaacaacctgagagccgaggacacggtccttatattactgtgacgaaatattctagacgtcgtagccacctcgaccccttattttgacttacgcgggccacggaaccctggtccacccgtcctcctcacgccctccaaccgaacgggcccaagtcccggtcccttcccccgtggccgtccctcgcctccgacgggtcaccgtacccgtccgacgacgaccaaccgacggcccggtccccgtggggcctcggcccgttcgggtaccgaaacggtcccttaaccgttacccgaagacccgacggtaccgttaccgtacgggacgggccgggtacgtcgggaacccgg

SEQ ID NO: 225454 - DNA, 413 bp, Homo sapiens
  misc_feature: GYAE6OF02G81GR.36.33.C11.1.454.CMB.1.raw
  modified_base (284)..(284): a, c, t, g, unknown or other
  misc_feature (284)..(284): n is a, c, g, or t
  modified_base (381)..(381): a, c, t, g, unknown or other
  misc_feature (381)..(381): n is a, c, g, or t
  modified_base (387)..(391): a, c, t, g, unknown or other
  misc_feature (387)..(391): n is a, c, g, or t
  modified_base (393)..(413): a, c, t, g, unknown or other
  misc_feature (393)..(413): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcagcctccaccaagggccccatccggtcttccccctggccnccctgctccaggacgccacctccgagagcacagccggccctgggctgcctggtcaagctacttccaagcagcgtactggacgcgggctggcaaggcncatagnnnnncnnnnnnnnnnnnnnnnnnnnn

SEQ ID NO: 225455 - DNA, 741 bp, Homo sapiens
  misc_feature: GYAE6OF02ICZKK.36.33.C11.1.454.CMB.1.raw
  modified_base (328)..(328): a, c, t, g, unknown or other
  misc_feature (328)..(328): n is a, c, g, or t
tcagtacgctgtctcacgaccggtgctcgatttagagtgagctcgttgggtttgggggagggttggtacagcctggggggtccctgagactctcctgtgcagcctctggattcaccttttagcagctatggcatgagctgggtccgccaggttccagggaaggactgcagtggtctcatctattagtgctagtggtggtactacattctacgcagactccctggacggggccgttcaccatctccagagacaaccgcgaagaacacgctagtatctgcaaaatgaacagtctagagacgccggaggaccacggctgtagtattattgngactaacgtttcgggatttaggtggaacccgcgcgacaagtcggggaccaacggggaaccccttggtaccacccgttctacccgtacaccggtaccctacccgaacccggtaaaccgggaccccctaacgttacccggttcccgtttccccccgtcgggccccgtcccccgtacgtcccttacccggaacgggaacggaccccgtaacccgttcccggaacggaacgacccgaaccgaaccgggccccgggtccccggttcggggaccttccgggtacccgtacggggttaacccgtaaacgggtaaccctttaccgttaacccgtaaccggaacccgtacggtacccgttaaccgtacgggtaccgggtaccgggggacccgttacggggaccgaacggggacccgaaccgg

SEQ ID NO: 225456 - DNA, 445 bp, Homo sapiens
  misc_feature: GYAE6OF02I4H8N.36.33.C11.1.454.CMB.1.raw
  modified_base (379)..(379): a, c, t, g, unknown or other
  misc_feature (379)..(379): n is a, c, g, or t
  modified_base (411)..(445): a, c, t, g, unknown or other
  misc_feature (411)..(445): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaaccctggtcaccgtctcctcacgcctccaccgaagggccccatccggtccttccccctgggccgcccctggcctcccgaggacgccaccctccgagagccacaggccggcccgtggggctcgccgtggtcaaaggcctactccagacagcgtacnggagcggggctggacgaaggccgactagtagnnnnnnnnnnnnnnnnnnnnnnnnnnnnnnnnnnn

SEQ ID NO: 225457 - DNA, 610 bp, Homo sapiens
  misc_feature: GYAE6OF02JCSKD.36.33.C11.1.454.CMB.1.raw
  modified_base (331)..(331): a, c, t, g, unknown or other
  misc_feature (331)..(331): n is a, c, g, or t
  modified_base (400)..(400): a, c, t, g, unknown or other
  misc_feature (400)..(400): n is a, c, g, or t
  modified_base (452)..(452): a, c, t, g, unknown or other
  misc_feature (452)..(452): n is a, c, g, or t
tcagtacgctgtctcacgaccggtgctcgatttagagtgagctcgttgggtttgggaggttggtacagcctggggggtccctgagactctcctgtgcagcctctggattcacctttagcagctatggcatgagctgggtcccgccaggttccaggggaagggactgcaggtgggtctcatctattagtgctagtggtgtactacattctacgcagactcctgacggggccgttcacatctccagagactattccaagacacgctgtatggtagcaaatgaaactacgcctaggacgacgccggaaggcgacggtcctaggtgtacttacgngtagacgagacgaccgcctacgtccgcctacccgttaggtcgggttaccggggagttacggccctaagngtacgggccgtcggtaggggacaaacgggcgtaccgtcgaccgtctccgacncgcctaccaccgacggccacgtccgtcctaccccgtcggacctacccgtcctacgaacgtcaccgtacgtcgtcgggaccacgacggtccgaccgtcgggtctcggccgttgacgaaccgtactaccgttacgagtaccgagtccgtactggtaacgg

SEQ ID NO: 225458 - DNA, 394 bp, Homo sapiens
  misc_feature: GYAE6OF02GCFVE.36.33.C11.1.454.CMB.1.raw
  modified_base (383)..(394): a, c, t, g, unknown or other
  misc_feature (383)..(394): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgccccttattttgactacgtggggccagggaaccctggtcaccgtctcctcagcctccaccaagggcccatcggtcttccccctgcgccctgctccaggagcacctccgagagcacagcggcctgggctgcctggtcaaggactacttccagacagcgtactgacgcgggctggcaaggcgcagtagnnnnnnnnnnnn

SEQ ID NO: 225459 - DNA, 397 bp, Homo sapiens
  misc_feature: GYAE6OF02I66S3.36.33.C11.1.454.CMB.1.raw
  modified_base (385)..(397): a, c, t, g, unknown or other
  misc_feature (385)..(397): n is a, c, g, or t
tcagtacgctgtctcacgaccggtgctcgatttagagtgagctcgttggggtttgggtgccgaagttgctggaggggccggttcaccatctccagagacaattccaagagcacgctgtatctacaaatgaacaacctgagagccgaggacacggccttatattactgtgacgaaatattctgacgtcgtagcacctcgccccttattttgactactggggccagggaaccctggtcaccgtctcctcagcctccaccaaggcccatccggtcttccccctggcgccctgcctccaggagccacctccgagagcacagccggccctggctgcctggtcaaggctacttccagacagcgtactgagcgggctggcaaggcacatagnnnnnnnnnnnnn

SEQ ID NO: 225460 - DNA, 755 bp, Homo sapiens
  misc_feature: GYAE6OF02HQJU7.36.33.C11.1.454.CMB.1.raw
  modified_base (245)..(245): a, c, t, g, unknown or other
  misc_feature (245)..(245): n is a, c, g, or t
tcagtacgctgtctcacgaccggtgctcgatttagagtgagctcgttgggtttgggagggttggtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctggacggggtccggttcaccatccnccagagacattccaagagcacgcttgatcaacaaatcgaaacaacctgagacgaccgaggaccacggaccttaatatttactggtagacgaaaattattctaggtactcggtagcctaccctcgtccccttatttcgacttacgtggggccctaacggggacccttgggtccacccgttcctccgtacaccgcccgtacccctaaccgaaccgggtcccctacgttccgggttaccccttcccccggtggaccccggtcccgttccgccgttacccgaagggtaccgacccaccgttacccgggaacgtaaccggcccaaaccggaaccggcccccgggtaccccgggttacggggccctttcccggggcccgtttacggggttaacccgtaaaaccgggttccccgtttaacccgttttaccccggaaacggtaaccccggtagggtaaccccggttaacccggttagggaacccggggtcccgggggtaccgttaccggggacccggg

SEQ ID NO: 225461 - DNA, 413 bp, Homo sapiens
  misc_feature: GYAE6OF02GU4VR.36.33.C11.1.454.CMB.1.raw
  modified_base (292)..(292): a, c, t, g, unknown or other
  misc_feature (292)..(292): n is a, c, g, or t
  modified_base (374)..(374): a, c, t, g, unknown or other
  misc_feature (374)..(374): n is a, c, g, or t
  modified_base (376)..(413): a, c, t, g, unknown or other
  misc_feature (376)..(413): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgccccctatttgactactggggccagggaaccctggtcaccgtctcctcagcctccaccaagggcccatcggtcttcccctgccgcctgctccaggncacctcgagagcacagccgcctggctgcctggtcaaggactacttccagacagcgtactgagcggctggcaaggcgcatagnannnnnnnnnnnnnnnnnnnnnnnnnnnnnnnnnnnnnn

SEQ ID NO: 225462 - DNA, 733 bp, Homo sapiens
  misc_feature: GYAE6OF02FKCGK.36.33.C11.1.454.CMB.1.raw
  modified_base (264)..(264): a, c, t, g, unknown or other
  misc_feature (264)..(264): n is a, c, g, or t
  modified_base (357)..(357): a, c, t, g, unknown or other
  misc_feature (357)..(357): n is a, c, g, or t
tcagtacgctgtctcacgaccggtgctcgatttagagtgagctcgttgggtttgggggagggttggtacagcctgggggtccctgagactctcctgtgcagcctctggattcacctttagcagctatggcatgagctgggtccgccaggttccagggaagggactgcagtgggtctcatctattagtgctagtggtggtactcattctacgcagacctcccgtgacgggccggttccacccatctccagacgacaattccaagngcacgctgtatctaacaactgaaccacctggactacggccgaggtacacggcctatactactacgttaacgaaatcggaccctagaacgttancgtaacttacgttagttcgggactaggttacttcgaattcctacggtcggggggtcccgtggcccgtacccgtgggtcctaacgttcggtacctcccgttacgtaaccgtcccccgttaccccgaacccgtaaaccggggtcccccaccgttacccggtttccccgttaccccccccgttcgggtccccgtacccccgttcgggacccctttcccggaaccgggtaccgaacccgtaccccgttacccgggaaacgtccgggaccctaacgacgggtcccgggtccccgtacgggccttcggtcccggttacggtacctaaacgggtacctaaccgttacccgacgtaacccgaggtccgtacgttggacccgggg

SEQ ID NO: 225463 - DNA, 567 bp, Homo sapiens
  misc_feature: GYAE6OF02FPRYG.36.33.C11.1.454.CMB.1.raw
  modified_base (496)..(496): a, c, t, g, unknown or other
  misc_feature (496)..(496): n is a, c, g, or t
tcagtacgctgtctcacgaccggtgctcgatttagagtgagctcgttgggtttggggggagggttggtacagcctggggggtccctgagactctcctgtgcagcctctggattcacctttagcagctatggcatgagctgggtccgccaggttccaggggaagggactgcagtgggtctcatctattagtgctagtggtggtactacattctacgcagactccctggaggggccggttcaccatctccagagacaattccaagagcacgctgtactctaacaaatgaacaacctgagacgccgaggacacggtcctaatattactgtgacgaaatattctgacgtcgtacgcctacctccgtccccttatttgactacgtcggggccacgggtaccctggtccaccgtctcctcacgcctccaccgaacgggccctagtccggttccttccccgtggccctccctcgcctccgagcgccaccgtccgagacgcacnggccggccgtggctcgccgtggccaaggtctactccgacgacacggtcgtacgcgacggcggtgtcggacg

SEQ ID NO: 225464 - DNA, 480 bp, Homo sapiens
  misc_feature: GYAE6OF02FJR12.36.33.C11.1.454.CMB.1.raw
  modified_base (324)..(324): a, c, t, g, unknown or other
  misc_feature (324)..(324): n is a, c, g, or t
  modified_base (429)..(430): a, c, t, g, unknown or other
  misc_feature (429)..(430): n is a, c, g, or t
  modified_base (433)..(433): a, c, t, g, unknown or other
  misc_feature (433)..(433): n is a, c, g, or t
  modified_base (435)..(480): a, c, t, g, unknown or other
  misc_feature (435)..(480): n is a, c, g, or t
tcagtacgctgtctcacgaccggtgctcgatttagagtgagctcgttgggtttggggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactacgtggggccagggaccctggtccaccgtctcctcacgcctccaccgaacgggccccagtccggtccttcccccgtggccgccctgcctccagggcgccaccccgtccgaagngccacgacggccggcccgtggggcctcggccgttggtaccgaacggacttaccttccaagacacgccgtagtcgagcggggcgtggcgaacggcgacgtagtgcnncancnnnnnnnnnnnnnnnnnnnnnnnnnnnnnnnnnnnnnnnnnnnnnn

SEQ ID NO: 225465 - DNA, 821 bp, Homo sapiens
  misc_feature: GYAE6OF02H1AKE.36.33.C11.1.454.CMB.1.raw
  modified_base (192)..(192): a, c, t, g, unknown or other
  misc_feature (192)..(192): n is a, c, g, or t
tcagtacgctgtctcacgaccggtgctcgatttagagtgagctcggttgggtttgggggagggttggtacagccgtgggggggtccctgagactctcctgtgcagcctctggattcacctttagcagctatggcatgagcgtcgggtcccgccgaggttccgaggggaagggctgcgaggtcgggtctcatntattagtgtctaggtggtggtactactattctacgcagacctccgtgggacggggtccgttacaccatcctacagtacgaactaacttaccgaagtagaccaacgtctagtactactaacaataacgaaaccaaccgtagaacgacgaccggaacggaactaccggtacttaattactttacgtggtacgaacgttaaacttacgttccgtaaggtaccggtacgtacgtacccgtaccccgttaccgtacccctttaagttttcggaaccgttaccgggtacggggtacccggaacggttacccggtcgtacccgtaaccgttcccgtacctaccgtaccgtaccctaacccggtaacggaacccgggtaccttccggtacccgttcccccggttaccggtccggcccgtacccgtcgacgtaacccggagggtccctaacccggtaccctaccggggaacctacggacccgaccgggtacccggtacccgggccgggtaaccggtcgtaccgggttcccgtacgggttaaccggtaccgttaaccgtttaacccgtcggaaaccggtaccggaacgttttacccggtacggacgggtacccggtccgggtacggtacgggaacccgg

SEQ ID NO: 225466 - DNA, 821 bp, Homo sapiens
  misc_feature: GYAE6OF02JPDW0.36.33.C11.1.454.CMB.1.raw
tcagtacgctgtctcacgaccggtgctcgatttagagtgagctcgttgggtttggggtagggttgggtacagcctggggggtcccgtgagactctcctgtgcagcctctggattcacctttaagtcagctatggcatgagctggggtcccgccacggttccaggggaagggactgcaggtgggtctcatctatagttcgctagtgggtggtactactattcacgacagactcctgacggggccggtccaccactctccgagacgaacgaattccgaagacgcacgactcgtactactaacctaaagtacgaaaccaacctaggagacggaccgaacggacgaaccggtaccgtttaattaacgttaccgtggttgaaccgtaaagttaactttacgtggtaccgtacggttacgcctacccgttacccgttaaccccttattttaccggacgtttaaccgggtcggggtaaccgtaaccggggtaaccccgtcgggtaccgttaccccggtacttcccgtcgacccgtccccgttaaccgaaaccccgaacccgggggtaccctaccgtcccgggttccccttcccccggtcggtccccggcccgttcccggcctacccggtcgggtaccgaccccgtaaccggtacccgggaacgccggacccgaaccgaccgggcccgggtaccccggtgggcccgttcggacccggttcgggaaccggttaacggaacccttaccgttacccgaaaccgggacgttaaacccggtaccggttacccggtaggtaccgggggtccccggggtaggttcccggaaccggg

SEQ ID NO: 225467 - DNA, 704 bp, Homo sapiens
  misc_feature: GYAE6OF02HIB0B.36.33.C11.1.454.CMB.1.raw
  modified_base (133)..(133): a, c, t, g, unknown or other
  misc_feature (133)..(133): n is a, c, g, or t
  modified_base (182)..(182): a, c, t, g, unknown or other
  misc_feature (182)..(182): n is a, c, g, or t
  modified_base (513)..(513): a, c, t, g, unknown or other
  misc_feature (513)..(513): n is a, c, g, or t
  modified_base (586)..(586): a, c, t, g, unknown or other
  misc_feature (586)..(586): n is a, c, g, or t
  modified_base (693)..(693): a, c, t, g, unknown or other
  misc_feature (693)..(693): n is a, c, g, or t
tcagtacgctgtctcacgaccggtgctcgatttagagtgagctcgttgggtttggggaggttggtacagcctgggggtccctgagactctcctgtgcagcctctggattcacctttagcagctatggcatgancgtggtccaccaggttccagggaaggctgcagtggtctcatctagtcgngctagtggtcgtactacagttcacgcagctcctaggacgggtccgttcaccatcctaccagacgaactaacttccgaagacgacgtacgtctgtactactaacgaatcgaactaacgtgagacgcgagtaccgacgtaccttatacgttaacgtgtacgtacgtaaatcttcgtacgtacgtaccgtacgacctccgtaccgtaccccttagtttacgtaacttacggtacgggtaccgttaaccgggaaacccgtttcggtaccctaaccgggtttacccgtccttaccgacccgttaccccggaccccaaaccggaccgggtaaccccngtttccccggggttcccctttaacccccggcgggtccccgttccgtccggtaaccttccggacgtaccgaccncccgtacggacacgacaaccgccggtccgcgttcggaccctgcccgtacggccgaaccgccgtttactacccgagttacccgagttccggaacgtcggaacgggccncggacgaccgg

SEQ ID NO: 225468 - DNA, 938 bp, Homo sapiens
  misc_feature: GYAE6OF02JI87A.36.33.C11.1.454.CMB.1.raw
tcagtacgctgtctcacgaccggtgctcgatttagagtgagctcgttgggtttgggggagggctggtacagcctggggggtccctgagactctcctgtgcagcctctggattcactttagcagctatggcatgagctgggtccgcaggtccagggaggctgcagtggtctcatctattagtgctagtggtgtactacatttcgacgcacgactccctggacggggtccgttcaccgtatcctaccgaaggacgacctaaacttccgaaaggtacggtacctaacgtccgttacggttaacttaacctaaccgtaaaaacgttcggaaaacccctaaacccggttagtaacgggtaacgggacccggtaacggtaaccggaaccgggttaccctttaacgttaacgtttaaccgttgggttaacgtaaccggttaaaacgttaacgttttccggtaacggtaccgggtttacggttaaccgtaccgtaaccccgttaccggttacccccttaagtttttacggaacccgtttacgggtccgggggtacccgtaaaccggggtaaaccccgttcgggttacccgtaacccgtttacccggtacccttaacccgtacggtaccccgttaccccgaacccgggtaccgggtaccccgtaccggttacccgggttacccgttccccccgggttaacggccccggtttccccgtaccgtttacccgtccccgggtaaacgggacctaccccggtaaccgttacccggaaccgttaacggaacccgtaacccgaccgggttaccgggtaccccgttcggggaacccgtttccggacccgttttccgggaaaccgtaaccggttacccgttaacgttacccgaaccggttaccgacccggttaccggttacggacgggttacccgggcgggtaccgtttaacgggg

SEQ ID NO: 225469 - DNA, 713 bp, Homo sapiens
  misc_feature: GYAE6OF02I8CPH.36.33.C11.1.454.CMB.1.raw
  modified_base (573)..(573): a, c, t, g, unknown or other
  misc_feature (573)..(573): n is a, c, g, or t
tcagtacgctgtctcacgaccggtgctcgatttagagtgagctcgttgggtttgggagggttggtacagcctggggggtccctgagactctcctgtgcagcctctggattcacctttagcagctatggcatgagctgggtccgccaggttccgagggaagggactgcagtgggtctcatctattagtgctagtggtggtactacattctacgcagacctcctggacggggtcccggttcaccatcctccagagacaattccaagagcacgctgtactactaacaaatcgaaacaacctggaacgacgaccggaggaccgacggtaccttaattactttactggtgaccgtaaaattacttcgtagtacgtacgtacgcctacccttcccgtacccctttattttcgacttacggtcggggaccgtaacgggtacccgttcggtaccctaccgtttccgtcccgtaccaaccgtccccttaaccccgaccggaacccgggcccctaccggttcccggttccccgttcccccgtaccgggccccgttacccgtcgtcccgttccgaacgggtccncccgtacccgtccgacggacgacctaccggcggacccggtcccggtcggccgtccgggtcctcgggtaccgacggttaacccttacctaccgacgtaaccgtacggaccgtacggtggaccgggtcgggacgtcgggacg

SEQ ID NO: 225470 - DNA, 861 bp, Homo sapiens
  misc_feature: GYAE6OF02HLWS7.36.33.C11.1.454.CMB.1.raw
  modified_base (250)..(250): a, c, t, g, unknown or other
  misc_feature (250)..(250): n is a, c, g, or t
tcagtacgctgtctcacgaccggtgctcgatttagagtgagctcgttgggtttgggagggttggtacagcctggggggtccctgagactctcctgtgcagcctctggattcacctttagcagctatggcatgagctcgggtccgccaggttccgaaggggtaaggactgcgagtgggtctcatctattagtgctaggtggtgtactacattcgagcagacctccgtggacggggtccgttcaccactccnccaagacgaactaacttaccgaaagacgcaccgcttgtactactaacaaaatacgaaactaccgagtaagacgccggaaggaacccacggtaccttaattattacgtggtagtacgaaaattctacgtacgtacggtacgtacacctacccgttccgtacccgtttagtttacgtaaccgttaccgggtaccggggtaccgaaccggggttaaaccccgtcgggtaccctaaccggtttccccgtacctacccggtacgtccccccgtaacccgtaaacccgggtaaccccgggacccttacccgtttacccgggttcccccgttacccccggttccgggacccccggttcccgttcccggtaccctaacccgggaagggtaccccgtaacccgttccccggtaacccgggtacggaacccgtaccccggaacccgggaacccgggccccgggttaccccgggtacgggtcccgttcccggtacccgggtttaaccgggaacccgttaaaccgggttaacccccgttaacttacccggaaacgttacccggtaaccggttacccgtacggaccggttacccggggaccgggtaccggtacggtaacccggg

SEQ ID NO: 225471 - DNA, 712 bp, Homo sapiens
  misc_feature: GYAE6OF02ID051.36.33.C11.1.454.CMB.1.raw
  modified_base (189)..(189): a, c, t, g, unknown or other
  misc_feature (189)..(189): n is a, c, g, or t
  modified_base (240)..(240): a, c, t, g, unknown or other
  misc_feature (240)..(240): n is a, c, g, or t
  modified_base (626)..(626): a, c, t, g, unknown or other
  misc_feature (626)..(626): n is a, c, g, or t
tcagtacgctgtctcacgaccggtgctcgatttagagtgagctcgttgggtttgggggagggttggtacagccgtggggggtccctgagactctccgtgtgcagcctctggattcacctttagcagctagtggcatgagcgtgggtccgccaggttccagggaaggctgcagtgggtctcatctattgngtctagtggtagtactacattcacgcagacctcctggacggggtcccgttnaccatcctcgaagagaactaagttaccgaaagcgacgcgtactgtacttacaacaaagtcaaacgactgagacgcgagaccgacggttactagtactacgtgtactacgtaaaattgttactacgaacgttcgtaacgtcctaacccgttaccgtcccctttaattttcggaaaccgttacggtaccgggggacccaaaacggggtttaccccctagggttacccgtaacccggtttctacccctacggtacgtaccccgtacccgaaccggtaaacccggaccttacgtacccgggttccccttccccggagtcccgtacctacgtacccgactacgggcacccggttacgaccggaagaccgacgacgtacggccgttacccgnggtcctcgccctggtaacccgacgttaccgtacctacgacgtaactccggacgttaccgtacgtacgggaccggtcgtacggacgg

SEQ ID NO: 225472 - DNA, 939 bp, Homo sapiens
  misc_feature: GYAE6OF02FG4DH.36.33.C11.1.454.CMB.1.raw
  modified_base (207)..(207): a, c, t, g, unknown or other
  misc_feature (207)..(207): n is a, c, g, or t
tcagtacgctgtctcacgaccggtgctcgatttagagtgagctcgttggggtttgggagggttggtacagcctggggggtccctgagactctcctgtgcagcctctggattcacctttagcagctatggcatgagctgggtccgcctaggttccaggggaacggggctgggagtggggtctcagactaattaagtgggtagggggtnattcaccactattacgcggactccggtgggggccgttcaccatcaccagaagacaactccgaggacacaccgcttaatatcgtgacaaatcgacgacctagcctagacggtagtacggaacggtacgaccggaccgttagttaactttagttacggtggtaccggaaggtaacgtaaccgttaacccccggtaaacggggttcgaaacccgaacgttaacggtttacggggtcgtttacggttttttacggttttaacgttttttttaccggggaaccctaaccgggggtaaccttaaacggtttaccgggttacccgttaaacccggtttcctttaccggtttacctaaccgtaccccgtaccccgtaaacccggtaaaccgggggtacccccttaaggttccccggttaaccccgtttccccccggtcgggggtaccccgtacccccggtttacgggtaccccgttacccggaaccggggaacctacccggtaaccccgtacccggtaaaccgggtaccgaacccttaaccgggaaccggtaccccgggtcccgtaccggggttaccggttaccgggtacccggtttaacggggttacccggtaaaaccgggtacccgtttaaacccggtttaacccgaaccgggtttaacccgaacggggtttacccgtaacgggtttaccggaaccgggtcccgggggtacggttaccgggtaaaccggtaccggggg

SEQ ID NO: 225473 - DNA, 426 bp, Homo sapiens
  misc_feature: GYAE6OF02HEH5F.36.33.C11.1.454.CMB.1.raw
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (395)..(426): a, c, t, g, unknown or other
  misc_feature (395)..(426): n is a, c, g, or t
tcagtacgctgtctcacgaccggtgctcgatttagagtgagctcgttgggtttgggtgccgaagttgctggaggggccggttcaccatctccagagacaattccaagagcacgctgtatctacaaatgaacaacctgagagccgaggacacggccttatattactgtgcgaaatattctgacgtcgtagcacctcgcccctattttgactactggggccagggaccctggtcaccgtctcctcagccctccaccaagggcccattcggtccttccccctggccgccctgcctccaggngccacctccgagacgcacgagccggcccgtgggcctcgcctggtcaaggactactccagacngctactgagcgggctggcaagggcacagtagnacnnnnnnnnnnnnnnnnnnnnnnnnnnnnnnnn

SEQ ID NO: 225474 - DNA, 521 bp, Homo sapiens
  misc_feature: GYAE6OF01DK0IP.19.86.H09.1.454.CMB.1.raw
  modified_base (509)..(521): a, c, t, g, unknown or other
  misc_feature (509)..(521): n is a, c, g, or t
tcagtactctcgtgcacgaccggtgctcgatttagtgctatagactttgggttttgggggcccgttcctgggccccaggtcttcgtgctgtactcaggcaccctcagcgtcgtgggacccccgggcagacggtcaccatcgcttgttctgcaagcagctcgaacagttcgggagcagtggttagtgatgtggtatcagaaagtccaggaacggccccaaacgtcgtcatctataatggacgctgagcggtccttaagggtccctgaccgattctctggcgagtaggtcttggcgcctcagcttccctgggcccatacagagggcgtccaggtctggaagatgagctgattattatgtgcaatctagggatgacagtgtgaacgggtccggttttcgcggagggaccaagctgaccgtctaagtcagacccaaaggctagccccctaggtcacgtactgttacccgcctcctccacgagagtactgagcgggctggcaagcgtcattagnnnnnnnnnnnnn

SEQ ID NO: 225475 - DNA, 320 bp, Homo sapiens
  misc_feature: GYAE6OF01AC55L.19.86.H09.1.454.CMB.1.raw
  modified_base (316)..(320): a, c, t, g, unknown or other
  misc_feature (316)..(320): n is a, c, g, or t
tcagtactctcgtgcacgaccggtgctcgatttagtgctatagacttgagcagcctgaggtctgacgacacggccatgtattattgtgcgaggcaggacgggctaaaggcataagtggttcgaccctgggccagggaccctggtcaccgtctcctcagcctccaccaagggcccatccggtccttccccctggccgccctgcctccaggacgccacctccggagacgcacgacgccggccctgggcctggccctgggtaccaacggaccttaccttcccacgagagtactggagcgggctggccaaggcgcatagnnnnn

SEQ ID NO: 225476 - DNA, 489 bp, Homo sapiens
  misc_feature: GYAE6OF01BP1G1.19.86.H09.1.454.CMB.1.raw
  modified_base (440)..(440): a, c, t, g, unknown or other
  misc_feature (440)..(440): n is a, c, g, or t
  modified_base (479)..(489): a, c, t, g, unknown or other
  misc_feature (479)..(489): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctagaccgattctctggcgagaggtctggcgcctcagattccctggccatcagagggctccagtctgagatgaggctgattatactgtgcaatctgggatgacagtgtgaacggtcggtttcggcggagggacaagctgaccgtcctaagtcagcccaaggctgcccctcggtcactctcgttcccaccctcncacgagagtactgacgcgggctggcgaaggcgcagtagnnnnnnnnnnn

SEQ ID NO: 225477 - DNA, 424 bp, Homo sapiens
  misc_feature: GYAE6OF01B5B3A.19.86.H09.1.454.CMB.1.raw
  modified_base (420)..(424): a, c, t, g, unknown or other
  misc_feature (420)..(424): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggccccatcggtcttccccctggcgccctgctccaggagcacctccgagagcacagcggccctgggctgcctggtcaaggactacttcccacgagagtactgagcgggctgggcaagggcgcatagnnnnn

SEQ ID NO: 225478 - DNA, 303 bp, Homo sapiens
  misc_feature: GYAE6OF01BVRAO.19.86.H09.1.454.CMB.1.raw
  modified_base (297)..(303): a, c, t, g, unknown or other
  misc_feature (297)..(303): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccctgggctgcctggtcaaggactacttcccacgagagtactgagcgggctggcaaggcgcatagnnnnnnn

SEQ ID NO: 225479 - DNA, 301 bp, Homo sapiens
  misc_feature: GYAE6OF01CH494.19.86.H09.1.454.CMB.1.raw
  modified_base (297)..(301): a, c, t, g, unknown or other
  misc_feature (297)..(301): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccctgggctgcctggtcaaggactacttcccacgagagtactgagcgggctggcaaggcgcatagnnnnn

SEQ ID NO: 225480 - DNA, 302 bp, Homo sapiens
  misc_feature: GYAE6OF01DIK5I.19.86.H09.1.454.CMB.1.raw
  modified_base (298)..(302): a, c, t, g, unknown or other
  misc_feature (298)..(302): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggactacttcccacgagagtactgagcgggctggcaaggcgcatagnnnnn

SEQ ID NO: 225481 - DNA, 484 bp, Homo sapiens
  misc_feature: GYAE6OF01BW6O9.19.86.H09.1.454.CMB.1.raw
  modified_base (479)..(484): a, c, t, g, unknown or other
  misc_feature (479)..(484): n is a, c, g, or t
tcagtactctcgtgcacgaccggtgctcgatttagtgctatagacttgggtttggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtcggttttcggcggagggaccaagctgaccgtcctaagtcagcccaaggctgcccctcggtcactctgttcccaccctcctccacgagagtactgagcgggctggcaaggcgcatagnnnnnn

SEQ ID NO: 225482 - DNA, 424 bp, Homo sapiens
  misc_feature: GYAE6OF01CLYQR.19.86.H09.1.454.CMB.1.raw
  modified_base (418)..(424): a, c, t, g, unknown or other
  misc_feature (418)..(424): n is a, c, g, or t
tcagtactctcgtgcacgaccggtgctcgatttagtgctatagacttgggcttgagtggatagggcggatccacggtggtagtggtggcgcatacgtcgcacagaagtttcaggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggacgcacctccgagagcacagcggccctgggctgcctggtcaaggctacttcccacgagagtactgagcgggctgggcaagggcgcatagnnnnnnn

SEQ ID NO: 225483 - DNA, 559 bp, Homo sapiens
  misc_feature: GYAE6OF01CPG37.19.86.H09.1.454.CMB.1.raw
  modified_base (526)..(526): a, c, t, g, unknown or other
  misc_feature (526)..(526): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacacttcagtcattatcatatactctgggtgcgacaggcccctggacaagggcttgagtggatagggcggatcgacggtggtagtgggtggcgcagtacgtcgcacagtaagtttcgagggccgcgtcaccagtggaccaaggtcgcgtccaacgaatacagtgtatagtggtacgttgagtcgacgtcgtaggacggtgtacggacgtacgacggcctagtcgtaattagtggtcgacggtaggcgaagggggacgggtaagtaaacgganaaaggttaaacggtcggttacccgtacccgggg

SEQ ID NO: 225484 - DNA, 499 bp, Homo sapiens
  misc_feature: GYAE6OF01BI2MP.19.86.H09.1.454.CMB.1.raw
  modified_base (487)..(499): a, c, t, g, unknown or other
  misc_feature (487)..(499): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagcccaaggctcgcccctggtcactctcgttcccaccctcctccacgacgacgtactgacgcgggctcggcaaggcgcagtagnnnnnnnnnnnnn

SEQ ID NO: 225485 - DNA, 458 bp, Homo sapiens
  misc_feature: GYAE6OF01BERKH.19.86.H09.1.454.CMB.1.raw
  modified_base (401)..(401): a, c, t, g, unknown or other
  misc_feature (401)..(401): n is a, c, g, or t
  modified_base (431)..(432): a, c, t, g, unknown or other
  misc_feature (431)..(432): n is a, c, g, or t
  modified_base (434)..(458): a, c, t, g, unknown or other
  misc_feature (434)..(458): n is a, c, g, or t
tcagtactctcgtgcacgaccggtgctcgatttagtgctatagacgaagggcttgagtggatagggcggatccacggtggtagtggtggcgcatacgtcgcacagaagtttcagggccgcgtcaccatggccaaggtcgcgtccacgaatacagttgtatatggacttgagcagcctgaggtctgacgacacggccatgtattagttgtgcgaggcagggcggggctaaaggcataaagtggttcgaccctggggccagggaccctggtcacgtctctcagctcacaagggcccatcggtctcccctggcgcccctgctccgaggacgcaacctccgagagcacaggcggcccctgggactgccctggtcaaggtcctacttcccaacggagacgttaccnggacgcgggctgggcaaaggcacaatacgnntnnnnnnnnnnnnnnnnnnnnnnnnn

SEQ ID NO: 225486 - DNA, 493 bp, Homo sapiens
  misc_feature: GYAE6OF01C0O8I.19.86.H09.1.454.CMB.1.raw
  modified_base (488)..(493): a, c, t, g, unknown or other
  misc_feature (488)..(493): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataaatgacgctgagcggtccttaagggtccctgaccgattctctggcgagaggtctggcgcctcagcttccctggccatcagagggctccagtctgaagatgaggctgattattactgtgcaatctgggatgacagtgtgaacggttcggttttcggcggagggaccaagctgaccgtcctaagtcagcccaaaggctcgccccctcggtcactctcgttcccaccctcctccacgagagtactgagcgggctggcaaggcgcagtagnnnnnn

SEQ ID NO: 225487 - DNA, 504 bp, Homo sapiens
  misc_feature: GYAE6OF01AY2QV.19.86.H09.1.454.CMB.1.raw
  modified_base (494)..(504): a, c, t, g, unknown or other
  misc_feature (494)..(504): n is a, c, g, or t
tcagtactctcgtgcacgaccggtgctcgatttagtgctatagacttgggtttgggggccgttcctgggcccagtctgtactgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagcccaaggctcgccccctcggtccactctcgttccccaccctccctccacgacgacgtactgacggcgggctggcaaggcgcatagcnnnnnnnnnnn

SEQ ID NO: 225488 - DNA, 501 bp, Homo sapiens
  misc_feature: GYAE6OF01DK1TM.19.86.H09.1.454.CMB.1.raw
  modified_base (486)..(486): a, c, t, g, unknown or other
  misc_feature (486)..(486): n is a, c, g, or t
  modified_base (490)..(501): a, c, t, g, unknown or other
  misc_feature (490)..(501): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagctttcctggccatcagagggctccagtctgaagatgaggctgattattactgtgcaatctggatgacagtgtgaacggtcggttttcggcggagggaccaagctgaccgtctaagtcagcccaaggctgcccctcggtcactctcgttcccaccctcccacgagacgtactgacgcgggctcgggcaaacgggcgcataggntagnnnnnnnnnnnn

SEQ ID NO: 225489 - DNA, 527 bp, Homo sapiens
  misc_feature: GYAE6OF01E40CI.19.86.H09.1.454.CMB.1.raw
  modified_base (499)..(500): a, c, t, g, unknown or other
  misc_feature (499)..(500): n is a, c, g, or t
  modified_base (507)..(508): a, c, t, g, unknown or other
  misc_feature (507)..(508): n is a, c, g, or t
  modified_base (513)..(514): a, c, t, g, unknown or other
  misc_feature (513)..(514): n is a, c, g, or t
  modified_base (516)..(516): a, c, t, g, unknown or other
  misc_feature (516)..(516): n is a, c, g, or t
  modified_base (519)..(522): a, c, t, g, unknown or other
  misc_feature (519)..(522): n is a, c, g, or t
  modified_base (524)..(527): a, c, t, g, unknown or other
  misc_feature (524)..(527): n is a, c, g, or t
tcagtactctcgtgcacgaccggtgctcgatttagtgctatagacggttgggtttggggccgttcctggcccagtctgtgctgtactcaggcaccctcagcgtctggacccccggcagacggtcaccatcgcttgtttcgtgcaagcaggtctcgtaacatcgggtagcagtggtgtgatgtggtatctagaaagtcccaggacgggccccaaactcggtcatcctagtaatcgacgctgacgtccggttccttaagggtcccctggaccccgtatttcgtcttcggccgtagaggttctggcgcctcagcttccctggccgactccagacgggtctccgagtcgtgaagagtggaggctgtattattactgtagcaatcgtgggatgacagtgtgaacggtcggtttcggcggagggacagctgaccgtctagtcagccaaggctcgccctcgtcactcctcgttccccacctccaccacgacgagtactgacgcggnnggcagcnngtagnngnagnnnnannnn

SEQ ID NO: 225490 - DNA, 492 bp, Homo sapiens
  misc_feature: GYAE6OF01BLUKW.19.86.H09.1.454.CMB.1.raw
  modified_base (484)..(492): a, c, t, g, unknown or other
  misc_feature (484)..(492): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagcccaaggctgcccctcggtcactctcgttcccaccctcctccacgagacgtactgacgcgggctggcaggcgcatagnnnnnnnnn

SEQ ID NO: 225491 - DNA, 514 bp, Homo sapiens
  misc_feature: GYAE6OF01EV2GG.19.86.H09.1.454.CMB.1.raw
  modified_base (497)..(497): a, c, t, g, unknown or other
  misc_feature (497)..(497): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagtaagtttcagggccgcgtcaccatggcaaggtcgcgtccacgaatacagtgtatagtggacttgagcagcctgagtctgacgacacggcatgtattagtgtggcgagggcaagggacggggacgtaaagganagtaaagtggttaccgg

SEQ ID NO: 225492 - DNA, 492 bp, Homo sapiens
  misc_feature: GYAE6OF01B5EA1.19.86.H09.1.454.CMB.1.raw
  modified_base (458)..(458): a, c, t, g, unknown or other
  misc_feature (458)..(458): n is a, c, g, or t
  modified_base (483)..(492): a, c, t, g, unknown or other
  misc_feature (483)..(492): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggttcggtttcggcggagggaccaagctgaccgtctaagtcagccaaggctcgcccctcggtcactctcgttcccaccctcctccacgacgagtacngacgcgggctggcaaggcgcagtgnnnnnnnnnn

SEQ ID NO: 225493 - DNA, 513 bp, Homo sapiens
  misc_feature: GYAE6OF01DN1DH.19.86.H09.1.454.CMB.1.raw
  modified_base (494)..(494): a, c, t, g, unknown or other
  misc_feature (494)..(494): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacacttcagtcattatcatatactctgggtgcgacaggcccctggacaagggcttgagtggatagggcggatccgacggtggtagtggtggcgcatacgtcgcacagaaagtttcagggccgcgtcaccatggccaaggtcgcgtccacgaatacagtgtatatggacttgagcagcctgaggtctgacgacacggccatgtattattgtgcgtaggcagggacggggctaaagggnaagtaaagtggttacccgg

SEQ ID NO: 225494 - DNA, 556 bp, Homo sapiens
  misc_feature: GYAE6OF01B4U47.19.86.H09.1.454.CMB.1.raw
  modified_base (120)..(120): a, c, t, g, unknown or other
  misc_feature (120)..(120): n is a, c, g, or t
  modified_base (168)..(168): a, c, t, g, unknown or other
  misc_feature (168)..(168): n is a, c, g, or t
  modified_base (264)..(264): a, c, t, g, unknown or other
  misc_feature (264)..(264): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
  modified_base (551)..(553): a, c, t, g, unknown or other
  misc_feature (551)..(553): n is a, c, g, or t
tcagtactctcgtgcacgaccggtgctcgatttagtgctatagacttggggtttaggggggccgttcctgggcccagtctgtgctgactcaggcaccctcagcgtctgggacccccgggnagacggtcaccatcgcttgttctgcaagcagctcggtaacatcggganctagtggtgtgatgtggtatcagaaagtcccagggaaccggccccaaatcggtcatctataatgacgctgagcggtccttaagggtccctgaccgnttctctggcgagaggtctggcgcctcagcttcctggccatcaggacgggctccgagtcctggaacgagtgaggctggtatttattactgtgcaatcgtggatgacagtgtgaacggttcggttttcggcggagggaccaaggcgtacggacccgttacctaagtcaacgcccaaagggcctccgccccctcgggtaccacctctcgttcccacccttcctaccacgacgtacgtacgtcgacgcgggctacggcgaagggccgacgagtgganctgntncgtacnannngcg

SEQ ID NO: 225495 - DNA, 490 bp, Homo sapiens
  misc_feature: GYAE6OF01CMGAF.19.86.H09.1.454.CMB.1.raw
  modified_base (479)..(490): a, c, t, g, unknown or other
  misc_feature (479)..(490): n is a, c, g, or t
tcagtactctcgtgcacgaccggtgctcgatttagtgctatagactttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccgagtctgaagatgaggctgattattactgtgcaatctggatgacagtgtgaacggtcggttttcggcggagggaccaagctgaccgtctaagtcagccaagctcgccccctggtcactctcgtcccgccctctccacgagagtactgagcgggctggcaaggcgcagtagnnnnnnnnnnnn

SEQ ID NO: 225496 - DNA, 496 bp, Homo sapiens
  misc_feature: GYAE6OF01EYU3I.19.86.H09.1.454.CMB.1.raw
  modified_base (260)..(260): a, c, t, g, unknown or other
  misc_feature (260)..(260): n is a, c, g, or t
  modified_base (484)..(496): a, c, t, g, unknown or other
  misc_feature (484)..(496): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattcnctggcgagaggtctggcgcctcagcttccctggccatcagaggggctccagtctgaagatgaggctgattattactgtgcaatctggatgacagtgtgaacggtcggtttcggcggaggaccaagctgacgtctaagtcagcccaaggctcgcccctcggtcactctcgttccccaccctcctccacgacgacgtactgagcgggctggcaaggcgcagtacgnnnnnnnnnnnnn

SEQ ID NO: 225497 - DNA, 497 bp, Homo sapiens
  misc_feature: GYAE6OF01CO2L4.19.86.H09.1.454.CMB.1.raw
  modified_base (480)..(480): a, c, t, g, unknown or other
  misc_feature (480)..(480): n is a, c, g, or t
  modified_base (486)..(497): a, c, t, g, unknown or other
  misc_feature (486)..(497): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctggatgacagtgtgaacggtccggttttcggcggagggacaagctgaccgtctaggtcagccaagctcgcccctcggtcactctcgttcccgcccctcctccacgacgacgtactgagcgggcgtcggcgaaggcgnagtagnnnnnnnnnnnn

SEQ ID NO: 225498 - DNA, 492 bp, Homo sapiens
  misc_feature: GYAE6OF01BJJ6G.19.86.H09.1.454.CMB.1.raw
  modified_base (483)..(492): a, c, t, g, unknown or other
  misc_feature (483)..(492): n is a, c, g, or t
tcagtactctcgtgcacgaccggtgctcgatttagtgctatagacttgggtttgggggccgttcctgggcccagtctgtgctgactcaggcaccctcaagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattatactgtgcaatctgggatgacagtgtgaacggtccggttttcggcggagggaccaagctgaccgtcctaagtcagcccaaggctgcccctcggtcactctcgttcccaccctcctccacgacgagtactgagcgggctggcaggcgcatagnnnnnnnnnn

SEQ ID NO: 225499 - DNA, 491 bp, Homo sapiens
  misc_feature: GYAE6OF01ER1IP.19.86.H09.1.454.CMB.1.raw
  modified_base (438)..(438): a, c, t, g, unknown or other
  misc_feature (438)..(438): n is a, c, g, or t
  modified_base (483)..(491): a, c, t, g, unknown or other
  misc_feature (483)..(491): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgagatgagctgattatactgtgcaatctgggatgacagtgtgaacggtccggttttcggcggagggaccagctgaccgtctaagtcagcccaaggctcgccccctcggtccactctcgttcccnccctcctccacgagacgtactgagcgggctggcaggcgcagtagnnnnnnnnn

SEQ ID NO: 225500 - DNA, 506 bp, Homo sapiens
  misc_feature: GYAE6OF01BENHA.19.86.H09.1.454.CMB.1.raw
  modified_base (465)..(465): a, c, t, g, unknown or other
  misc_feature (465)..(465): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagaagtttcagggccgcgtcaccatggccaaggtcgcgtccacgaatacagtgtatatggacttgagcagcctgagtctgacgacacggccatgtattattgtgngaggcaggacggggctaaagggcagtaagtggtcgacccgg

SEQ ID NO: 225501 - DNA, 492 bp, Homo sapiens
  misc_feature: GYAE6OF01ATC04.19.86.H09.1.454.CMB.1.raw
  modified_base (354)..(354): a, c, t, g, unknown or other
  misc_feature (354)..(354): n is a, c, g, or t
  modified_base (478)..(478): a, c, t, g, unknown or other
  misc_feature (478)..(478): n is a, c, g, or t
  modified_base (482)..(492): a, c, t, g, unknown or other
  misc_feature (482)..(492): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctggatgacngtgtgacggttcggtttggcggagggaccagctgaccgtctaagtcagcccaaggctcgccccgtcggtcactctcgttcccaccctcctccacgagacgtactgacgcgggctggcaggccgnatgnnnnnnnnnnn

SEQ ID NO: 225502 - DNA, 497 bp, Homo sapiens
  misc_feature: GYAE6OF01DWBSC.19.86.H09.1.454.CMB.1.raw
  modified_base (486)..(497): a, c, t, g, unknown or other
  misc_feature (486)..(497): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctcttgcgagaggtctggcgcctcagcttccctggccatcagagggctccagtctgaagatgaggctgattattactgtgcaatctgggatgacagtgtgaacggttcggtttcggcggagggaccagctgaccgtctaagtcagccaaggctcgcccctcggtcactctcgttcccgccctcctccacgacgagtacctgacgcgggctcgggcaaggcacgatagnnnnnnnnnnnn

SEQ ID NO: 225503 - DNA, 500 bp, Homo sapiens
  misc_feature: GYAE6OF01AICQ7.19.86.H09.1.454.CMB.1.raw
  modified_base (468)..(468): a, c, t, g, unknown or other
  misc_feature (468)..(468): n is a, c, g, or t
  modified_base (485)..(485): a, c, t, g, unknown or other
  misc_feature (485)..(485): n is a, c, g, or t
  modified_base (492)..(500): a, c, t, g, unknown or other
  misc_feature (492)..(500): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacgggtccggttttcggcggtagggaccaagctgaccgtctagtcagcccaaggctcgccccctcggtccactcctcgttccccaccctccctccacgagacgtacngagcgggctggcaggcncagtagnnnnnnnnn

SEQ ID NO: 225504 - DNA, 574 bp, Homo sapiens
  misc_feature: GYAE6OF01AIXG1.19.86.H09.1.454.CMB.1.raw
  modified_base (561)..(561): a, c, t, g, unknown or other
  misc_feature (561)..(561): n is a, c, g, or t
  modified_base (563)..(574): a, c, t, g, unknown or other
  misc_feature (563)..(574): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcagagggctccagtctgaagatgaggctgattatactgtgcaatcgtgggatgacaggtgtaggtaaccgggttccggttttcgggcgggtacgggaaccgaaggtcgtacggaccgtaccgtaagtccgtaacgtccgaaaggtcctccggcccccgtcggtcctaccgttccgtccggttccccgccccttcccgtcccgaccgtacggtacgttaccgtcggacggccgggtctcgggacgaacgggcgacgtagtacgngnnnnnnnnnnnn

SEQ ID NO: 225505 - DNA, 492 bp, Homo sapiens
  misc_feature: GYAE6OF01A9L9B.19.86.H09.1.454.CMB.1.raw
  modified_base (480)..(492): a, c, t, g, unknown or other
  misc_feature (480)..(492): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttcctggccatcagagggctccagtctgaagatgaggctgattatactgtgcaatctggatgacagtgtgaacggtccggttttcggcggagggaccaagctgaccgtctaagtcagcccaaggctcgccccctggtcactctcgttcccaccctcctccacgacgacgtactgagcggctggcaggcgcatagnnnnnnnnnnnnn

SEQ ID NO: 225506 - DNA, 607 bp, Homo sapiens
  misc_feature: GYAE6OF01CR0N5.19.86.H09.1.454.CMB.1.raw
  modified_base (163)..(163): a, c, t, g, unknown or other
  misc_feature (163)..(163): n is a, c, g, or t
  modified_base (592)..(592): a, c, t, g, unknown or other
  misc_feature (592)..(592): n is a, c, g, or t
  modified_base (596)..(597): a, c, t, g, unknown or other
  misc_feature (596)..(597): n is a, c, g, or t
  modified_base (599)..(603): a, c, t, g, unknown or other
  misc_feature (599)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggcccccaaagtcgtcatctataatgacgctgagcggtccttaaggtccctgaccgtattctctggcgagaggtctggcgcctcagcttcctggccatcgagaggctcgagtctgaagatgagctgattatactgtgacaatcgtagggatgaactaggttagtaggtaaaccgggtttccggttttacgggacgggtaagggaaccaaggtccgtacggtacccgtaccgtaagtccgaacgacccgaaacgggtcctaccggtcccccgtacggtacctacttccgttaccgttaccccaccccttcccgtacccgaaccggtacggtaacgttaaccgtaggaacggtccgggtacgtcgggaccgaacgggccgtacgacgtagcgangtgnngnnnnngngn

SEQ ID NO: 225507 - DNA, 541 bp, Homo sapiens
  misc_feature: GYAE6OF01CAM63.19.86.H09.1.454.CMB.1.raw
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (531)..(532): a, c, t, g, unknown or other
  misc_feature (531)..(532): n is a, c, g, or t
  modified_base (537)..(541): a, c, t, g, unknown or other
  misc_feature (537)..(541): n is a, c, g, or t
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtccaggaacggccccaaatcgtcatctataatgacgctgagcggtccgttaagggtccctgaccgattctctggcgagaggtctggcgcctcagcttccctggccatcagacgggctccagtctggaagatgaggctgattatactgtgcaatcgtgggatgaacagtggtcgtaacgggttccggtttcggacggagggaccaagtccgtagaccgtctaagtcacgaccgaagcctacgccccgtcgtccacttccgtcgtacccaccccttcctacccgaaccggtacgtacgtacgtacgacggccgggtctcgggcacggccgacgagtacgntngannctgcnnnnn

SEQ ID NO: 225508 - DNA, 423 bp, Homo sapiens
  misc_feature: GYAE6OF01DEM1N.19.86.H09.1.454.CMB.1.raw
  modified_base (418)..(423): a, c, t, g, unknown or other
  misc_feature (418)..(423): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgatcagcctgaggtctgacgacacggccatgtattattgtgcgaggcaggacggggctaaaggcataaagtggttcgacccctggggccagggaaccctggtcaccgtctcctcagcctccaccaagggccccatcggtcttccccctggcgccctgctccaggagcacctccgagagcacagcggccctgggctgcctggtcaaggactacttcccacgagagtactgagcgggctggcaaggcgcatagnnnnnn

SEQ ID NO: 225509 - DNA, 298 bp, Homo sapiens
  misc_feature: GYAE6OF01EQEOY.19.86.H09.1.454.CMB.1.raw
  modified_base (297)..(298): a, c, t, g, unknown or other
  misc_feature (297)..(298): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggactacttccacgagagtactgagcgggctggcaaggcgcatagnn

SEQ ID NO: 225510 - DNA, 424 bp, Homo sapiens
  misc_feature: GYAE6OF01EQX9R.19.86.H09.1.454.CMB.1.raw
  modified_base (415)..(424): a, c, t, g, unknown or other
  misc_feature (415)..(424): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgaccctggggccagggaccctggtcaccgtctcctcagcctccaccaaggcccatcggtctcccctggcgccctgcctccaggacgcacctcgagagcacacgcggccctgggctgcctggtcaaggactactcccacgagagtactgagcgggctgggcaaggcgcagtagnnnnnnnnnn

SEQ ID NO: 225511 - DNA, 495 bp, Homo sapiens
  misc_feature: GYAE6OF01B6W25.19.86.H09.1.454.CMB.1.raw
  modified_base (163)..(163): a, c, t, g, unknown or other
  misc_feature (163)..(163): n is a, c, g, or t
  modified_base (171)..(171): a, c, t, g, unknown or other
  misc_feature (171)..(171): n is a, c, g, or t
  modified_base (482)..(487): a, c, t, g, unknown or other
  misc_feature (482)..(487): n is a, c, g, or t
  modified_base (490)..(492): a, c, t, g, unknown or other
  misc_feature (490)..(492): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtntgatgtggtatcagaaagtcccaggaacggcccccaaatcgtcatctataatgacgctgagcggtccttaagggtccctgaccgattctctggcgagaggtctggcgcctcagcttcccctggccatcagagggctccagtctgaagatgaggctgattattactgtgcaatctggatgacagtgtgaacggtcggtttcgcggaggacagctgacgtctaagtcagcccaaggctcgcccctggtcactctcgttcccaccctcctccacgacgacgtactgacgcgggctcggcaaggcgacgagtagnnnnnncannngcg

SEQ ID NO: 225512 - DNA, 493 bp, Homo sapiens
  misc_feature: GYAE6OF01A9V6N.19.86.H09.1.454.CMB.1.raw
  modified_base (485)..(493): a, c, t, g, unknown or other
  misc_feature (485)..(493): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgagatgaggctgattattactgtgcaatctgggatgacagtgtgaacggtccggttttcggcggagggaccagctgaccgtctaagtcagcccaaggctcgcccctcggtcactctcgttcccaccctcctcccacgacgagtactgagcgggctggcaaggcgcagtagnnnnnnnnn

SEQ ID NO: 225513 - DNA, 492 bp, Homo sapiens
  misc_feature: GYAE6OF01BD7IQ.19.86.H09.1.454.CMB.1.raw
  modified_base (485)..(492): a, c, t, g, unknown or other
  misc_feature (485)..(492): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgagatgaggctgattattactgtgcaatctgggatgacagtgtgaacggtcggttttcggcggagggaccaagctgaccgtcctaagtcagcccaaggctcgccccctcggtcactctcgttcccaccctcctccacgagacgtactgacgcgggctggcaggcgcagtgnnnnnnnn

SEQ ID NO: 225514 - DNA, 501 bp, Homo sapiens
  misc_feature: GYAE6OF01CM45O.19.86.H09.1.454.CMB.1.raw
  modified_base (491)..(501): a, c, t, g, unknown or other
  misc_feature (491)..(501): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggttcttaagggtccctgaccgattctctggcgagaggtctggcgcctcagcttcctggccatcagagggctccagtctgaagatgaggctgattattactgtgcaatctgggatgacagtgtgaacggtccggttttcggcggagggaccaagctgaccgtctaagtcagcccaaaggctgccccctggtcactcctgttccccaccctcctccacgacgacgtactcgagcggggctgggccaagggcgcagtagnnnnnnnnnnn

SEQ ID NO: 225515 - DNA, 531 bp, Homo sapiens
  misc_feature: GYAE6OF01BQ2FW.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggagtagggcggatccgacggtggtagtgggtggcgcagtacgtcgcacagtaagtttcgagggccgcgtcaccagtcggccaaggtccgcgtaccgaacgaatacgagtgtatagtggacttgagcagcctggaggtctgacgacaccggcagtgtattagtgtgcggtaggcgagggacgggtacgtaaaggcaagtaaggtggtacccgg

SEQ ID NO: 225516 - DNA, 500 bp, Homo sapiens
  misc_feature: GYAE6OF01ECT30.19.86.H09.1.454.CMB.1.raw
  modified_base (375)..(375): a, c, t, g, unknown or other
  misc_feature (375)..(375): n is a, c, g, or t
  modified_base (441)..(441): a, c, t, g, unknown or other
  misc_feature (441)..(441): n is a, c, g, or t
  modified_base (490)..(500): a, c, t, g, unknown or other
  misc_feature (490)..(500): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgagctgtattattactgtgcaatctgggatgacagtgtgaacggttcggtttcggnggagggaccagctgaccgtctaagtcacgccaaggcctcgccccctggtccactcctcgttccccnccctcctccacgagtacgtactgacgcgggctcggcaaggcgacagtgnnnnnnnnnnn

SEQ ID NO: 225517 - DNA, 504 bp, Homo sapiens
  misc_feature: GYAE6OF01DEK5Z.19.86.H09.1.454.CMB.1.raw
  modified_base (416)..(416): a, c, t, g, unknown or other
  misc_feature (416)..(416): n is a, c, g, or t
  modified_base (486)..(486): a, c, t, g, unknown or other
  misc_feature (486)..(486): n is a, c, g, or t
  modified_base (492)..(495): a, c, t, g, unknown or other
  misc_feature (492)..(495): n is a, c, g, or t
  modified_base (497)..(504): a, c, t, g, unknown or other
  misc_feature (497)..(504): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgcccccaaactcgtcatctataatgacgctgagcggtccttaagggtccctgaccgattctcgtggcgagaggtctggcgcctcagcttccctggccatcagagggctccagtctgaagatgaggctgattattactgtgcaatctgggatgacagtgtgtaacggtccggtttcggcggagggaccaagctagaccgtctaagtcagcccaaggcncgcccctggtccactctcgttcccacccctcctaccacgagtacgtacctggacgcgggctggcaggcgnagtagnnnncnnnnnnnn

SEQ ID NO: 225518 - DNA, 493 bp, Homo sapiens
  misc_feature: GYAE6OF01B0GAN.19.86.H09.1.454.CMB.1.raw
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (481)..(483): a, c, t, g, unknown or other
  misc_feature (481)..(483): n is a, c, g, or t
  modified_base (485)..(493): a, c, t, g, unknown or other
  misc_feature (485)..(493): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgattctctggcgagaggtctggcgctcagcttcctggccatcagagggctccagtctgaagatgaggctgattattactgtgcaatcgtggatgacagtgtgtacggtcggttttggcggtagggacaagctgaccgtctaagtcacgccaaggctcgcccctggtccactctctccaccctctccacgcgacgtacncgagcggctcggcgaacggcgnacgtagnnncnnnnnnnnn

SEQ ID NO: 225519 - DNA, 519 bp, Homo sapiens
  misc_feature: GYAE6OF01D3A4A.19.86.H09.1.454.CMB.1.raw
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacacggccctggacaagggcttgagtggagtagggcggatccgacggtggtagtgggtggcgcagtacgtcgcacgagaagtttcgagggccgcgtcaccatggccaagatcgcgtccaacgatacagtgtatatggacttgagcagcctgaggtctgacgacacggccagtgtattagttgtgcggaggcgagggacggggactaaaggcaagtaaaggtggtacccgg

SEQ ID NO: 225520 - DNA, 499 bp, Homo sapiens
  misc_feature: GYAE6OF01A4VSL.19.86.H09.1.454.CMB.1.raw
  modified_base (488)..(499): a, c, t, g, unknown or other
  misc_feature (488)..(499): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattatactgtgcaatctgggatgacagtgtgaacggtccggttttcggcggagggaccaagctgaccgtctaagtcagcccaaggctcgcccctcggtcactctcgttcccgccctcctccacgacgacgtactgaggcgggctgggcaaggcgcagtagnnnnnnnnnnnn

SEQ ID NO: 225521 - DNA, 507 bp, Homo sapiens
  misc_feature: GYAE6OF01DKJBN.19.86.H09.1.454.CMB.1.raw
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (444)..(444): a, c, t, g, unknown or other
  misc_feature (444)..(444): n is a, c, g, or t
  modified_base (495)..(507): a, c, t, g, unknown or other
  misc_feature (495)..(507): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattcnctggcgagaggtctggcgcctcagcttcccnggccatcagagggctccagtctgagatgagctgattattactgtgcaatctggatgacagtgtagacggttcggtttcggcgggtagggaccaagctcgaccgtctaagtcagcccgaaggcctcgcccctcggtccactcctcgttccccnccctcccgtccacgagagtacgtgacggcggcgtggcaaggcgcacgtagnnnnnnnnnnnnn

SEQ ID NO: 225522 - DNA, 417 bp, Homo sapiens
  misc_feature: GYAE6OF01DB1GA.19.86.H09.1.454.CMB.1.raw
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
  modified_base (410)..(417): a, c, t, g, unknown or other
  misc_feature (410)..(417): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaaggcccatcggtctcccctggcnccctgctccaggngcacctccgagagcacngcggccctgggctgcctggtcaaggctactcccagagagtactgagcggctggcaaggcgcatagnnnnnnnn

SEQ ID NO: 225523 - DNA, 519 bp, Homo sapiens
  misc_feature: GYAE6OF01D5E3N.19.86.H09.1.454.CMB.1.raw
  modified_base (506)..(506): a, c, t, g, unknown or other
  misc_feature (506)..(506): n is a, c, g, or t
  modified_base (508)..(509): a, c, t, g, unknown or other
  misc_feature (508)..(509): n is a, c, g, or t
  modified_base (511)..(519): a, c, t, g, unknown or other
  misc_feature (511)..(519): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaaactcgtcatctataatgacgctgagcggtccttaagggtccctgaccgattctctggcgagaggtctggcgcctcagcttccctggccatcagagggctccagtctgaagatgaggctgattattactgtgcaatctggggatgacagtgtagaacggttccggttttcgggcggagggaccaagctcggaccgtcctaagtcacgcccaaggcctcgccccctggtcactcctcgttccccgccctccctccacgagtagtactgacgccgggctggacgaacggcggcacgtagncnncnnnnnnnnn

SEQ ID NO: 225524 - DNA, 538 bp, Homo sapiens
  misc_feature: GYAE6OF01CR8PD.19.86.H09.1.454.CMB.1.raw
  modified_base (527)..(527): a, c, t, g, unknown or other
  misc_feature (527)..(527): n is a, c, g, or t
  modified_base (530)..(538): a, c, t, g, unknown or other
  misc_feature (530)..(538): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaactcgtcatctataatgacgctgagcggtccttggacgggtccctgaccgattctctggcgagaggtctggcgcctcagcttccctggccatcagagggctccagtctgaagatgaggctgtattattactgtgacaatcgtgggatgacagtgtggtacggttcggtttcggcggaggacagctgaccgtctagtcacgaccgaggcctccgcccccgtcggtccaccttcgttccgttcccctaccctccctacccgaccgacgtacgtacgtacggacggccgggcgtcgggcgaaacgggtccgacgtagtagcngcnnnnnnnnn

SEQ ID NO: 225525 - DNA, 508 bp, Homo sapiens
  misc_feature: GYAE6OF01DITKN.19.86.H09.1.454.CMB.1.raw
  modified_base (479)..(479): a, c, t, g, unknown or other
  misc_feature (479)..(479): n is a, c, g, or t
  modified_base (498)..(508): a, c, t, g, unknown or other
  misc_feature (498)..(508): n is a, c, g, or t
tcagtactctcgtgcacgaccggtgctcgatttagtgctatagacttgggtttgggggccgttcctgggcccagtctgtgctgactcaggcaccttcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacaggtgtgtacgggttccggttttcggcgggagggaccaagctgaccgtctaagtcagcccaaggctcgcccctcggtcactctcgttccccaccctccctccacgacgacgtactggacgcgggcngggaccaggcgacagtagnnnnnnnnnnn

SEQ ID NO: 225526 - DNA, 495 bp, Homo sapiens
  misc_feature: GYAE6OF01CHTCY.19.86.H09.1.454.CMB.1.raw
  modified_base (485)..(495): a, c, t, g, unknown or other
  misc_feature (485)..(495): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctcgccccctcggtcactctgttcccgccctcctccacgagacgtactgagcgggctggcaggcgcagtgnnnnnnnnnnn

SEQ ID NO: 225527 - DNA, 419 bp, Homo sapiens
  misc_feature: GYAE6OF01EUYC4.19.86.H09.1.454.CMB.1.raw
  modified_base (415)..(419): a, c, t, g, unknown or other
  misc_feature (415)..(419): n is a, c, g, or t
tcagtactctcgtgcacgaccggtgctcgatttagtgctatagacaagggcttgagtggatagggcggatccacggtggtagtggtggcgcatacgtcgcacagaagtttcagggcccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggctactcccagagagtactgagcgggctggcaaggcgcatagnnnnn

SEQ ID NO: 225528 - DNA, 510 bp, Homo sapiens
  misc_feature: GYAE6OF01CPU2M.19.86.H09.1.454.CMB.1.raw
  modified_base (498)..(498): a, c, t, g, unknown or other
  misc_feature (498)..(498): n is a, c, g, or t
  modified_base (500)..(510): a, c, t, g, unknown or other
  misc_feature (500)..(510): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaactcgtcatctataatgacgctgagcggtccttaagggtccctgaccgattctctggcgagaggtctggcgcctcagcttccctggccatcagagggctccagtctgaagatgaggctgattatactgtgcaatctgggatgacagtgtggaacggttccgggttttcggcgggagggaccaagcgtgaccgtctaagtcagcccaagctgccccctcggtcactctcgttcccgccctcctcccacgacgacgtctgacggcgggctcgggcgaacggccgcagtacgncnnnnnnnnnnn

SEQ ID NO: 225529 - DNA, 548 bp, Homo sapiens
  misc_feature: GYAE6OF01BQKBN.19.86.H09.1.454.CMB.1.raw
  modified_base (455)..(455): a, c, t, g, unknown or other
  misc_feature (455)..(455): n is a, c, g, or t
  modified_base (472)..(472): a, c, t, g, unknown or other
  misc_feature (472)..(472): n is a, c, g, or t
  modified_base (534)..(535): a, c, t, g, unknown or other
  misc_feature (534)..(535): n is a, c, g, or t
  modified_base (537)..(539): a, c, t, g, unknown or other
  misc_feature (537)..(539): n is a, c, g, or t
  modified_base (542)..(548): a, c, t, g, unknown or other
  misc_feature (542)..(548): n is a, c, g, or t
tcagtactctcgtgcacgaccggtgctcgatttagtgctatagacttgggtttgggggccgttcctgggcccagtctgtgctgactcaggcaccctcagcgtctcggggacccccgggcagacggtcaccatcgcttgttctgcaagcagctcgaacatcggggagcaggtggtgtgatgtggtatcagaaacgtcccaggaaccgcccccaaatcgtcatctaataatgacgctgagccggttccttaagggtccctgaccgtattctctggcgagaggtctggcgcctcagcttccctggccatcagacgggctccagtctgaagatgaggctgattattactgtgcaatctgggatgacagtgtaggtaacggttccggttttcggcgggagggacctaagccgtacggaccgtcctaagtcacgcccgaaggctccgcccccgtcggtccnccttcgtccgttccccnccctcctaccgacgacgtacgtactcggacgtcgggctcgggacaacggccgacgacgtagnncnnncgnnnnnnn

SEQ ID NO: 225530 - DNA, 532 bp, Homo sapiens
  misc_feature: GYAE6OF01BATJ5.19.86.H09.1.454.CMB.1.raw
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
  modified_base (523)..(524): a, c, t, g, unknown or other
  misc_feature (523)..(524): n is a, c, g, or t
  modified_base (526)..(532): a, c, t, g, unknown or other
  misc_feature (526)..(532): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaactcgtcatctataatgacgctgagcggtccttaagggtccctgaccgattctctggcgagaggtctggcgcctcagcttccctggccatcagaggctccagtctgaagatgaggctgattattactgtgcaatcgtggatgacagtgtagaacggttcggtttcggcggaggaccaagcgtgaccgtctaagtcacgccaacggctcgcccctcggtcactctccgttcccaccccgttcctccgaacgtacggacgttaccgtgaacgccggggctcgggaccgtaacgggccgacacgtaacggnacgngcnncnnnnnnn

SEQ ID NO: 225531 - DNA, 498 bp, Homo sapiens
  misc_feature: GYAE6OF01CJ597.19.86.H09.1.454.CMB.1.raw
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(498): a, c, t, g, unknown or other
  misc_feature (490)..(498): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattattatgtgcaatctgggatgacagtgtgaacggtcggtttcggcggagggacaagctgaccgtctaagtcagcccaaggctcgccccctcggtcactctcgttcccacctcctccacgagtagtacgtgacggcgggctggcaagggccganagtagnangnnnnnnnnn

SEQ ID NO: 225532 - DNA, 787 bp, Homo sapiens
  misc_feature: GYAE6OF01EO3XG.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggagccgtggggcctcgagtgaaggtctccgtgcgaggtcttttggatacaccttcagtctattatcatactactcgtgggtgcgacacggcccctggacaaggcttgagtggagtagggcgatcgaggtggtagtggtggcgctagtacggtcgactacgaggtaagtttcgaacggggtcccgacggttacaacccgtagttacggggacccgtaaaggggttcccgacccggttaacccgaaacggtaaaacgttaacccggtaaggtttacggttaaagttaacggttcggggtaaaccgttttacgggaacgtacccggtaaacggtcccgttaaggggtaaccggggtttacccgtaacgggttaaaccccggaacccggtaaccggggtacccttaaaggtttaaccggttttaacgtttaaaggttttcggggtacgggtacccgggtaagggggttaacccgggaaagggggggtaaaccccgggggtaaactttaaaaacggggggaccttaaaagggtttaaaaccggggtttcggggttaacccccggggtaaaccccccgggg

SEQ ID NO: 225533 - DNA, 580 bp, Homo sapiens
  misc_feature: GYAE6OF01BIC66.19.86.H09.1.454.CMB.1.raw
  modified_base (194)..(194): a, c, t, g, unknown or other
  misc_feature (194)..(194): n is a, c, g, or t
tcagtactctcgtgcacgaccggtgctcgattagtgctatagacttgggtttgggggaagaggaagactgacggtcccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccgaggtggtagtggtggcgcatacgtcgcacagaagtttcgagggtccgcgtcaccatggccaaggtcgcgtccacgaatacagtgtatatggacttgagcagcctgagtctgacgacacggcatgtattatggtgcgaggcgagggacgggactaaagggcaagttaaagtcggttaccgacccgtggggaccgacgggtaacccgtggtcctaccgtcctctaccgacgccctaccaccgaacgggccctacgtccggtacccttccccgcggcccgcccgtacgccctaccgacggcgcctacccgtccgacgacgcacgacggccggcccgtgggtcccg

SEQ ID NO: 225534 - DNA, 496 bp, Homo sapiens
  misc_feature: GYAE6OF01BDWMY.19.86.H09.1.454.CMB.1.raw
  modified_base (484)..(496): a, c, t, g, unknown or other
  misc_feature (484)..(496): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctggatgacagtgtgaacggtcggtttcggcggagggacaagctgaccgtctaagtcagcccaaggctcgcccctcggtcactctcgttcccgccctcctccacgacgacgtactgagcgggctggcgaaggcgacagtagnnnnnnnnnnnnn

SEQ ID NO: 225535 - DNA, 506 bp, Homo sapiens
  misc_feature: GYAE6OF01CVM5K.19.86.H09.1.454.CMB.1.raw
  modified_base (493)..(493): a, c, t, g, unknown or other
  misc_feature (493)..(493): n is a, c, g, or t
  modified_base (498)..(506): a, c, t, g, unknown or other
  misc_feature (498)..(506): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtaccttaagggtccctgaccgattctctggcgagaggtctggcgcctcagcttccctggccatcagaggctccagtctgaagatgaggctgattattactgtgcaatcgtggatgacaggttgtgtaacggttccggttttcgggacggtagggaccaaggtctgaccgtacctaagtcacgccgaaggctcgccccgtcgtcactctcgttcccaccctcctccacgagacgtactgacgcggctggctaaggcgnagtgnnnnnnnnn

SEQ ID NO: 225536 - DNA, 505 bp, Homo sapiens
  misc_feature: GYAE6OF01EZE3D.19.86.H09.1.454.CMB.1.raw
  modified_base (493)..(505): a, c, t, g, unknown or other
  misc_feature (493)..(505): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgcccccaaactcgtcatctataatgacgctgagcggtccttaagggtccctgaccgattctctggagagaggtctggcgcctcagcttccctggccatcagagggctccagtctgaagatgaggctgattattactgtgcaatctgggatgacagtgtgaacggttccggtttcggcggagggaccaagctcgaccgtctaagtcagcccaaggcctcgcccctcggtcacctctcgttccccgccctcctccacgacgtacgtactgacgcgggctggcaaggcgacagtagnnnnnnnnnnnnn

SEQ ID NO: 225537 - DNA, 558 bp, Homo sapiens
  misc_feature: GYAE6OF01CSQ3B.19.86.H09.1.454.CMB.1.raw
  modified_base (450)..(450): a, c, t, g, unknown or other
  misc_feature (450)..(450): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaagggcaagtaaagtggttacgacccgtggggccagggaaccctggtcaccgtctcctcngcctccaccgaagggcccagtccgtccttcccccgtggccgcccgtcgcctcccgacggacgcccacccgtcccgagacgccacgaggcccggccccgtggggtcccg

SEQ ID NO: 225538 - DNA, 497 bp, Homo sapiens
  misc_feature: GYAE6OF01D3EC2.19.86.H09.1.454.CMB.1.raw
  modified_base (485)..(497): a, c, t, g, unknown or other
  misc_feature (485)..(497): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgacggttcggtttcggcggagggacaagctgaccgtctaagtcagcccaaggcctcgcccctcggtcactctcgttccccgccctcctccacgagagtactgacgcgggctggccaaggcgcagtgnnnnnnnnnnnnn

SEQ ID NO: 225539 - DNA, 618 bp, Homo sapiens
  misc_feature: GYAE6OF01CLLR7.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcgagtgaaggtctccgtgcgaggtcttttggatacacttcagtcattatcatatactcgtgggtgcgacaggcccctggacaaggtcttggagtggagtagggcggtagtccgacggtggtaggtggtggcgcagtacgtcgcacgagtaagttcgagggccgcggtcaccgagtcggaccaagggtccgacgtaccgaacgtaaatacgaggtagtaagtagtagggactttggaacgcgtaacggcccgtaggacgggttctaggaccgaacgaccggaccaagttcgtaagtttagttaggtcggacggtaacgggcggacggggtaacggggtacgtaaaacgggaccgtaaaaggttaaacggtcgggttacccggtaacccccgggg

SEQ ID NO: 225540 - DNA, 489 bp, Homo sapiens
  misc_feature: GYAE6OF01CKSMX.19.86.H09.1.454.CMB.1.raw
  modified_base (479)..(489): a, c, t, g, unknown or other
  misc_feature (479)..(489): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtcggtttcggcggaggaccaagctgaccgtctaagtcagccaaggctcgccccctggtcactctcgtcccgccctcctccacgagacgtactgacgcgggctggcaggcgcagtgnnnnnnnnnnn

SEQ ID NO: 225541 - DNA, 491 bp, Homo sapiens
  misc_feature: GYAE6OF01BN4XR.19.86.H09.1.454.CMB.1.raw
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
  modified_base (480)..(491): a, c, t, g, unknown or other
  misc_feature (480)..(491): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagccaaggctcgcccctcggtcactctgttcccaccctcctccacgagatactgagcgggctggnaacggcncataggnnnnnnnnnnnn

SEQ ID NO: 225542 - DNA, 443 bp, Homo sapiens
  misc_feature: GYAE6OF01DECAL.19.86.H09.1.454.CMB.1.raw
  modified_base (433)..(443): a, c, t, g, unknown or other
  misc_feature (433)..(443): n is a, c, g, or t
tcagtactctcgtgcacgaccggtgctcgatttagtgctatagacttgggcttggagtggatagggcggatccacggtggtagtggtggcgcatacgtcgcacagaagtttcaggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtccttccccctggccgccctgcctccaggacgcaccctcccgagacgcacagccggccctggggctcggcctggtcaacggactaccttcccacgagacgtactggagcgggctggcaaggcgcatacgnnnnnnnnnnn

SEQ ID NO: 225543 - DNA, 494 bp, Homo sapiens
  misc_feature: GYAE6OF01CDF31.19.86.H09.1.454.CMB.1.raw
  modified_base (264)..(264): a, c, t, g, unknown or other
  misc_feature (264)..(264): n is a, c, g, or t
  modified_base (450)..(450): a, c, t, g, unknown or other
  misc_feature (450)..(450): n is a, c, g, or t
  modified_base (482)..(494): a, c, t, g, unknown or other
  misc_feature (482)..(494): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgctttgttctgcaagcagctcgaacatcgggagcagtggtgtgatgtggtatcaagaaacgtcccaggaaccggccccaaactcgtcatctataatgacgctgagcggtccttaagggccctgaccgattcnctggcgagaggtctggcgcctcagcttccctggccatcagagggctccagtctgaagatgagctgattatactgtgcaatctgggatgacagtgtgaacggttcggtttcggcggagggacagctcgaccgtctagtcacgccaaggctcgcccctggtccactctcgtcccaccctcctccacgngtacgtactgagcggctggcaaggcgcagtgnnnnnnnnnnnnn

SEQ ID NO: 225544 - DNA, 588 bp, Homo sapiens
  misc_feature: GYAE6OF01D002E.19.86.H09.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagtactctcgtgcacgaccggtgctcgatttagtgctatagacttggggtttggggggaaaggaggaagactgacggtcccaactcccaggtgcagctggtgcagtctcggggctgaggtcgaaggagcctggggcctcagtgaaggtctcctgcgaggcttttggatacaccttcagtcattatcatatactntgggtncgacaggccctggacaagggcttgagtggatagggcgatccacggtggtagtggtggacacatacgtcgcacagaagtttcagggccgcgtcaccatcggccaaggtcgcgtccacgaatacagtggtatatggaacttgagcagcctgaggtctgaccgacacggccatgtattattgtgcggagcgaggacggggcgtaaaggcaagtaaaggtggtaccgacccgtgggccgagggtaaccctggtcaccgtctcctcacgcctccgaaccgaacgggcccagttccggtaccttcccccgtggcccgtcccgcgtccgtcccgacgggacgtccgtacccgtccgtacgacgccaacgacgtcccggcccgtcgggtcccgg

SEQ ID NO: 225545 - DNA, 487 bp, Homo sapiens
  misc_feature: GYAE6OF01CTAOK.19.86.H09.1.454.CMB.1.raw
  modified_base (318)..(318): a, c, t, g, unknown or other
  misc_feature (318)..(318): n is a, c, g, or t
  modified_base (480)..(487): a, c, t, g, unknown or other
  misc_feature (480)..(487): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagntgaggctgattattactgtgcaatctgggatgacagtgtgaacggtccggttttcggcggagggacaagctgaccgtctaagtcagcccaaggctgcccctcggtcactctcgttcccaccctctccacgagacgtctgagcgggctggcaggcgcagtagnnnnnnnn

SEQ ID NO: 225546 - DNA, 512 bp, Homo sapiens
  misc_feature: GYAE6OF01ELV6H.19.86.H09.1.454.CMB.1.raw
  modified_base (263)..(263): a, c, t, g, unknown or other
  misc_feature (263)..(263): n is a, c, g, or t
  modified_base (340)..(340): a, c, t, g, unknown or other
  misc_feature (340)..(340): n is a, c, g, or t
  modified_base (500)..(512): a, c, t, g, unknown or other
  misc_feature (500)..(512): n is a, c, g, or t
tcagtactctcgtgcacgaccggtgctcgatttagtgctatagacttgggtttgggggccgttcctgggcccagtctgtgctgactcaggcacccctcagcgtctcgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattcnctggcgagaggtctggcgcctcagcttccctggccatcagagggctccagtctgagatgagctgtattattactgtnacaatcgtggatgacagtgtgtacggttccggtttcgcggagggccaagctgaccgtctagcacgcccaaggtcctccgcccctcggtcacctctccgttcccaccctcctccaccgagtacgtactgacggcgggctcgggacaggccgacgagtacgnnnnnnnnnnnnn

SEQ ID NO: 225547 - DNA, 507 bp, Homo sapiens
  misc_feature: GYAE6OF01EUFJB.19.86.H09.1.454.CMB.1.raw
  modified_base (444)..(444): a, c, t, g, unknown or other
  misc_feature (444)..(444): n is a, c, g, or t
  modified_base (496)..(507): a, c, t, g, unknown or other
  misc_feature (496)..(507): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgctaatctgggatgacagtgtgaacggttacggtttggcggagggaccaagctgaccgtctaagtcagcccaaggcctcgccccctcggtcactcctcgttccccnccctcctccacgagtacgtactcggagcgggctcgggcaacggcgcagtggnnnnnnnnnnnn

SEQ ID NO: 225548 - DNA, 550 bp, Homo sapiens
  misc_feature: GYAE6OF01EXKNV.19.86.H09.1.454.CMB.1.raw
  modified_base (118)..(118): a, c, t, g, unknown or other
  misc_feature (118)..(118): n is a, c, g, or t
  modified_base (330)..(330): a, c, t, g, unknown or other
  misc_feature (330)..(330): n is a, c, g, or t
  modified_base (524)..(524): a, c, t, g, unknown or other
  misc_feature (524)..(524): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
tcagtactctcgtgcacgaccggtgctcgatttagtgctatagacttgggtttgggggccgttcctgggcccagtcctgtgctgactcaggcaccctcagcgtctgggacccccgggnagacggtcaccatcgcttgttctgcaagcagctcgaacatcgggagcagtcggtgtgatgtggtatcagaaagtcccaggaacgccccaaactcgtcatctataatgacgctgagcggtccttaagggtccctgaccgattcctcctggccgagaggtcttggacgcctcagcttccctggccgtatcaggagggtctccgagtcctgaagntgaggctggattacttactgtcgcaatctgggatcgaacagtgtgaacggttcggtttcggcggaggacaagctagccgtctaagtcacgccgaagctcgtcccctggtcacgtcgtcgttacccgcccgtccgtccgacgtacgacgtactcggacgcgggcgtcggaccgaaggccgaccgtacgttagacncgctcgcacgcncgtacnctagngcg

SEQ ID NO: 225549 - DNA, 484 bp, Homo sapiens
  misc_feature: GYAE6OF01CEFWM.19.86.H09.1.454.CMB.1.raw
  modified_base (163)..(163): a, c, t, g, unknown or other
  misc_feature (163)..(163): n is a, c, g, or t
  modified_base (260)..(260): a, c, t, g, unknown or other
  misc_feature (260)..(260): n is a, c, g, or t
  modified_base (457)..(457): a, c, t, g, unknown or other
  misc_feature (457)..(457): n is a, c, g, or t
  modified_base (474)..(484): a, c, t, g, unknown or other
  misc_feature (474)..(484): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggccccaaatcgtcatctataatgacgctgagcggtccttaagggtccctgaccgattcnctggcgagaggtctggcgcctcagcttccctggccatcagagggctccagtctgaagatgaggctgattattactgtgcaatctggatgacagtgtgtaacggtcggtttggcggagggacagcgtgaccgtctaagcagcccaagctcgcccctgcactctcgtcccacctcctccacgagactcgtgacgcggcnggcaacggcacagagannnnnnnnnnn

SEQ ID NO: 225550 - DNA, 509 bp, Homo sapiens
  misc_feature: GYAE6OF01EPYRD.19.86.H09.1.454.CMB.1.raw
  modified_base (487)..(487): a, c, t, g, unknown or other
  misc_feature (487)..(487): n is a, c, g, or t
  modified_base (498)..(499): a, c, t, g, unknown or other
  misc_feature (498)..(499): n is a, c, g, or t
  modified_base (502)..(509): a, c, t, g, unknown or other
  misc_feature (502)..(509): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgtattattactgtgcaatcgtgggatgacgagtgtaggaacggttccggttttcgggcggagggaccaagctcgaccgtcgtaacgtcagcccaggctcgcccctcgtcactctcgttcccgccctcctccacgagagtactgcggcggcgtggcacggcnccagtacgagnngcnnnnnnnn

SEQ ID NO: 225551 - DNA, 507 bp, Homo sapiens
  misc_feature: GYAE6OF01D443B.19.86.H09.1.454.CMB.1.raw
  modified_base (496)..(507): a, c, t, g, unknown or other
  misc_feature (496)..(507): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatcgtgggatgacagtgtgaacggttccggtttcggcggagggacaagctgaccgtctaagtcacgcccaaggcctcgccccctggtccactcctcgttccccgccctccctccgacgacgagtactgacggcgggctggcaaggcgacagtagnnnnnnnnnnnn

SEQ ID NO: 225552 - DNA, 498 bp, Homo sapiens
  misc_feature: GYAE6OF01A3QEV.19.86.H09.1.454.CMB.1.raw
  modified_base (481)..(481): a, c, t, g, unknown or other
  misc_feature (481)..(481): n is a, c, g, or t
  modified_base (487)..(498): a, c, t, g, unknown or other
  misc_feature (487)..(498): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtccaggaacggcccccaaatcgtcatctataatgacgctgagcggtccttaagggtccctgaccgattctctggcgagaggtctggcgcctcagcttccctggccatcagaggctccagtctgaagatgaggctgattattactgtgcaatctggatgacaggtgtgaacggttccggttttcggcggagggaccaagctcgaccgtctaagtcagccaaggctcgcccctcggtcactctcgtcccgccctcctccacgacgacgtacgtgacgcgggctggcaaggcganagtagnnnnnnnnnnnn

SEQ ID NO: 225553 - DNA, 588 bp, Homo sapiens
  misc_feature: GYAE6OF01DANEM.19.86.H09.1.454.CMB.1.raw
  modified_base (574)..(575): a, c, t, g, unknown or other
  misc_feature (574)..(575): n is a, c, g, or t
  modified_base (577)..(577): a, c, t, g, unknown or other
  misc_feature (577)..(577): n is a, c, g, or t
  modified_base (582)..(588): a, c, t, g, unknown or other
  misc_feature (582)..(588): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcaagaaagtcccaggaaccggcccccaaatcgtcatctaataatgacgctgagccggtccttaagggtcccctgaccgtattccgtcgtggcgagaggtctgggcgcctcagccttcccgtggccatcagagggcctccagtctgaagatgaggctgaatttattactgtgacaagtcgtgggatgactaggtggtaggtaacccgggttcgggttttcgggacgggaacggggaccaacggtcgtcgtaaccgtccttaaagccgacgacccgaaggtcctccgcccccgttcggtccctaccttccgttccgttccccgccccttcctcccgacggtacgaacgttacgtcggacggccgggacgcggtacgacggccgtacgagtaggnngnatgannnnnnn

SEQ ID NO: 225554 - DNA, 538 bp, Homo sapiens
  misc_feature: GYAE6OF01DK970.19.86.H09.1.454.CMB.1.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
  modified_base (351)..(351): a, c, t, g, unknown or other
  misc_feature (351)..(351): n is a, c, g, or t
  modified_base (526)..(538): a, c, t, g, unknown or other
  misc_feature (526)..(538): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtccaggaaccggccccaaatcgtcatctataatgacgctgagcggtccttaagggccctgaccgnttcntggcgagaggtctggcgcctcagcttcccnggccatcagagggctccagtctgaagatgagctgatttattactgtgctaatcgtgggatganagttgtaggaaccggttccggttttacgggcgggagggtaccaaggctcggtaccgtcctaagtcacgcccgaagcctccgcccctcggtccactccttcgtccccgccctccgtccacgacgtagtaaccgtggacggtccgggcgtcgggaccgaaggccgaccgagtacggnnnnnnnnnnnnn

SEQ ID NO: 225555 - DNA, 461 bp, Homo sapiens
  misc_feature: GYAE6OF01BKQZ8.19.86.H09.1.454.CMB.1.raw
  modified_base (276)..(276): a, c, t, g, unknown or other
  misc_feature (276)..(276): n is a, c, g, or t
  modified_base (419)..(419): a, c, t, g, unknown or other
  misc_feature (419)..(419): n is a, c, g, or t
  modified_base (425)..(426): a, c, t, g, unknown or other
  misc_feature (425)..(426): n is a, c, g, or t
  modified_base (428)..(428): a, c, t, g, unknown or other
  misc_feature (428)..(428): n is a, c, g, or t
  modified_base (430)..(461): a, c, t, g, unknown or other
  misc_feature (430)..(461): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattatgtgcgaggcaggacggggctaaaaggcataaagtggttcgacccctggggccagggaaccctggtcaccgtcncctcagcctccaccaaggcccatcgtctcccctggcgccctgctccaggagcacctccggagacgcacgacgcggccctgggactgccctggccaaggacctacttcccgagacgagtactggagcgggctggacaaggcganagtagnngncnnnnnnnnnnnnnnnnnnnnnnnnnnnnnnnn

SEQ ID NO: 225556 - DNA, 498 bp, Homo sapiens
  misc_feature: GYAE6OF01BLNJW.19.86.H09.1.454.CMB.1.raw
  modified_base (487)..(498): a, c, t, g, unknown or other
  misc_feature (487)..(498): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgagatgaggctgattattactgtgcaatctggatgacagtgtgaacggttcggtttcggcggagggaccaagctgaccgtctaagtcagcccaaggctcgcccctcggtcactctcgttccccaccctcctccacgacgacgtactgacgcgggctggcgaaggcgacagtagnnnnnnnnnnnn

SEQ ID NO: 225557 - DNA, 500 bp, Homo sapiens
  misc_feature: GYAE6OF01D91J7.19.86.H09.1.454.CMB.1.raw
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
  modified_base (491)..(500): a, c, t, g, unknown or other
  misc_feature (491)..(500): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcaggagggcctccagtctagaagatgaggctgtaattatactgtgctaatcgtaggatgactagtgtagaaccggttcggtttcggcggaggaccaagctcgaccgtctaagtcacgcccaaggctcgcccctgcctctctcgttcccncctcctcacganagtctgngcggcgcggacacggcacagtgncnnnnnnnnnn

SEQ ID NO: 225558 - DNA, 453 bp, Homo sapiens
  misc_feature: GYAE6OF01CDLGP.19.86.H09.1.454.CMB.1.raw
  modified_base (333)..(333): a, c, t, g, unknown or other
  misc_feature (333)..(333): n is a, c, g, or t
  modified_base (436)..(436): a, c, t, g, unknown or other
  misc_feature (436)..(436): n is a, c, g, or t
  modified_base (441)..(442): a, c, t, g, unknown or other
  misc_feature (441)..(442): n is a, c, g, or t
  modified_base (444)..(453): a, c, t, g, unknown or other
  misc_feature (444)..(453): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgaccccgtggggccagggaccctggtcaccgtctcctcagcctccaccagggccccatcggtcttccccctggcgccctgcctccaggacncacctccgagagccacacgccggccccgtgggctcggcccgtggtccaaggacctaccttccccgagacgagtacctggacggcgggctgggcaagggccganatagnngnnnnnnnnnn

SEQ ID NO: 225559 - DNA, 681 bp, Homo sapiens
  misc_feature: GYAE6OF01CYFSD.19.86.H09.1.454.CMB.1.raw
  modified_base (118)..(118): a, c, t, g, unknown or other
  misc_feature (118)..(118): n is a, c, g, or t
  modified_base (164)..(164): a, c, t, g, unknown or other
  misc_feature (164)..(164): n is a, c, g, or t
  modified_base (664)..(664): a, c, t, g, unknown or other
  misc_feature (664)..(664): n is a, c, g, or t
  modified_base (667)..(667): a, c, t, g, unknown or other
  misc_feature (667)..(667): n is a, c, g, or t
  modified_base (670)..(670): a, c, t, g, unknown or other
  misc_feature (670)..(670): n is a, c, g, or t
  modified_base (674)..(678): a, c, t, g, unknown or other
  misc_feature (674)..(678): n is a, c, g, or t
  modified_base (680)..(681): a, c, t, g, unknown or other
  misc_feature (680)..(681): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttctgcaagcagctcgaacatcgggancagtggtgtgatgtggtatcagaaacgtcccaaggaaccgcccccaaatcgtcatctaataatgacgctgagccggtacttaacgggtccctagaccgatttctcgtggcgaggtaggtcgtggccgcctcgacgtccttccctggccatccgaggacgggtcctccgagtccgtaggaagagtaggaaggccttagtaacttttagttacgtggttacgaactaagttcggtaggggtatacggtaactaggttacggttacgggtaaacccgggttttcgggtttacgggacgggtaacgggaacgtaacggtcgtacggtaacccgtaccgtaaagtaccgaaccggtacccgaaggtccgttaccccggtcccccgttcggtacccgtaaccgttccgttacccgttaccccaccccgttccgtaaccgacggtaacgtaccgtacgcggtacggtccgggtaccgtacgggaccgtaacggcgtacgaagtacgngcngcncagnnnnngnn

SEQ ID NO: 225560 - DNA, 612 bp, Homo sapiens
  misc_feature: GYAE6OF01CU5W7.19.86.H09.1.454.CMB.1.raw
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (600)..(605): a, c, t, g, unknown or other
  misc_feature (600)..(605): n is a, c, g, or t
  modified_base (607)..(612): a, c, t, g, unknown or other
  misc_feature (607)..(612): n is a, c, g, or t
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgtctgcaagcagctcgaacatcgggagcagtggtgtgatgtggtatcgagaaagtcccaggaccggccccaaatcgtcatctataatgacgctgagcgtacttacgggtcctgaccgnttctctcggcgagnggtctcggccgcctcacgtccttccgtcggccatcgacggacgggtcctccgagtcgtagaagtagtacggacggtctagtaactttagttacgtggtcgtactaacgtcggtagggagtagtacggtaggttcggtcgggtaaccgggtttccgggtttcgggacgggacgggaccgtaagtccgtaccggtacccgtaccgtaagtccgaccggtacccgaaggtcccgtcccgcccccgttccggtcctacctccgttccgtcccctcccctcctccgacgtagtaccgtacgtcgacgggtccgggcgacggacgacgggcacgagtagnnnnnncnnnnnn

SEQ ID NO: 225561 - DNA, 511 bp, Homo sapiens
  misc_feature: GYAE6OF01BCIT8.19.86.H09.1.454.CMB.1.raw
  modified_base (453)..(453): a, c, t, g, unknown or other
  misc_feature (453)..(453): n is a, c, g, or t
  modified_base (499)..(511): a, c, t, g, unknown or other
  misc_feature (499)..(511): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttcctggccatcagagggctccagtctgaagatgaggctgatttattactgtcgcaattcgtagggatggacaggtgtagaacgggttccggttttcggcgggagggaccaagctgaccgtctagtcagccaaggctcgcccctgtcactctcgttcccgccctccnccacgacgacgtacctgacggcggtctcggcgtacggcgcagtcgnnnnnnnnnnnnn

SEQ ID NO: 225562 - DNA, 505 bp, Homo sapiens
  misc_feature: GYAE6OF01EZR6W.19.86.H09.1.454.CMB.1.raw
  modified_base (353)..(353): a, c, t, g, unknown or other
  misc_feature (353)..(353): n is a, c, g, or t
  modified_base (494)..(505): a, c, t, g, unknown or other
  misc_feature (494)..(505): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattattactgtgctaatctgggatgacngtgtagacggttcggtttcggcgggagggaccaagctgaccgtctaagtcagccaaggcctcgcccctcggtcactctcttcccaccctcctccacgacgagtacgtggacggccgggcgtcggacgaggcgacagtacgnnnnnnnnnnnn

SEQ ID NO: 225563 - DNA, 787 bp, Homo sapiens
  misc_feature: GYAE6OF01AOI2X.19.86.H09.1.454.CMB.1.raw
  modified_base (331)..(331): a, c, t, g, unknown or other
  misc_feature (331)..(331): n is a, c, g, or t
  modified_base (778)..(778): a, c, t, g, unknown or other
  misc_feature (778)..(778): n is a, c, g, or t
  modified_base (781)..(781): a, c, t, g, unknown or other
  misc_feature (781)..(781): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgtattctcgtggcgagacggtctggcgcctcagccttcccgtggccatcgaggacgggcctcctagtctgaacgntgaggtctagtatttactactgtacgactaattcggtacggtatacggaacgtaggttacggttaacgggtaaacccggggttttccccggggtttttacggggaccgggggtaacggggaaccccgtaagggtacccgttaccgggtaaccccggtttaccgttaaacgggttacccgaaaccgggtacccccgtaaacgggtcccgttaccccgggtacccccccggtttacgggttaccccgtaacccgtttcccgttaaccccggttttacccccccacccccgtttaccccgtaccccggaacgggtaaccgggtaaccggtttaacccggtcggggtaaacccgggtcccgggggtacccgttacgggggaaacccgtaaacgggggtccccgtaaaccgtaaggttaaccgggcttacgacggttgacccgagtacgcancgngtgtcg

SEQ ID NO: 225564 - DNA, 505 bp, Homo sapiens
  misc_feature: GYAE6OF01A79N2.19.86.H09.1.454.CMB.1.raw
  modified_base (163)..(163): a, c, t, g, unknown or other
  misc_feature (163)..(163): n is a, c, g, or t
  modified_base (258)..(258): a, c, t, g, unknown or other
  misc_feature (258)..(258): n is a, c, g, or t
  modified_base (333)..(333): a, c, t, g, unknown or other
  misc_feature (333)..(333): n is a, c, g, or t
  modified_base (485)..(485): a, c, t, g, unknown or other
  misc_feature (485)..(485): n is a, c, g, or t
  modified_base (496)..(505): a, c, t, g, unknown or other
  misc_feature (496)..(505): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaacggcccccaaatcgtcatctataatgacgctgagcgtcctaagggtccctgaccgattcnctggcgagaggtctggcgcctcagcttcctggccatcagagggctccagtctgaagatgagctgattatactgtncaatcgtggactgacagtgtgtaacggttccggtttggcgggtaggaccaagcgtagaccgtactaagtcacgccaaggctacgccccctagtccactctcgttcccgccctcctccacgagacgtactggacgcgggactggacgaggccngtagagcagcnnnnnnnnnn

SEQ ID NO: 225565 - DNA, 499 bp, Homo sapiens
  misc_feature: GYAE6OF01EFE1T.19.86.H09.1.454.CMB.1.raw
  modified_base (318)..(318): a, c, t, g, unknown or other
  misc_feature (318)..(318): n is a, c, g, or t
  modified_base (487)..(499): a, c, t, g, unknown or other
  misc_feature (487)..(499): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagntgagctgattattactgtgcaatctgggatgacagtgtgaacggttcggtttcggcggagggaccaagctgaccgtctaagtcagccaagctcgcccctcgtcactctcgttcccaccctctccacgagacgtactgacggcgggctcggacgtaggccgacagtacgnnnnnnnnnnnnn

SEQ ID NO: 225566 - DNA, 483 bp, Homo sapiens
  misc_feature: GYAE6OF01DKROJ.19.86.H09.1.454.CMB.1.raw
  modified_base (431)..(431): a, c, t, g, unknown or other
  misc_feature (431)..(431): n is a, c, g, or t
  modified_base (449)..(449): a, c, t, g, unknown or other
  misc_feature (449)..(449): n is a, c, g, or t
  modified_base (468)..(468): a, c, t, g, unknown or other
  misc_feature (468)..(468): n is a, c, g, or t
  modified_base (475)..(483): a, c, t, g, unknown or other
  misc_feature (475)..(483): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatcgtggatgacagtgtgtaacggtccggttttcggcggaggacagctgaccgtctagtcagccaagctcgcccctggtcactctcgtcccncctcctcacgagacgtcngacgcggctgggcaggcgnagtacgnnnnnnnnn

SEQ ID NO: 225567 - DNA, 543 bp, Homo sapiens
  misc_feature: GYAE6OF01C6KZ3.19.86.H09.1.454.CMB.1.raw
  modified_base (531)..(543): a, c, t, g, unknown or other
  misc_feature (531)..(543): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcaagaaagtcccaggaaccggcccccaaaatcgtcatctataatgacgctgagcggtccttaagggtccctgaccgattctctggcgagaggtctggcgcctcagcttcctggccatcagaggctccagtctagaagatgaggctgattattactgtgactaatcgtggatgacagtgtagacggttcggtttcggcgggaggaccaagcgtacgaccgtctaacgtcacgacccgaaggctccgccccgtcggtccacttctccgttccccgccccttccgtcccaacggacgtacgttacgcggtacggccgggtacgtcgggacacgggccgtaccgaagtacggnnnnnnnnnnnnn

SEQ ID NO: 225568 - DNA, 609 bp, Homo sapiens
  misc_feature: GYAE6OF01ASVFZ.19.86.H09.1.454.CMB.1.raw
  modified_base (226)..(226): a, c, t, g, unknown or other
  misc_feature (226)..(226): n is a, c, g, or t
  modified_base (593)..(593): a, c, t, g, unknown or other
  misc_feature (593)..(593): n is a, c, g, or t
  modified_base (597)..(597): a, c, t, g, unknown or other
  misc_feature (597)..(597): n is a, c, g, or t
  modified_base (599)..(601): a, c, t, g, unknown or other
  misc_feature (599)..(601): n is a, c, g, or t
  modified_base (603)..(605): a, c, t, g, unknown or other
  misc_feature (603)..(605): n is a, c, g, or t
  modified_base (607)..(609): a, c, t, g, unknown or other
  misc_feature (607)..(609): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacnctgagcggtccttaagggtccctgaccgattctctggagagaggtctggcgcctcagcttccctggccatcagacgggcttccagtctgaagactgaggctaggtattaatacgtgtcgcaatcgtggatgacgagtgtacggaacggttccggttttacggcgggtacgggtaccaaggtcgtacggtacccgttacgtaacgtaccgtacgacccgaagggtcctaccggtcccccgtacgggttccctaaccgttcccgttaccgtttccccctaacccccgttcccgttaccccgaaccggtacggtaaccgtacgtacgggacggtccgggctcgggacgtaacggccgaacgacgtacggnacgncnnncnnncnnn

SEQ ID NO: 225569 - DNA, 508 bp, Homo sapiens
  misc_feature: GYAE6OF01B19DO.19.86.H09.1.454.CMB.1.raw
  modified_base (498)..(508): a, c, t, g, unknown or other
  misc_feature (498)..(508): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttcctggccatcagagggctccagtctgaagatgaggctgattattactgtgcaatctggatgacagtgtgaacggtccggttttcggcggagggacaagctgaccgtctaagtcagcccaaggcctcgcccccgtcggtccactccttcgttccccaccccttccctccaccgacgagtacctggacgccgggctggcgaacggcgcatgnnnnnnnnnnn

SEQ ID NO: 225570 - DNA, 497 bp, Homo sapiens
  misc_feature: GYAE6OF01D6CO8.19.86.H09.1.454.CMB.1.raw
  modified_base (163)..(163): a, c, t, g, unknown or other
  misc_feature (163)..(163): n is a, c, g, or t
  modified_base (338)..(338): a, c, t, g, unknown or other
  misc_feature (338)..(338): n is a, c, g, or t
  modified_base (484)..(485): a, c, t, g, unknown or other
  misc_feature (484)..(485): n is a, c, g, or t
  modified_base (488)..(489): a, c, t, g, unknown or other
  misc_feature (488)..(489): n is a, c, g, or t
  modified_base (491)..(497): a, c, t, g, unknown or other
  misc_feature (491)..(497): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgcccccaaatcgtcatctataatgacgctgagcggtccttaagggccctgaccgtattctcgtggcgagaggtctggcgcctcagcttccctggccatcagagggctccagtctgaagatgagctgattattactgtncaatcgtgggatgacagtgtgacggttcggtttcggcggaggacagctcgaccgtctagcacgcccaagcctcgcccctcggcactctctcccaccctcctccacgagacgtactggacggcggcgtcggcgaacggcgacagtgnncanncnnnnnnn

SEQ ID NO: 225571 - DNA, 422 bp, Homo sapiens
  misc_feature: GYAE6OF01E5A9N.19.86.H09.1.454.CMB.1.raw
  modified_base (418)..(422): a, c, t, g, unknown or other
  misc_feature (418)..(422): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggacgcacctccgagagcacagcggccctgggctgcctggtcaaggactacttcccacgagagtactgagcgggctggcaaggcgcatagnnnnn

SEQ ID NO: 225572 - DNA, 317 bp, Homo sapiens
  misc_feature: GYAE6OF01EIICD.19.86.H09.1.454.CMB.1.raw
  modified_base (297)..(317): a, c, t, g, unknown or other
  misc_feature (297)..(317): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcaccctcctccaagagcacctctgggggcacagcggccctgggctgcctggccaaggactacttcccagagagtactgagcgggctggcaaggcgcatagnnnnnnnnnnnnnnnnnnnnn

SEQ ID NO: 225573 - DNA, 734 bp, Homo sapiens
  misc_feature: GYAE6OF01ETPR9.19.86.H09.1.454.CMB.1.raw
  modified_base (128)..(128): a, c, t, g, unknown or other
  misc_feature (128)..(128): n is a, c, g, or t
  modified_base (704)..(704): a, c, t, g, unknown or other
  misc_feature (704)..(704): n is a, c, g, or t
  modified_base (717)..(717): a, c, t, g, unknown or other
  misc_feature (717)..(717): n is a, c, g, or t
  modified_base (729)..(729): a, c, t, g, unknown or other
  misc_feature (729)..(729): n is a, c, g, or t
  modified_base (733)..(733): a, c, t, g, unknown or other
  misc_feature (733)..(733): n is a, c, g, or t
tcagtactctcgtgcacgaccggtgctcgattttagtgctatagacttggggtttcggggtccgttcctggcccagtctgtgccttgacgtctaggctacccttcacgccgttcgtgggaccccgggnagacggtcaccatcggcttgttcgtaggcaaggcaggctcgaacaagtcgggagtcaggtggtgtagatgtggtatcgacgtaaagtccgaggaaccggcccctaaactcgtacatcgtaataagtgacgctagaaacgtccgttcttaaggtcctgaccgtattcgtacgtggacgacgtaggtctacgggcgtacctacgacgtcctttccgtggtacctagtcgaggtacggtctaccgtagttaccttagtaagtatacggaggtcgttagtaatttacgttacgtcgttacgactagtcggtagggatccgagtacggtcgttacggtacgggtttccggttcggaccgggtaacggacccgtaacggtcccgttaccggttacccgttacccgttaaccggtccgaaccggtcccgtaaggtcccctacccggtcccccgttgtacccgtacccgttcccgttaccggtacccccacccgttaccgaccggtaaccggtacgtacgggttaccgtcgggaccggtcgggtacgtacgggaaccgtaacgggttccaacgttacgtacgtnacgtggactcggngtacgcgacgtngtgng

SEQ ID NO: 225574 - DNA, 659 bp, Homo sapiens
  misc_feature: GYAE6OF01CJ6QD.19.86.H09.1.454.CMB.1.raw
  modified_base (647)..(648): a, c, t, g, unknown or other
  misc_feature (647)..(648): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(657): a, c, t, g, unknown or other
  misc_feature (654)..(657): n is a, c, g, or t
  modified_base (659)..(659): a, c, t, g, unknown or other
  misc_feature (659)..(659): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaactcgtcatctataatgacgctgacgcggtaccttaagggtccctagaccgtattccgtcgtggcgagagggtctggcgcctcacgtccttccctggccatcgaggagggctccgagtctggaagatggaggctgatttatactgtgcaagtcgtagggatgacgtagttgtacggtaaccgggtttccgggttttcgggacgggaacgggtaccgtaagtcgtacggtaccgtaccgtaacgtaccgaccgacccgtaacgggtcccgtacccggtccccccgttcggtaccctaccgttcccgtttccggttaccccctacccccgttacccgtaccccgaaccggtaacggtaaccgggttaaccgtcgggtacgggcccggggtacgtaccggggtaccggaacgggtcccgtaccgaacgttacggctagcgtcnncncncnnnngn

SEQ ID NO: 225575 - DNA, 547 bp, Homo sapiens
  misc_feature: GYAE6OF01BUV12.19.86.H09.1.454.CMB.1.raw
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (534)..(535): a, c, t, g, unknown or other
  misc_feature (534)..(535): n is a, c, g, or t
  modified_base (537)..(547): a, c, t, g, unknown or other
  misc_feature (537)..(547): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagctccctggccatcagngggctccngtctgaagatgaggctgatttattactgtgcaatcgtgggatggacaggtgtaggtaacgggttccggttttcggcgggaagggaccaagtctcggacccgttccgtaagtccacgcccgaaggcctcgcccccgtcggtcacttcctccgttccccgccctccctccgacgacgtaccgtacgttcggacggccggggtcgtggaccgaacggccgcagtacgnngnnnnnnnnnnn

SEQ ID NO: 225576 - DNA, 525 bp, Homo sapiens
  misc_feature: GYAE6OF01BOKZG.19.86.H09.1.454.CMB.1.raw
  modified_base (501)..(501): a, c, t, g, unknown or other
  misc_feature (501)..(501): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctctgcgaggctttggatacaccttcagtcattatcatatactctgggtgcgacacggccctggacaagggcttgagtggagtagggcggatccgacggtggtagtggtggcgcagtacgtcgcacagaagtttcgagggccgcgtcaccatggccaaggtcgcgtccacgaatacagtgtatagtggacttgagcagcctgaggtctgacgacacggcatgtattagttgtgcggagggcgaggggacgggtacgtaaacggntaagtaaaggttcggttacccggg

SEQ ID NO: 225577 - DNA, 497 bp, Homo sapiens
  misc_feature: GYAE6OF01EKE2C.19.86.H09.1.454.CMB.1.raw
  modified_base (446)..(446): a, c, t, g, unknown or other
  misc_feature (446)..(446): n is a, c, g, or t
  modified_base (486)..(497): a, c, t, g, unknown or other
  misc_feature (486)..(497): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggttccggtttcggcggagggaccaagctcgaccgtctaagtcacgccaaggctcgcccctcgtcactctcgtcccaccctccnccacgagacgtactgacgcggcgtggcgaggcgcagtcgnnnnnnnnnnnn

SEQ ID NO: 225578 - DNA, 529 bp, Homo sapiens
  misc_feature: GYAE6OF01AWYOT.19.86.H09.1.454.CMB.1.raw
  modified_base (339)..(339): a, c, t, g, unknown or other
  misc_feature (339)..(339): n is a, c, g, or t
  modified_base (508)..(508): a, c, t, g, unknown or other
  misc_feature (508)..(508): n is a, c, g, or t
  modified_base (516)..(517): a, c, t, g, unknown or other
  misc_feature (516)..(517): n is a, c, g, or t
  modified_base (519)..(529): a, c, t, g, unknown or other
  misc_feature (519)..(529): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcagagggctccagtctgaagatgaggctgatttatactgtncaatcgtggatgacaggtgtagtaacgggttccggttttcgggcgggtagggaccgaagctacgtaccgtctaagtcgacgacccgaggcctcgcccccgtcggtccaccgtctccgttcccgcccctcctcccacgacgtacgtacctgacgcgggctggcgacggcncgagtagnngnnnnnnnnnnn

SEQ ID NO: 225579 - DNA, 533 bp, Homo sapiens
  misc_feature: GYAE6OF01C7RH9.19.86.H09.1.454.CMB.1.raw
  modified_base (263)..(263): a, c, t, g, unknown or other
  misc_feature (263)..(263): n is a, c, g, or t
  modified_base (321)..(321): a, c, t, g, unknown or other
  misc_feature (321)..(321): n is a, c, g, or t
  modified_base (494)..(494): a, c, t, g, unknown or other
  misc_feature (494)..(494): n is a, c, g, or t
  modified_base (521)..(533): a, c, t, g, unknown or other
  misc_feature (521)..(533): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgtattcnctggcgagaggtctggcgcctcagcttccctggccatcagagggctccagtctgaagntgaggctgattattactgtgctaatcgtgggatgacaggtgtggtaacgggttccgggttttcgggacgggagggaccaagtcgtacgaccgtcctaagtcacgacccgaaggcctccgcccccgtcggtccaccttcctcgttccccacccctcctccgacgacgattacgngacggcggctggccgaaggcgcagtgnnnnnnnnnnnnn

SEQ ID NO: 225580 - DNA, 528 bp, Homo sapiens
  misc_feature: GYAE6OF01AFIMQ.19.86.H09.1.454.CMB.1.raw
  modified_base (510)..(510): a, c, t, g, unknown or other
  misc_feature (510)..(510): n is a, c, g, or t
  modified_base (516)..(528): a, c, t, g, unknown or other
  misc_feature (516)..(528): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgtattctcgtggcgagaggtctggcgcctcagtcttccctggccatcaggacggctccagtctagaagatgagctgtatttatactgtgacaatcgtggatgactagtgtacggtacggttccggtttcggcgggacgggacaagcgtgaccgtctaagtcgacgcccgaacggtcctccgccccgtcggtcctactcctccgttcccaccctcctccgacgacgtacgtactgacggcggcgtcggcgaggcanagtcgnnnnnnnnnnnnn

SEQ ID NO: 225581 - DNA, 615 bp, Homo sapiens
  misc_feature: GYAE6OF01CURLB.19.86.H09.1.454.CMB.1.raw
  modified_base (265)..(265): a, c, t, g, unknown or other
  misc_feature (265)..(265): n is a, c, g, or t
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
tcagtactctcgtgcacgaccggtgctcgatttagtgctatagacttgggtttggggagcatcacccagcaaccacatctgtcctctagagaatcccctgagagctccgttcctcaccattgactggacctggaggatcctcctcttggtggcagcagccaccggagcccactcccaggtgcagctggtgcagtctggggctgaggtgaaggagccgtggggcctcgagtgaaggtctcctgcgaggtcttttggatacaccttnagtcattatcatatactgtgggtgcgacncggcccctggacaagggcttgagtggagtagggcgactcgacggtggtagtggtggcgnagtcgtcgcacgagtaagtttcgagggccgcgtaccgaccgtagtcgggaccgaaagggttccgccggttaccaacggtaataccgagttagtatagtggtacgttgacgcaacggcctggacggtctagaccgaacgaccgggtactagttgtaactttagttcggtaggtaccggagggtaccggagggggtaaccggggacgtaaaacgggtcgtaaaggttaaaacgggttcggggttaccccggtaacccccggggg

SEQ ID NO: 225582 - DNA, 487 bp, Homo sapiens
  misc_feature: GYAE6OF01EFRER.19.86.H09.1.454.CMB.1.raw
  modified_base (352)..(352): a, c, t, g, unknown or other
  misc_feature (352)..(352): n is a, c, g, or t
  modified_base (440)..(440): a, c, t, g, unknown or other
  misc_feature (440)..(440): n is a, c, g, or t
  modified_base (472)..(472): a, c, t, g, unknown or other
  misc_feature (472)..(472): n is a, c, g, or t
  modified_base (476)..(487): a, c, t, g, unknown or other
  misc_feature (476)..(487): n is a, c, g, or t
tcagtactctcgtgcacgaccggtgctcgatttagtgctatagacttgggtttgggggccggttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgagatgagctgattattactgtgcaatctgggatgacngtgtgaacggttcggtttcggcggaggaccagctgaccgtctaagtcacgcccaaggctcgcccctggtcactctcgtcccgccctcnccacgagagtactgacgcggctggcaggcacntagnnnnnnnnnnnn

SEQ ID NO: 225583 - DNA, 556 bp, Homo sapiens
  misc_feature: GYAE6OF01C2JL5.19.86.H09.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (344)..(345): a, c, t, g, unknown or other
  misc_feature (344)..(345): n is a, c, g, or t
  modified_base (520)..(520): a, c, t, g, unknown or other
  misc_feature (520)..(520): n is a, c, g, or t
  modified_base (544)..(556): a, c, t, g, unknown or other
  misc_feature (544)..(556): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcaagaaacgtcccaggaaccggacccccaaactcgtcatctataatgacgctgagcggtccttaagggtccctgaccgtattcttcgnggcgaggtaggtctggcgcctcagcctttcccgnggccancgagngcncngcaganagtnagntntatnatgnntagtgagatgacgtagtcgtacgacgggttcggtggacggacgacgtacgcgtacgtaccgtacgtacgccgacgaaccgtcggccgaccccgtcccgtacgtacctaccgtcccgttcccgtacccgttacccctacccgacgaacgttacgtaacggtcgacggtcggacggnggacggacggacgacgacgagcgnnnnnnnnnnnnn

SEQ ID NO: 225584 - DNA, 514 bp, Homo sapiens
  misc_feature: GYAE6OF01A2HWN.19.86.H09.1.454.CMB.1.raw
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (500)..(501): a, c, t, g, unknown or other
  misc_feature (500)..(501): n is a, c, g, or t
  modified_base (505)..(514): a, c, t, g, unknown or other
  misc_feature (505)..(514): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggcctccagtctgaagatgagctgattattactgtgcaatcgtgggatgactagtgtagaacggttccggtttcggcggagggaccagctgaccgtctagtcagccaagctcgcccctggtcactctcgttcccgcccttccnccacgngacgtacgtggacggcgggcgtcggacgtaaggccgacgtagtacgnngtcnnnnnnnnnn

SEQ ID NO: 225585 - DNA, 511 bp, Homo sapiens
  misc_feature: GYAE6OF01B37D1.19.86.H09.1.454.CMB.1.raw
  modified_base (355)..(355): a, c, t, g, unknown or other
  misc_feature (355)..(355): n is a, c, g, or t
  modified_base (499)..(501): a, c, t, g, unknown or other
  misc_feature (499)..(501): n is a, c, g, or t
  modified_base (503)..(511): a, c, t, g, unknown or other
  misc_feature (503)..(511): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctggatgacngtgtgaacggtcggttttcggcggagggacagctgaccgtctaagtcagcccaaggctcgcccccttggcacctcttcgttccccgccctcctcccacgacgacggtactggacggccgggctgggccaagggcgccgagtagnnngnnnnnnnnn

SEQ ID NO: 225586 - DNA, 515 bp, Homo sapiens
  misc_feature: GYAE6OF01E0ULI.19.86.H09.1.454.CMB.1.raw
  modified_base (468)..(468): a, c, t, g, unknown or other
  misc_feature (468)..(468): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagtaagtttcagggccgcgtcaccatggccaaggtcgcgtccacgaactacagtgtatatggacttgagcagcctgaggtctgacgacacggccatgtattattgtgngaggcgagggacgggctaaaggctaagtaagttggtccgtaccccgg

SEQ ID NO: 225587 - DNA, 421 bp, Homo sapiens
  misc_feature: GYAE6OF01DTPVC.19.86.H09.1.454.CMB.1.raw
  modified_base (418)..(421): a, c, t, g, unknown or other
  misc_feature (418)..(421): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaaggcataaagtggttcgacccctggggccagggaaccctggtcaccgtctcctcagcctcaccaagggcccatcggtcttccccctggccgccctgctccaggagcacctccgagacgcacagcggcctgggctgcctggtcaaggactacttcctacgagagtactgagcgggctggcaaggcacatagnnnn

SEQ ID NO: 225588 - DNA, 423 bp, Homo sapiens
  misc_feature: GYAE6OF01EYDBJ.19.86.H09.1.454.CMB.1.raw
  modified_base (419)..(423): a, c, t, g, unknown or other
  misc_feature (419)..(423): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaaggcataaagtggttcgacccctggggccagggaaccctggtcaccgtctcctcagcctccaccaagggcccatcggtcttccccctggcgccctgctccaggagcacctccgagacgcacagcggcccctgggctgcctggtcaaggctacttcccacgagagtactgagcgggctggcaaggcgcatagnnnnn

SEQ ID NO: 225589 - DNA, 567 bp, Homo sapiens
  misc_feature: GYAE6OF01CK8T7.19.86.H09.1.454.CMB.1.raw
  modified_base (353)..(353): a, c, t, g, unknown or other
  misc_feature (353)..(353): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcgagtgaaggtctcctgcgaggcttttggatacaccttcagtcattatcatatactctgggtgcgacaggcccctggacgaagggcttggagtggagtagggcggatccgaggtggtagtggtggcgnagtacgtcgcacagtaagtttcgagggccgcgtcaccgatcggccgaagggtcgcgttaccacgaatacgagtgtagtagtaggtactttgacgcacgaccgttggagggttctaggaccgaacgaccggcctagtgttaatttagttggtcgacggaggccgaggggacgggacgtaaagggctaaggtaaagtgggttcccgtaaccccggg

SEQ ID NO: 225590 - DNA, 493 bp, Homo sapiens
  misc_feature: GYAE6OF01DPAYH.19.86.H09.1.454.CMB.1.raw
  modified_base (352)..(352): a, c, t, g, unknown or other
  misc_feature (352)..(352): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
  modified_base (485)..(493): a, c, t, g, unknown or other
  misc_feature (485)..(493): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttcctggccatcagagggctccagtctgaagatgaggctgattattactgtgcaatctggatgacngtgtgacggtcggtttggcggacgggacaagctggaccgtctaacgtcgagacccaaggctcgcccctcgtccactcctcgttcccaccctcctccacgngacgtacngacgcggcgtcgcgaggcngactgnnnnnnnnn

SEQ ID NO: 225591 - DNA, 527 bp, Homo sapiens
  misc_feature: GYAE6OF01EKE7K.19.86.H09.1.454.CMB.1.raw
  modified_base (294)..(294): a, c, t, g, unknown or other
  misc_feature (294)..(294): n is a, c, g, or t
  modified_base (518)..(527): a, c, t, g, unknown or other
  misc_feature (518)..(527): n is a, c, g, or t
tcagtactctcgtgcacgaccggtgctcgatttagtgctatagacttgggtttgggggccgttcctgggcccagtctgtgctgactcaggcaccctcagcgtctgggaccccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggccgcctcagcttcccnggccatcagagggctccagtctgagatgagctgtattattactgtgcaatcgtgggatgactaggtgtgacgggttccggtttcggcgggagggaccaagctcggaccgtcgtaacgtcacgacccaaggcctccggccccctcggtccaccttcctccgttccccaccctcctcccacgacgacgtactcggcggccgggcgtcggcgtaggccacgagtcgnnnnnnnnnn

SEQ ID NO: 225592 - DNA, 501 bp, Homo sapiens
  misc_feature: GYAE6OF01B7LI7.19.86.H09.1.454.CMB.1.raw
  modified_base (451)..(451): a, c, t, g, unknown or other
  misc_feature (451)..(451): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
  modified_base (491)..(501): a, c, t, g, unknown or other
  misc_feature (491)..(501): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaaatcgtgggatgacagtgtagaacggttccggttttcggcggagggaccaagctgaccgtctaagtcacgcccaaggctcgcccctggtcactctcgttccccaccctccnccacgagacgtactgacgcgggntcggcaaggcgnatcgnnnnnnnnnnn

SEQ ID NO: 225593 - DNA, 502 bp, Homo sapiens
  misc_feature: GYAE6OF01BF4M4.19.86.H09.1.454.CMB.1.raw
  modified_base (261)..(261): a, c, t, g, unknown or other
  misc_feature (261)..(261): n is a, c, g, or t
  modified_base (341)..(341): a, c, t, g, unknown or other
  misc_feature (341)..(341): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
  modified_base (491)..(493): a, c, t, g, unknown or other
  misc_feature (491)..(493): n is a, c, g, or t
  modified_base (496)..(502): a, c, t, g, unknown or other
  misc_feature (496)..(502): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgcccccaaactcgtcatctataatgacgctgagcggtccttaagggtccctgaccgattcnctggcgagaggtctggcgcctcagcttccctggcccatcagagggctccagtctagaagatgaggctgattattactgtncaatcgtggatgacagtgtagtacgggttcggtttcggcgggaggaccagctgaccgtcagtcagccaaggcctcgccccgtcgtcactctcgtccccncctccnccacgagacgtacnggacgcgggcgtggcgaaggcgacagtgnannncgnnnnnnn

SEQ ID NO: 225594 - DNA, 612 bp, Homo sapiens
  misc_feature: GYAE6OF01CG1KY.19.86.H09.1.454.CMB.1.raw
  modified_base (351)..(351): a, c, t, g, unknown or other
  misc_feature (351)..(351): n is a, c, g, or t
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
  modified_base (605)..(606): a, c, t, g, unknown or other
  misc_feature (605)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
tcagtactctcgtgcacgaccggtgctcgatttagtgctatagacttgggtttggggccgttcctgggcccagtctgtgctgactcaggcaccctcagcgtctcgggaccccgggcagacggtcaccatcgcttgttctgcaagcagctcgaacagtcgggagcagtggtgtgatgtggtatcagaaacgtcccaggaaccgccccaaatcgtcatctataatgacgctgagcggtccttaagggtccctaggaccgtattctcgtggcgagaggtctggcgcctcacgcttcccgtggccagtccgagacgggctccagtctgaagatgaggctggatttagtactggtnctaatcgtagggatgactagtggttacgaaccggtttcggtttcggacgggtacggaccgtagcgtcgaaccgttcgtaacgtcacgacccgtaaggtcctaccggcccccgttggtcccgtaccttcccgtcggttccccgaccccttcccgtcccgaacggtacggtaacgttccgttacggaaccgggtccgggtaccttacggggaccgtacgggacccgtacgaacgttacggncggngcgncgtcncnncngngn

SEQ ID NO: 225595 - DNA, 613 bp, Homo sapiens
  misc_feature: GYAE6OF01D1WJR.19.86.H09.1.454.CMB.1.raw
  modified_base (96)..(96): a, c, t, g, unknown or other
  misc_feature (96)..(96): n is a, c, g, or t
  modified_base (261)..(261): a, c, t, g, unknown or other
  misc_feature (261)..(261): n is a, c, g, or t
  modified_base (317)..(317): a, c, t, g, unknown or other
  misc_feature (317)..(317): n is a, c, g, or t
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (609)..(613): a, c, t, g, unknown or other
  misc_feature (609)..(613): n is a, c, g, or t
tcagtactctcgtgcacgaccggtgctcgatttagtgctatagacttgggtttgggggccgttcctgggcccagtctgtgctgactcaggcacctnagcgtctgggacccccgggcaggacggtcaccatcgcttgttctgcaagcagctgaacatcgggagcagtggtgtgatgtggtatcagaaagtcccaggaaccggcccccaaatcgtcatctaataatgacgctgagcggtccttaagggtccctgaccgattcnctggcgtagaggtctggcgctcagcttcctggccatcagaggctccagtctgaagntgaggctgattattactgtgcaatctgggatgactaggtgtaggtaacgggttccggttttcggacgggaacgggaccaagtccgttaggacccgttcctaaaggtccacggtaccccgaaaggtccgtccggccccccgttcgggtaccctaaccgtttccgtttccggtttaccccctaacccccgttcccgttacccgaaccggtaacggtaacgttaccgttacggaacggtccgggcgttcgggaccgaaagggtcccgacaaccggttacggngcgngcnacncannnnn

SEQ ID NO: 225596 - DNA, 519 bp, Homo sapiens
  misc_feature: GYAE6OF01A8NQA.19.86.H09.1.454.CMB.1.raw
  modified_base (348)..(348): a, c, t, g, unknown or other
  misc_feature (348)..(348): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgnatacgtcgcacagaagtttcgagggccgcgtcaccatcggccaagggtcgcgtccacgaatacagtgtatatggacttgagcagcctggaggtctgacgacgacggccagtgtattagttgtgcgaggcagggacgggactaaagggcaagtaagtggttacgaccccggg

SEQ ID NO: 225597 - DNA, 508 bp, Homo sapiens
  misc_feature: GYAE6OF01BY34D.19.86.H09.1.454.CMB.1.raw
  modified_base (496)..(497): a, c, t, g, unknown or other
  misc_feature (496)..(497): n is a, c, g, or t
  modified_base (499)..(508): a, c, t, g, unknown or other
  misc_feature (499)..(508): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtccgtaagtcagccaaggctcgcccctcggtcactctcgttcccaccctcctccacgacgacgtaccgtgaggccgggctcggcaacgggccgcgagtagnncnnnnnnnnnn

SEQ ID NO: 225598 - DNA, 679 bp, Homo sapiens
  misc_feature: GYAE6OF01CFLH0.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggagccgtggggcctcgaggtggaaggtctccgtggcggtaggtcgttttggacttacctaccttcagtctattatcattactactcgtggggtgcgacgacggcccgtaggacgaagggtcttaggaggtggagtagggcggagtccgacgggtggtaggtggtggcgactagtaccggtcgacgacgtaggtaacgtttcggacgggccgtcgtaccacgacgtcgggaccgaacgggtccgaccgtaccgaacgtaactacgaaggttacgtaagtagtacgggtacttaggacgtcgacgggtcccgttagggacggttaccgtggaaccgtaccgaccgggtcttaagtacgttaacgtttaggttggtcggagggtacgggtcgggaacgggggaacggggtaacgtaaaacgggtacgtaaaggttaaacggggttccgggttcccgggtaacccccgggg

SEQ ID NO: 225599 - DNA, 535 bp, Homo sapiens
  misc_feature: GYAE6OF01CIS2T.19.86.H09.1.454.CMB.1.raw
  modified_base (257)..(257): a, c, t, g, unknown or other
  misc_feature (257)..(257): n is a, c, g, or t
  modified_base (323)..(323): a, c, t, g, unknown or other
  misc_feature (323)..(323): n is a, c, g, or t
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
  modified_base (527)..(531): a, c, t, g, unknown or other
  misc_feature (527)..(531): n is a, c, g, or t
  modified_base (533)..(535): a, c, t, g, unknown or other
  misc_feature (533)..(535): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgnttctctggcgagtaggtctggcgcctcagccttcccgtggccatcgagagggctccagtctgaagntgaggctgatttatctgtgcaatcgtgggatgactagtgtcgaacggttccgggtttcggacgggagggaccagtctcggaccgttaccgtaagcacgccgaacggctccgccccgtcggtccacttcctccgtcccaccctcctccacgtagacgtacgtcgaggtccggcgtacggcgaacggccggactagtcgncnncgnnnnncnnn

SEQ ID NO: 225600 - DNA, 695 bp, Homo sapiens
  misc_feature: GYAE6OF01C3LWM.19.86.H09.1.454.CMB.1.raw
  modified_base (164)..(164): a, c, t, g, unknown or other
  misc_feature (164)..(164): n is a, c, g, or t
  modified_base (310)..(310): a, c, t, g, unknown or other
  misc_feature (310)..(310): n is a, c, g, or t
  modified_base (669)..(669): a, c, t, g, unknown or other
  misc_feature (669)..(669): n is a, c, g, or t
  modified_base (673)..(673): a, c, t, g, unknown or other
  misc_feature (673)..(673): n is a, c, g, or t
  modified_base (679)..(679): a, c, t, g, unknown or other
  misc_feature (679)..(679): n is a, c, g, or t
  modified_base (684)..(684): a, c, t, g, unknown or other
  misc_feature (684)..(684): n is a, c, g, or t
  modified_base (688)..(688): a, c, t, g, unknown or other
  misc_feature (688)..(688): n is a, c, g, or t
  modified_base (690)..(690): a, c, t, g, unknown or other
  misc_feature (690)..(690): n is a, c, g, or t
  modified_base (692)..(692): a, c, t, g, unknown or other
  misc_feature (692)..(692): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggancagtggtgtgatgtggtatcaagaaagtcccaggaaccggcccccaaatcgtcatctataatgacgctgagtcggtccgttaagggtccctgacccgtatttcctcgtggcgagtacggtctggccgccttcaggtcctttcccgnggccatcaggacggtcctccagtctagaagatgaggtctgtattagttacttgtgtacaagtcgtagggatagacgtaggtgtacggaaccgggtttcgggtttacggacgggtaacgggaccgtaaggtccgttacggaaccccgttaccgtaaacggtacccgtacggtacccccggtaaaggtcccgttacccggaccccccgtttcgggttacccctaacccgtttcccgtttaccccggttaccccctaaccccgttcccgttaaccccgaaccggtaccgtaacccgggttaaccgtaccgggaacgggtcccgggacgtaccggacggacgggtacccgaagtacgtaacgngacngtacgntcacncgcncngngcg

SEQ ID NO: 225601 - DNA, 504 bp, Homo sapiens
  misc_feature: GYAE6OF01EUMDI.19.86.H09.1.454.CMB.1.raw
  modified_base (475)..(475): a, c, t, g, unknown or other
  misc_feature (475)..(475): n is a, c, g, or t
  modified_base (496)..(504): a, c, t, g, unknown or other
  misc_feature (496)..(504): n is a, c, g, or t
tcagtactctcgtgcacgaccggtgctcgatttagtgctatagacttgggtttgggggccgttcctgggcccagtctgtgctgactcaggcacccctcagcgtctgggaccccccgggcatacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagtccttcccctggccatcaggacgggctccagtctgaagatgaggctgattattactgtgcaatctgggatgacagtgtagaacgggttccggtttcggcgggagggaccaagcgtgaccgtctaagtcacgccagctggcccccctcggtcactctgttccccaccctcctccacgagagtactgancgggctgggcaaggcgcatgnnnnnnnnn

SEQ ID NO: 225602 - DNA, 561 bp, Homo sapiens
  misc_feature: GYAE6OF01BFMEG.19.86.H09.1.454.CMB.1.raw
  modified_base (320)..(320): a, c, t, g, unknown or other
  misc_feature (320)..(320): n is a, c, g, or t
  modified_base (514)..(514): a, c, t, g, unknown or other
  misc_feature (514)..(514): n is a, c, g, or t
  modified_base (539)..(539): a, c, t, g, unknown or other
  misc_feature (539)..(539): n is a, c, g, or t
  modified_base (549)..(549): a, c, t, g, unknown or other
  misc_feature (549)..(549): n is a, c, g, or t
  modified_base (551)..(561): a, c, t, g, unknown or other
  misc_feature (551)..(561): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcacgcttccctggccatcaggaggctccagtctgaagntgaggctgtatttattactgtgctatcgtggatgaactaggtgtaggtacgggttccggttttcgggcgggtagggaccaaggtcgtacggaccgtacctaagtcacgacccgaacggtctcccggcccccgttcggtcctaccttccgttccgttccccctaccccttccctccgaccgacggacgttaccgnggacggcgggtcgtcggcgacggcncgtagtacgncnnnnnnnnnnn

SEQ ID NO: 225603 - DNA, 428 bp, Homo sapiens
  misc_feature: GYAE6OF01C33BD.19.86.H09.1.454.CMB.1.raw
  modified_base (330)..(330): a, c, t, g, unknown or other
  misc_feature (330)..(330): n is a, c, g, or t
  modified_base (422)..(428): a, c, t, g, unknown or other
  misc_feature (422)..(428): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgaccctggggccagggaaccctggtcaccgtctcctcagcctccaccaagggcccatcggtcttccccctggccgccctgctccaggngcacctccgagagcacagcggccctgggctgcctggtcaaggacctacttcccacgagagtactgagcgggctgggcaagggcgcagtacgnnnnnnn

SEQ ID NO: 225604 - DNA, 529 bp, Homo sapiens
  misc_feature: GYAE6OF01CF376.19.86.H09.1.454.CMB.1.raw
tcagtactctcgtgcacgaccggtgctcgatttagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacgggctaaaggcataaagtgttcgaccctgggccagggaaccctggtcaccgtctcctcagcctccaccaacgggcccatcggtcttcccctggcgccctgcctccgacggagcacctccgagacgcacagccggccctgggccg

SEQ ID NO: 225605 - DNA, 566 bp, Homo sapiens
  misc_feature: GYAE6OF01CRQK0.19.86.H09.1.454.CMB.1.raw
  modified_base (373)..(373): a, c, t, g, unknown or other
  misc_feature (373)..(373): n is a, c, g, or t
  modified_base (471)..(471): a, c, t, g, unknown or other
  misc_feature (471)..(471): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggagccgtggggcctcgagtgaaggtctcctgcgaggtcttttggatacaccttcagtcattatctatatactctgggtgcgacgacggcccctaggacaagggtcttgagtggagtagggcgagtccgacggtggtaggtgggtggcgcagtacgtcgcanagtaacgtttcgacgggccgcgtacaccagtcggaccgaggtccgcgtaccaacgtaactacgagtagtatagtggacgttgagcacgcgtgagtcgngacgacgacggctagttacgtattagttgtggacggagggcgaaggggacggagtaaacggctaaagtaaacggtcgggtacccgtaccccgggg

SEQ ID NO: 225606 - DNA, 506 bp, Homo sapiens
  misc_feature: GYAE6OF01ETW0L.19.86.H09.1.454.CMB.1.raw
  modified_base (308)..(308): a, c, t, g, unknown or other
  misc_feature (308)..(308): n is a, c, g, or t
  modified_base (439)..(439): a, c, t, g, unknown or other
  misc_feature (439)..(439): n is a, c, g, or t
  modified_base (494)..(499): a, c, t, g, unknown or other
  misc_feature (494)..(499): n is a, c, g, or t
  modified_base (501)..(506): a, c, t, g, unknown or other
  misc_feature (501)..(506): n is a, c, g, or t
tcagtactctcgtgcacgaccggtgctcgattttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggcnccagtctgaagatgaggctgattattactgtgcaatctgggatgacagtgtggacggttcggtttcggcggaggaccagctgaccgtctaagtcacgccaaggctcgccccgtggtcactctcgttccccnccctcctccacgacgacgtacgtgacggcggcgtcggcgaacggcgacagtacgnnnnnncnnnnnn

SEQ ID NO: 225607 - DNA, 727 bp, Homo sapiens
  misc_feature: GYAE6OF01DAVOJ.19.86.H09.1.454.CMB.1.raw
  modified_base (703)..(703): a, c, t, g, unknown or other
  misc_feature (703)..(703): n is a, c, g, or t
  modified_base (711)..(711): a, c, t, g, unknown or other
  misc_feature (711)..(711): n is a, c, g, or t
  modified_base (720)..(720): a, c, t, g, unknown or other
  misc_feature (720)..(720): n is a, c, g, or t
  modified_base (722)..(722): a, c, t, g, unknown or other
  misc_feature (722)..(722): n is a, c, g, or t
  modified_base (724)..(724): a, c, t, g, unknown or other
  misc_feature (724)..(724): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgtattctctggcgagaggtctggcgcctcagtccttcccgtggccctatcaggacgggctccgtagtctagaagatgaggctgtatttattactgtcgctaagtcgtagggatggacgtagttggtacggtaacggggtttccgggttttacgggacgggtacgggaacccgtaaggtccgttacggtaaccccggttaccgtaaacggttcccgaaccgggtaccccgtaaacgggtccccgttaccccgggtccccccccgtttaccggggttacccctaccccgtttcccgtttaccccgtttacccccccctacccccgttccccgtaccccgtaaccgggtaaccggtaaccggttaccggtacggggtaccgggtcccgggggtaccggttaccggggaacccggtaaacggggtccccgtaaccgtaaaggtaccggganacgcgcgngcgtcgcgncngngcg

SEQ ID NO: 225608 - DNA, 524 bp, Homo sapiens
  misc_feature: GYAE6OF01BP2Q5.19.86.H09.1.454.CMB.1.raw
  modified_base (213)..(213): a, c, t, g, unknown or other
  misc_feature (213)..(213): n is a, c, g, or t
  modified_base (491)..(491): a, c, t, g, unknown or other
  misc_feature (491)..(491): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggngcctggggcctcagtgaaggtctcctgcgaggcttttggatacaccttcagtcattatcatatactctgggtgcgacaggcccctggacaagggcttggagtgggatagggcggatccgacggtggtaggtgggtggcgcatacgtcgcacgagaagtttcagggccgcgtcacatggccaagggtcgcgtccacgaatacgagtgtatagtgacttgagcagcctgacgggttctaggacgacgacggccagttgtattagttgtgcgaggcagggngggactaaggcaagtaagtggttccgaccccgg

SEQ ID NO: 225609 - DNA, 558 bp, Homo sapiens
  misc_feature: GYAE6OF01C2MFM.19.86.H09.1.454.CMB.1.raw
  modified_base (482)..(482): a, c, t, g, unknown or other
  misc_feature (482)..(482): n is a, c, g, or t
  modified_base (544)..(545): a, c, t, g, unknown or other
  misc_feature (544)..(545): n is a, c, g, or t
  modified_base (550)..(558): a, c, t, g, unknown or other
  misc_feature (550)..(558): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgtctgcaagcagctcgaacatcgggagcagtggtgtgatgtggtatcagaaagtcccaggaaccgccccaaatcgtcatctataatgacgctgagtcggtaccttaagggtccctgaccgattctcgtggcgagaggtcgtggcgtcctcagtccttccgtcggccatcgagacgggctccgagtctgaagatggaggctgtattacttactgtgacaagtcgtggatgacagtgtacggtacgggttcggttttcgggcgggtaacgggaccgaagtccgtcgacccgttaccgtaacgtacgacgcccgaaggcctcgcccctcggtcacttcctccgttccccnccctcctccacgacgtacgtacgtcggacgccgggcgtcggaccgaacgggccgacacgtgnntcgannnnnnnnn

SEQ ID NO: 225610 - DNA, 587 bp, Homo sapiens
  misc_feature: GYAE6OF01BFBYX.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggagcctggggcctcagtgaaggtctcctgcgaggtcttttggatacaccttcagtcattatcatatactctgggtgcgacacggccccgtaggacgaagggcttgaggtggagtagggcggagtccgacgggtggtagtggtggcgcagtacgtcgcacgagtaagtttcgagggccgcgtcaccgagtggacccgaaggttccgaccgtaccaacgaaatacgagttgtatagtggacttgacgacacgaccgtggacggtctggaaccgtacgaccggcctaagttcgttagttagttggtggcggaagggcgaaggggacggggactaaacgggactaaggttaaacggttcggttacccggtaaccccggg

SEQ ID NO: 225611 - DNA, 535 bp, Homo sapiens
  misc_feature: GYAE6OF01EFN49.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctcctgcgaggcttttggatacaccttcagtcattatcatatactctgggtgcgacaggcccctggacaagggcttgagtggagtagggcggatccgacggtggtagtgggtggcgcagtacgtcgcacagaagtttcgagggcgcgtcgacatggacctaagggtcgcgtccacgaatacaggtgtatatggacttggagcagccgtgaggtctggacgacacggcagtgtattagttgtgcggaggccaaggggacgggactaaagggctaaagtaaacggtgggtaccgaccccggg

SEQ ID NO: 225612 - DNA, 665 bp, Homo sapiens
  misc_feature: GYAE6OF01DKTHQ.19.86.H09.1.454.CMB.1.raw
  modified_base (320)..(320): a, c, t, g, unknown or other
  misc_feature (320)..(320): n is a, c, g, or t
  modified_base (652)..(652): a, c, t, g, unknown or other
  misc_feature (652)..(652): n is a, c, g, or t
  modified_base (654)..(665): a, c, t, g, unknown or other
  misc_feature (654)..(665): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacagtcggggagcaggtggtgtgatgtggtatcagaaaacgtcccgaagggaacccggcccccaaacgtcgtcatctaataatgacgctgagtccggtaccgttaacgggtccctggaccgtattctcgtggcgagaggtcgtcggcgcctcgacgtccttcccgnggccactcgaggacgggtcctaccgacggttccgtaggaagtacgttagggacggtcgtaggttaatttacgtttaacgttggtacgacgtaaacttcgggtagggtacgtacggtaaccggtaggttacgggttaccgggttaaaccggggttttcccgggggttttacgggaccgggggttaccgggaaccgtaacggtcgtacgtaccgttacgtacgtcgacgccgtaacgcctccgcccgtcgtcctacgtccttcccgtcccctccctcctccgaccgtacgacgttcgcggacggtccggacgtacggcggaagcggacacgtgngnnnnnnnnnnnn

SEQ ID NO: 225613 - DNA, 606 bp, Homo sapiens
  misc_feature: GYAE6OF01EKIN1.19.86.H09.1.454.CMB.1.raw
  modified_base (353)..(353): a, c, t, g, unknown or other
  misc_feature (353)..(353): n is a, c, g, or t
  modified_base (588)..(588): a, c, t, g, unknown or other
  misc_feature (588)..(588): n is a, c, g, or t
tcagtactctcgtgcacgaccggtgctcgatttagtgctatagacttgggtttgggggaagaggaagactgacggtcccactcccaggtgcagctggtgcagtctggggctgaggtgaaggagcctggggcctcagtgaaggtctcctgcgaggctttttggatacaccttcagtcatttatcatatactctgggtgcgacaggcccctggacaagggcttgagtggatagggcgatccgacggtggtagtggtggcgcatacgtcgcacagaagtttcgagggccgcgtcaccatcggccaaggtcgcgtccacgaatacagtgtatatggacttgagcagcctgacggtcngacgacgacggccagtgtattacgtgtgcggaggcgagggacggggactaaaggcaagtaaagtcggttaccgaccccgtggggacccgaacgggtaacccgtgggtaccacccggttcctccctacgacgtccctaccaaccgaaccgggtcccctacgttccggttcccttcccccgtcggcccgtcccgtcgccctccgacggacgcctacccgtccggacgacgcaaccgnggcccggccgtgggcccg

SEQ ID NO: 225614 - DNA, 564 bp, Homo sapiens
  misc_feature: GYAE6OF01D85QE.19.86.H09.1.454.CMB.1.raw
  modified_base (551)..(553): a, c, t, g, unknown or other
  misc_feature (551)..(553): n is a, c, g, or t
  modified_base (555)..(564): a, c, t, g, unknown or other
  misc_feature (555)..(564): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcgaggacgggctccgagtctgaagatgagctgattatactgtgcaatcgtgggatgactagtggtacgtaaccgggttccggttttcgggcgggaacgggaccaaggcgtacggtaccgtacgtaacgtcacgcccgaaggtcctaccgccccccgttcggtcctaccgttccgtccgttacccctaccccttcccgtcccgaacggtacgtacgtaccgtggacgccgggctcggcgaacggcgacagtagnnngnnnnnnnnnn

SEQ ID NO: 225615 - DNA, 510 bp, Homo sapiens
  misc_feature: GYAE6OF01EUI3S.19.86.H09.1.454.CMB.1.raw
  modified_base (476)..(476): a, c, t, g, unknown or other
  misc_feature (476)..(476): n is a, c, g, or t
  modified_base (496)..(498): a, c, t, g, unknown or other
  misc_feature (496)..(498): n is a, c, g, or t
  modified_base (500)..(501): a, c, t, g, unknown or other
  misc_feature (500)..(501): n is a, c, g, or t
  modified_base (503)..(504): a, c, t, g, unknown or other
  misc_feature (503)..(504): n is a, c, g, or t
  modified_base (507)..(510): a, c, t, g, unknown or other
  misc_feature (507)..(510): n is a, c, g, or t
tcagtactctcgtgcacgaccggtgctcgattttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcgtccttaagggtcctgaccgtattctctggcgagaggtctggcgcctcagtcttccctggccatcagacgggctccgagtctgaagatgaggctgattattactgtgctaatctagggatgacagtgtagaacggttcggtttcggacggaggaccagcgtagaccgtctaacgtcagcccaaggcgtcgccccgtgtcactcgtcgttcccccacctcctccacgagagtactgacgcggngtcggcaaggcacgtagtgnnngnnanncannnn

SEQ ID NO: 225616 - DNA, 587 bp, Homo sapiens
  misc_feature: GYAE6OF01BIB47.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagccccactcccaggtgcagctggtgcagtctggggctgaggtgaaggagccgtggggcctcagtgaaggtctcctgcgaggtctttggatacaccttcagtcattatcatatactctggtgcgacaggcccctggacaagggcttgagtggagtagggcggatccgacgggtggtagtgggtggcgcagtacgtcgcacagtaagtttcgacgggtccgcgtaccaccgtagtcggaccaagggtccgacgtccaacgatacagtatagtagtggacttgagcagcccgtggacggtctaggaccgacgacggcctagttcgttaatttagttgtcggtacggtacgggcgaacgggggaccggggacgttaaacgggacgtaaagttaaacgggttcgggtttcccggtaacccccgggg

SEQ ID NO: 225617 - DNA, 544 bp, Homo sapiens
  misc_feature: GYAE6OF01CL5ZH.19.86.H09.1.454.CMB.1.raw
  modified_base (260)..(260): a, c, t, g, unknown or other
  misc_feature (260)..(260): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (538)..(544): a, c, t, g, unknown or other
  misc_feature (538)..(544): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgattcntggcgagaggtctggcgcctcagcttcctggccatcagagggctccagtctgaagatgaggctgattattactgtgcaatcgtggatgacagtgtagtacggttcggtttcggcgggaggaccaagcgtacgtaccgtactaagtcacgccaacggcctcgtcccccgtcggtccaccttcgtccgttccccgtccctcctacccgacgacgtacgtacgtacgacggccgggtctacgggccgaaacgggccgacgtaagtacggctagctnancgnnnnnnn

SEQ ID NO: 225618 - DNA, 585 bp, Homo sapiens
  misc_feature: GYAE6OF01DFGD8.19.86.H09.1.454.CMB.1.raw
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggatagggcgatccgacggtggtagtggtggcgcatacgtcgcacagaagtttcgagggccgcgtcaccagtggccaaggtcgcgtccacgaatacagtgtatagtggacttgagcagcctggagtctgacgacacggcctatgtattattgtgcgaggcgagggacgggactaaggcaagtaaagtcggttaccgacccggtgggaccgagggtaacccgtggtaccaccgtctctccgacgtccctaccgaccgaacgggcccctaacgttccggtacccttccccgtggcccgtcccgtcgcctccgacggacgccacccgtccggaagacgccacgaggcccggtccgtgggtcccg

SEQ ID NO: 225619 - DNA, 668 bp, Homo sapiens
  misc_feature: GYAE6OF01BTB82.19.86.H09.1.454.CMB.1.raw
  modified_base (652)..(652): a, c, t, g, unknown or other
  misc_feature (652)..(652): n is a, c, g, or t
  modified_base (656)..(657): a, c, t, g, unknown or other
  misc_feature (656)..(657): n is a, c, g, or t
  modified_base (659)..(659): a, c, t, g, unknown or other
  misc_feature (659)..(659): n is a, c, g, or t
  modified_base (661)..(664): a, c, t, g, unknown or other
  misc_feature (661)..(664): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctcgtggcgagaggtctggcgcctcagtcttcccgtggccatcgagacgggtctccgagtctagaagtagtgaggcttgtagtttattactggtgactaagtcgtggtatgactaggttggtacggtaacgggtttccgggttttcggacggggtacgggaacccgtaaggtccgtcggtaacccggttacccgttaaacggtccgtaacggaccccgtaacgggtcccgttaccggccccccgtttcggttaccctaacccggtttcccgtttcccggtttccccccggtcccccttaccccgtaccccgtaaccggtaccggtaccggttaccgtacgggaaccggtccggggtcgtaccgggacgaaccgggccgtaccgtaagtcgacgncgcnncncnnnngngn

SEQ ID NO: 225620 - DNA, 749 bp, Homo sapiens
  misc_feature: GYAE6OF01ECTP8.19.86.H09.1.454.CMB.1.raw
  modified_base (722)..(722): a, c, t, g, unknown or other
  misc_feature (722)..(722): n is a, c, g, or t
  modified_base (735)..(735): a, c, t, g, unknown or other
  misc_feature (735)..(735): n is a, c, g, or t
  modified_base (741)..(741): a, c, t, g, unknown or other
  misc_feature (741)..(741): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcagaaacgtcccaggaaccgccccaaactcgtcatctataatgacgctgacgtccggttaccgttaacgggtccctagaccgtattcctcgtgggacgaaggtacgggttccgtcgggccgtacccttcgacgtcccttccccgtaggccctagtccgaggaccgggtccttaccgagttccgtaggaacgtagtaggacggtcttaggtaattttacgttacgttggacgtactaagttcgtaggggatggacgtaggttcggtacgggtaaccgggtttccggggtttacgggacgggtaacgggacctaaggtccgttacggtaacccggttacgttaaacggtccaaccggtacccgtaacgggtccccgttacccggtcccccggttacgttacccgtacccgtttcccgttccccggtttacccccgccccttacccgtacccgaaccgggtacgtaacgttaccgtgggtaaccgggtcccgggtacgtacgggtaaccggaacgggtcccgttacggtaaacgtcgggacncgtgtacgcgtcncgcacncgngngcg

SEQ ID NO: 225621 - DNA, 555 bp, Homo sapiens
  misc_feature: GYAE6OF01ETWOI.19.86.H09.1.454.CMB.1.raw
  modified_base (518)..(518): a, c, t, g, unknown or other
  misc_feature (518)..(518): n is a, c, g, or t
  modified_base (544)..(555): a, c, t, g, unknown or other
  misc_feature (544)..(555): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgtattctctggcgagaggtctggcgcctcagcttccctggccatcaggagggctccagtctgaagatgaggctgattattactgtgcaatcgtgggatgactagtgtagaaccgggttccggttttcgggacgggtagggaaccaagccttacggacccgttccgtaaagtcgagacccaagggcctcggcccccctcgggtaccaccttccgtcgttcccccaccctcccgtccaacgagacgtactggacggcgggtacgnggtccgaacggccgacgagtacggannnnnnnnnnnn

SEQ ID NO: 225622 - DNA, 422 bp, Homo sapiens
  misc_feature: GYAE6OF01DC1Y6.19.86.H09.1.454.CMB.1.raw
  modified_base (417)..(422): a, c, t, g, unknown or other
  misc_feature (417)..(422): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggactacttcccacgagagtactgagcgggctggcaaggcgcatagnnnnnn

SEQ ID NO: 225623 - DNA, 610 bp, Homo sapiens
  misc_feature: GYAE6OF01DWJ26.19.86.H09.1.454.CMB.1.raw
  modified_base (120)..(120): a, c, t, g, unknown or other
  misc_feature (120)..(120): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (599)..(599): a, c, t, g, unknown or other
  misc_feature (599)..(599): n is a, c, g, or t
  modified_base (606)..(607): a, c, t, g, unknown or other
  misc_feature (606)..(607): n is a, c, g, or t
tcagtactctcgtgcacgaccggtgctcgatttagtgctatagacttgggggtttgggggccgttcctgggcccagtctgtgctgactcaggcaccctcaggcgtctgggacccccgggnagacgtccaccatcgcttgttctgcaagcagctcgaacatcgggagcagtggtgtgatgtggtatcaagaaacgtcccaggaaccgcccccaaactcgtcatctaataatgacgctgagtcggtaccttaacgggtccctagaccgtattctcgtggcgagtaggtctggccgcctcacgccttcccgtacggcctatcgagagggctccgagtctgaagctgagcgtgtattattactgtgactaatcgtggatgacaggtgtacggtaccgggttccggtttcgggacggtaacgggtaccgaacgtcgtcggtaacccgttcgtaacgtacgacggaacccgaaggtccgtccgtccccgttacggtacctaccttccgtccgttaccccgtaccctcccgtaccgacgaacgtacgtacgtggacggtccgggtcgtcggtaccgaacggccgacgaagtcgancgtcngngtcncacaccnntgc

SEQ ID NO: 225624 - DNA, 562 bp, Homo sapiens
  misc_feature: GYAE6OF01AKZMG.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctggaggtgaaggagccgtgggggcctcgagtgaaggtctccgtgcgaggtcttttggatacaccttcagtcattatcatatactcgtgggtgcgacgacggccccgtggacgaagggcttggagtggagtagggcggagtccgacggttggtagtgggtggcgcagtacgtcgcacgagtacgtttcgacgggccgcgtcaccagtcggccaaggtcgcgtaccacgaatacaggtgtatagtggtacttgacgcagccgtggaggtctaggacgacaccggcagttgttattacgttggtggcggaggcgaggggacgggtactaaagggcgaagttaagggttcgggttaccccgg

SEQ ID NO: 225625 - DNA, 553 bp, Homo sapiens
  misc_feature: GYAE6OF01CDCGI.19.86.H09.1.454.CMB.1.raw
  modified_base (213)..(213): a, c, t, g, unknown or other
  misc_feature (213)..(213): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggngccgtggggcctcagtgaaggtctccgtgcgaggtcttttggatacaccttcagtcattatcatatactctgggtgcgacaggcccctggacaagggctgagtggagtagggcggatccgacggtggtagtgggtggcgcatacgtcgcacgagtaagtttcgagggccgcgtccaccatcggaccaagggtcgaccgtccaacgaactacgagtagtatagtggacttggacgcgaagcctggacgtcgtagacgacgacggcctagtcgttattagttggtcgaggaggcgagggacggggataaacgggcaagtaagttcgggtccgtaccccgggg

SEQ ID NO: 225626 - DNA, 607 bp, Homo sapiens
  misc_feature: GYAE6OF01E4LMH.19.86.H09.1.454.CMB.1.raw
  modified_base (163)..(163): a, c, t, g, unknown or other
  misc_feature (163)..(163): n is a, c, g, or t
  modified_base (318)..(318): a, c, t, g, unknown or other
  misc_feature (318)..(318): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
  modified_base (596)..(596): a, c, t, g, unknown or other
  misc_feature (596)..(596): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaccggccccaaatcgtcatctataatgacgctgagcggtccttaagggtccctgaccgtattctctggcgagaggtctggcgcctcagcttccctggccatcaggaggctccagtctggaantgagctgattattactgtgacaagtctgggatggactaggtgtacggtaacgggttccggttttacgggcgggtacggggaacctaacggcctacggtacccgtaccgttaaacggtcgaacggaccccaaagggcccttacggtccccccgttcgggttacctaccgttccgttccgtttcccccacccttcctcccaacggacggtacgtaccgtcggacggtcgggtactgggaccgtaagggccgacgaagttacggnactgcnacgtactagngctagcgtacg

SEQ ID NO: 225627 - DNA, 714 bp, Homo sapiens
  misc_feature: GYAE6OF01AG668.19.86.H09.1.454.CMB.1.raw
  modified_base (706)..(706): a, c, t, g, unknown or other
  misc_feature (706)..(706): n is a, c, g, or t
  modified_base (709)..(709): a, c, t, g, unknown or other
  misc_feature (709)..(709): n is a, c, g, or t
  modified_base (711)..(711): a, c, t, g, unknown or other
  misc_feature (711)..(711): n is a, c, g, or t
  modified_base (713)..(713): a, c, t, g, unknown or other
  misc_feature (713)..(713): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaactcgtcatctataatgacgctgagcggtccttaagggtccctgaccgattctctggcgagaggtctggcgcctcagcttcccctggccactcgaggacgggcctccgagtctaggaagataggaggctagtatttaacttacgttgtacgactaagttcgtaggggataggacgtaggttacggtacggtaaaccggggtttccggggttttcggacggggacgggtaaccgaaggtcgtacggtacccgtaccgttaacggtacctaaccggacccgtaacgggtccgttccccggtacccccccgtttacgggtacccctaccgttcccgtttccccggttaccccccgtacccccgtttccccgtaaccccgtaccggggtaaccgtaaccggggttaaccgggacggggcccgggtcccgttacggggaacccggtaaaccggggtccgaaaccgtaacggttaaccggtcgacgtcgtcgagacgctcacancgngngng

SEQ ID NO: 225628 - DNA, 579 bp, Homo sapiens
  misc_feature: GYAE6OF01BTV4S.19.86.H09.1.454.CMB.1.raw
  modified_base (163)..(163): a, c, t, g, unknown or other
  misc_feature (163)..(163): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
  modified_base (576)..(579): a, c, t, g, unknown or other
  misc_feature (576)..(579): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggcccccaaatcgtcatctataatgacgctgagcggtccttaagggtccctgaccgattctctggcgagaggtctggcgcctcagtccttcccgtggccatcgaggacgggctccagtctagaagatgaggtctagtatttattacgtgtgactaagttcgtaggattgactaggtggtaggtaaccgggtttccggtttacgggcgggtacgggaccaagtcgtacgtaccgtacctaagtcgaacgcccgaaggtcctccgtcccccgtcgtcctacctcgttccgttccccnccctccnccgacgacgtacgtacgtcggacgccgggcgtcgggaccgaagggccgactaacgtagcngcncgncgcagtcnnnn

SEQ ID NO: 225629 - DNA, 551 bp, Homo sapiens
  misc_feature: GYAE6OF01BN9VG.19.86.H09.1.454.CMB.1.raw
  modified_base (522)..(551): a, c, t, g, unknown or other
  misc_feature (522)..(551): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaaaggcaataaagtggttcgaccccgtggggccagggaaccctggtccaccgtctcctcacgcctaccaccaacgggccccagtccggtcctttcccccgtcggccgccccgtgcctccgaggacgccaccctccgagacgcacgacgccggccccgtgggcctcgccgtacgggttaccgaaacgggtacccttaacccgtttccccgaaaccggtaacggtaacggttaccgttagggaacgggccgggggtaccgttacggggaccgaaacggggcccgacgtaacgtaggcnnnnnnnnnnnnnnnnnnnnnnnnnnnnnn

SEQ ID NO: 225630 - DNA, 638 bp, Homo sapiens
  misc_feature: GYAE6OF01CWGDN.19.86.H09.1.454.CMB.1.raw
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
  modified_base (634)..(638): a, c, t, g, unknown or other
  misc_feature (634)..(638): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacgtcaccatcgcttgttctgcaagcagctcgaacatcgggagcagtggtgtgatgtggtattagaaagtcccaggaaacggcccccaaatcgtcatctataatgacgctgagcggtcctaagggtccctgaccgattctctggcgagaggtctggcgcctcagccttccctggccatcaggacgggctccagtctgaacgatgaggctgattattactgtgtcaatcgtgggatgacgagtgtcgacgggttccgggttttacggcgggtacgggaccgtaagtccgtacgtacccggtaccgtaagtccgaacggcccgtaacggccgtccggccccccgttacgggtccctaaccgttccgttacccggtttacccccctacccccgtttaccccgtaccccggtaaccggtaacggtaaccgggttaacccgtcgggtaaccggtcccgggggtaccgtcgggaacccgtaaccggggcccgacgtaagtacggangcgncgtacncnncnnnnn

SEQ ID NO: 225631 - DNA, 652 bp, Homo sapiens
  misc_feature: GYAE6OF01CDTPQ.19.86.H09.1.454.CMB.1.raw
  modified_base (162)..(162): a, c, t, g, unknown or other
  misc_feature (162)..(162): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(642): a, c, t, g, unknown or other
  misc_feature (641)..(642): n is a, c, g, or t
  modified_base (648)..(648): a, c, t, g, unknown or other
  misc_feature (648)..(648): n is a, c, g, or t
  modified_base (650)..(652): a, c, t, g, unknown or other
  misc_feature (650)..(652): n is a, c, g, or t
tcagtactctcgtgcacgaccggtgctcgatttagtgctatagacttgggtttggggccgttcctgggcccagtctgtgctgactcaggcaccctcagcgtctcgggaccccgggcagacggtcaccatcgcttgtctgcaagcagctcgaacagtcgggancagtggtgtgatggtggtatcgagaaacgtccaggaccgccccaaatcgcatctataatgacgctgacgtcggtaccgttaagggtccctagaccgtattcgtcgtcggcgagtacggtcgtcggcgtcctcgtacgtccttccgtcggaccacgtacgacggacggtcctccgtacgtcgtagaacgtacgtacgacggtacgtagtaactttacgttacgtcgtacgtacgtaacgtcggtaggtacgtacgaacgtaggttacggtacggttaccgggtttccgggtttacgggacgggtacgggaccgtaacgtcgtacggtaccgtacgtaacgtacgaaccgaccgacggtccgtacccgtcccgttcggtacctaccgttccgttcccgttcccctaccctaccgtaccgacgtacgtacgtacgtacggacggtcggccgtacggaccgacggcgacgtacgcgncncncnncgcagncnnn

SEQ ID NO: 225632 - DNA, 630 bp, Homo sapiens
  misc_feature: GYAE6OF01AWHNM.19.86.H09.1.454.CMB.1.raw
  modified_base (164)..(164): a, c, t, g, unknown or other
  misc_feature (164)..(164): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (605)..(605): a, c, t, g, unknown or other
  misc_feature (605)..(605): n is a, c, g, or t
  modified_base (619)..(619): a, c, t, g, unknown or other
  misc_feature (619)..(619): n is a, c, g, or t
  modified_base (622)..(624): a, c, t, g, unknown or other
  misc_feature (622)..(624): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcggggancagtggtgtgatgtggtatcagaaagtcccaggaaccggcccccaaatcgtcatctataatgacgctgagcggtctagggccaggccgatctagngcagtagctgcncctcgagtctcctgccatcagtaggctccagtctaggacacgtgaggtctgactttactacgtggtctactagtcgtagggtattcgaaccgtggttcgacgggttaaaccgggtttcccggggttttacggacgggtaacgggtacctaaggtccgttaccggtaccgttaccgtaacggttaccaccggacccgtaaaccggtccgtacccgtccccccggttacgggtaccttaccggtcccttaaccggttccccctaaccccggtccttacccgaacggtaacggaccgttaaccggcggtcgggtctacgggaccgaagggcccgtanacgtgctggcatgncgnnncngngn

SEQ ID NO: 225633 - DNA, 521 bp, Homo sapiens
  misc_feature: GYAE6OF01CPHQK.19.86.H09.1.454.CMB.1.raw
  modified_base (485)..(521): a, c, t, g, unknown or other
  misc_feature (485)..(521): n is a, c, g, or t
tcagtactctcgtgcacgaccggtgctcgatttagtgctatagacttgggcttgagtggatagggcggatccacggtggtagtggtggcgcatacgtcgcacagaagttttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaaccaagggccccagtccggtccttcccccctggccgcccttgcctccgaggacgccaccgtccgagacgcacgacgccggcccgtggggctcgcccgtggtaccaaagggaccttaccgttccccgaaacggacgtaacggttacctgggaacggccgggggtactcggggaccaaaggggccgacaagtaacggnnnnnnnnnnnnnnnnnnnnnnnnnnnnnnnnnnnnn

SEQ ID NO: 225634 - DNA, 737 bp, Homo sapiens
  misc_feature: GYAE6OF01DF02G.19.86.H09.1.454.CMB.1.raw
  modified_base (724)..(724): a, c, t, g, unknown or other
  misc_feature (724)..(724): n is a, c, g, or t
  modified_base (728)..(728): a, c, t, g, unknown or other
  misc_feature (728)..(728): n is a, c, g, or t
  modified_base (730)..(730): a, c, t, g, unknown or other
  misc_feature (730)..(730): n is a, c, g, or t
  modified_base (732)..(737): a, c, t, g, unknown or other
  misc_feature (732)..(737): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgtctgcaagcagctcgaacatcgggagcagtggtgtgatgtggtatcaagaaagtcccaggaaccgccccaaatcgtcatctaataatgacgctgacgccggtaccttaacgggtccctgaccgtattccgtcgtggcgaggaggtcgtcgggccgccctcgacgtcctttccccgtcggccattaccgaggacggggtcctccgtaaggtccgttaggaaacggagtggaacgggccttagtaacgttttaatttaccgttggttacggtactaaacgttccggtaggggtattaggtaaccgtaggtttcggtacgggttaaccggggtttcccggggtttttcggggaaccggggtaacggggaaccctaaggtccgtacggtaacccgttacccgtaaacggtaccgacggacccgtaacgggtcccgtacccggtccccccgttcgggtaccctacccgtttaccgttcccgggtttcccccctcccgttcccgaacccgtaccggaacgttacggtaccgtcgggaacgggtcccgggacggttcgggaaccgtaacgggcccgtacgtacgttaaggcagngagncncnnnnnn

SEQ ID NO: 225635 - DNA, 657 bp, Homo sapiens
  misc_feature: GYAE6OF01BUEDQ.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggacgcccactcccgaggtgcagctggtgcagtcgtgggctggaggtgaaggcgcgtgggctgagtgagtctcgtgcgagtcgtttggatactacttcagtctattatcattatactcgtgggcgcgacacggtcccgtaggacgaagggtcttaggaggtggagtagggcggtacgtcgtaacgggtggtaggtgggtggcgcgtagtacgtcgacgacgaggttaacgttcggacgggtccgcgtaccaccgtacggtcggaccgtaacgggtccgaccggtaccgaaacgaataccgtaggttagtaacgttagtacgggttaccttgggaacgtcgacggtccgttaggacggttacgtacggaacgaccgtacgccgtaagttacgttaattaggttcggtcgagggagggtacggaacggggtaacgggtaacgtaaacgggacgttaaaggttaaacgggttccgggttacccgtaaccccgggggg

SEQ ID NO: 225636 - DNA, 513 bp, Homo sapiens
  misc_feature: GYAE6OF01C6ZGT.19.86.H09.1.454.CMB.1.raw
  modified_base (259)..(259): a, c, t, g, unknown or other
  misc_feature (259)..(259): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (505)..(513): a, c, t, g, unknown or other
  misc_feature (505)..(513): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggtccctgaccgattcntggcgagaggtctggcgcctcagcttccctggccatcagagggctccagtctgaagatgaggctgattattactgtgcaatctgggatgacagtgtgtaacggtccgggttttcggcgggagggaccaagctgaccgtcctaagtcagacccaaggctgccccctcggtcactcctcgttccccgcccttctcccacgacgtagtactcgacgcgggtctggacgaacgggcgcagtagngnncgnnnnnnnnn

SEQ ID NO: 225637 - DNA, 505 bp, Homo sapiens
  misc_feature: GYAE6OF01AV3WQ.19.86.H09.1.454.CMB.1.raw
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (494)..(505): a, c, t, g, unknown or other
  misc_feature (494)..(505): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggccctgaccgattctctggcgagaggtctggcgcctcagcttccctggccatcgagagggctccagtctgaagatgaggctgattattactgtgcaatcgtggatgacngtgtgacggttcggtttcggnggtacggacgagctgaccgtctaagtcacgacccaggctcgcccctggccactcctcgtccccaccctcctccacgacgactacgtgacgtcgggctcggcgaacggcgacgagtgannnnnnnnnnnn

SEQ ID NO: 225638 - DNA, 592 bp, Homo sapiens
  misc_feature: GYAE6OF01CB584.19.86.H09.1.454.CMB.1.raw
  modified_base (579)..(581): a, c, t, g, unknown or other
  misc_feature (579)..(581): n is a, c, g, or t
  modified_base (583)..(592): a, c, t, g, unknown or other
  misc_feature (583)..(592): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcagaggctccagtctgaagatgaggctgtattattactgtgcaatcgtagggatgacgagtggtacggtaaccgggttcgggttttcgggacggggacgggaccgaacggtcgtacggtacccgtacctaaggtccacggaccccgaagggtccgtcccgacccccgttccggtcctaccgttccgttcccgttcccccgtccccttccccgtacccgaccgtacggtacgttaccgtacggacggccgggtcgtacgggaccgaacgggccgacagtcgnnngnnnnnnnnnn

SEQ ID NO: 225639 - DNA, 456 bp, Homo sapiens
  misc_feature: GYAE6OF01B0KP9.19.86.H09.1.454.CMB.1.raw
  modified_base (330)..(330): a, c, t, g, unknown or other
  misc_feature (330)..(330): n is a, c, g, or t
  modified_base (427)..(427): a, c, t, g, unknown or other
  misc_feature (427)..(427): n is a, c, g, or t
  modified_base (432)..(456): a, c, t, g, unknown or other
  misc_feature (432)..(456): n is a, c, g, or t
tcagtactctcgtgcacgaccggtgctcgatttagtgctatagacgttgggcttgagtggatagggcggatccacggtggtagtggtggcacatacgtcgcacagaagttttcagggccgcgtcaccatggccaaggtcgcgtccacgaatacagtgtatatggacttgagcagcctgaggtctggacgacacggccatgtattattgtgcgaggcaggacgggctaaaggcataagtggttcgaccctgggccaggaccctggcaccgtctcctcagcctccaccaagggcccatcggtccttccccctggccgccctgctccaggacnccacctcgagacgcacaggccggcccgtggggcctggcctggtcaacggcctacctcccgacgagacgtacgtgacggccgggcgtgggcaagggcncatgnnnnnnnnnnnnnnnnnnnnnnnnn

SEQ ID NO: 225640 - DNA, 595 bp, Homo sapiens
  misc_feature: GYAE6OF01BOJO0.19.86.H09.1.454.CMB.1.raw
  modified_base (350)..(350): a, c, t, g, unknown or other
  misc_feature (350)..(350): n is a, c, g, or t
tcagtactctcgtgcacgaccggtgctcgatttagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgacggtggtagtggtggcgcatacgtcgcacagaagtttcagggccgcgtcaccagtggccaaggtccgcgtccacgaatacagtgtatatggacttgagcagcctgagtcngacgacacggccagtgtattattgtgcgaggcgagggacggggtactaaagggcaagttaaaggtggttaccgaccccgtggggacccacgggaaccctggtcctacccgtctccctacacgccctaccacccgaacgggccctacgtccggtcccttcccccgtgggcccgtcccctcgcctcccgacgggacgcccgacccgtcccggacgacgccaacgacggcccgggcccgtgggtcccg

SEQ ID NO: 225641 - DNA, 696 bp, Homo sapiens
  misc_feature: GYAE6OF01EEGIQ.19.86.H09.1.454.CMB.1.raw
  modified_base (162)..(162): a, c, t, g, unknown or other
  misc_feature (162)..(162): n is a, c, g, or t
  modified_base (684)..(696): a, c, t, g, unknown or other
  misc_feature (684)..(696): n is a, c, g, or t
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggancagtggtgtgatgtggtatcaagaagtcccaggaaccgcccccaaatcgtcatctataatgacgctgacgcggttaccttaagggtccctgaccgtattctcgtggcgagtacggtctggccgcctcacggtccttcccgtggccctagtcgaacgggtacggggtcctacccgtaggttccgttaggaaacggtagttagggaacggttccgttaaggttaaactttttaattttaacccggttggttacgtacttaaacgttcgggttagggtatacggtaacgtaggttcggtacggggttaaccgggttttccgggtttacgggacgggtaacgggaccgtaaggtccgtacggtacccgtacgtaacgtcgaccgaccgtaacggtcctacccgtccccgttggtaccctacgttcccgttacccgttccccctacccttcccgtaccgaacggtacgtaccgttacggtcggaccgggtccgggtacgtcgggacgacgggtccaccgtagacggnnnnnnnnnnnnn

SEQ ID NO: 225642 - DNA, 938 bp, Homo sapiens
  misc_feature: GYAE6OF01EF5TM.19.86.H09.1.454.CMB.1.raw
  modified_base (120)..(120): a, c, t, g, unknown or other
  misc_feature (120)..(120): n is a, c, g, or t
  modified_base (167)..(167): a, c, t, g, unknown or other
  misc_feature (167)..(167): n is a, c, g, or t
  modified_base (238)..(238): a, c, t, g, unknown or other
  misc_feature (238)..(238): n is a, c, g, or t
  modified_base (930)..(930): a, c, t, g, unknown or other
  misc_feature (930)..(930): n is a, c, g, or t
  modified_base (933)..(933): a, c, t, g, unknown or other
  misc_feature (933)..(933): n is a, c, g, or t
  modified_base (937)..(937): a, c, t, g, unknown or other
  misc_feature (937)..(937): n is a, c, g, or t
tcagtactctcgtgcacgaccggtgctcgatttagtgctatagactttgggtttggggccgttcctgggcccagtctgtgctgactcaggccaccctcagcgtcgtcgggacccccgggnagacggtcaccatcgcttgttctgcaagcagctcgaacagtcgggancgagtggtgtgatgtggtatcgagaaacgtcccgaggaacccgccccaacttcgtcatctaataatgaccntgacgtccggttaccttaacgggtccctaggaccgtatttccgtacgtggccggaggtacgggttccgtggtccgcccttacgacggttcctttccccgtcggacctacgttccgaacggtacgggtcctacccggaggttaccgttaggaaacggtagttagggaacggtccgtttaaggttaattttaacgtttaccgtggttacgtaactaaacggttcgtagggtaacttacggtaacgttacgggttaggtttaaccggggttaacccggggtttttaccggggtttttaccggggaaaccggggtaaccgggttaaaccccggtaacggttaccgggtttaacccggttaacccccgggttaacctttaaacggggtttaacccccaaccggggtttaaacccccggaaaccggggtttacccccggttccccggttacccccccccggtttaccgggttaccccgtttaaccccgggttttcccccgtttaccccgggtttcccccccccgtaccccgtttacccccgttaacccggtaaaccccgggttacggtaaacccgggttttaacccggtacggggtaaacccggggtacccgggttccgggttaaccgggaaacccgggtaaacggggtccccggtaaaccttaaacggggtcgtacgcgtcgcgtcgcgtcgacgancgngtgng

SEQ ID NO: 225643 - DNA, 537 bp, Homo sapiens
  misc_feature: GYAE6OF01D4LT0.19.86.H09.1.454.CMB.1.raw
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (483)..(483): a, c, t, g, unknown or other
  misc_feature (483)..(483): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(537): a, c, t, g, unknown or other
  misc_feature (527)..(537): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagnggtctggccgcctcagtccttccnggccatcgagcgggcctccgagtctgaagntgaggctgattatactgtgnaatcgtggatgactagtgtacggtaccgggtttcggtttcggccgggtagggaccaagcgtcggaccgtacctaagtcacgacccgaaggcctccgccccctcggtccacttctccgttcccacccctccaccgacgngacgtacgtaggacggcggtctcggacgacggcgactagngnannnnnnnnnnn

SEQ ID NO: 225644 - DNA, 628 bp, Homo sapiens
  misc_feature: GYAE6OF01DAB1I.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctggaggtgaaggagccgtggggcctcgagtgaaggtctcctgcgaggtcttttggatacaccttcagtctattactcatatactcgtgggtgcgacgacggcccgtggacgaagggtcttggagtggagtagggcggactcgaggtggtaggtggtggcgcagtacgtcgacacgtaaggtaacggtttcggaacggggccgtccgtaccaacccgtagtcgggaccgtaaacgggtccgtaccggtaccaacggtaactacgaagttgttaatagtggtactggagcaagcctaggagtcgagaccgacgacgcctagttgttattggttaggtcggacgggaggccggtaagggggaaccgggtaacgtaaaacgggtacgtaaagggttaaacggttccgggttacccgggtaacccccgggg

SEQ ID NO: 225645 - DNA, 633 bp, Homo sapiens
  misc_feature: GYAE6OF01C11WR.19.86.H09.1.454.CMB.1.raw
  modified_base (163)..(163): a, c, t, g, unknown or other
  misc_feature (163)..(163): n is a, c, g, or t
  modified_base (229)..(229): a, c, t, g, unknown or other
  misc_feature (229)..(229): n is a, c, g, or t
  modified_base (538)..(538): a, c, t, g, unknown or other
  misc_feature (538)..(538): n is a, c, g, or t
  modified_base (620)..(620): a, c, t, g, unknown or other
  misc_feature (620)..(620): n is a, c, g, or t
  modified_base (623)..(633): a, c, t, g, unknown or other
  misc_feature (623)..(633): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggatcaagaaagtcccaggaaccggccccaaactcgacatctaataatgacnctagacgtccggttaccgttaacgggtccctaggaaccgtatttccgtcgttgggaccggaaggtacgggtcgttcgggccgtcccgttcgacggtcccttcccgtcggcccagttccgaaggtacgggccttaccgagttccgtaggtaagaggttggaacgggtcttaggtaattttaacgttacgtagtcgacgttaaatcggtaggatagacgtaggtgttacggtacgggtttccggtttggacgggaggacgagtcgtagaccgttacaagtccacgacccgagcctaccgcccgtcggtacncgtcctccgtccccgaccttccacgacgtaacgtaccgttacgacgtacggcgggacgtcggacggtaacgcgaacagtagngcnnnnnnnnnnn

SEQ ID NO: 225646 - DNA, 721 bp, Homo sapiens
  misc_feature: GYAE6OF01CXD6O.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccacggagcccactcccgaggtgcagcgtggtgcagtcgtggggctggaggtggaaggacgccgtggggcctcgaggtgaacggtcctcgtgcggtgtttacgttagaactacctacgttacgtactacttatactatacttacttcgtcgggtggtaccgacggacgcccgtacggtacggaacgggtgttacggtaggtaggtaggtacgggtacgggtacgtaccgtaccgggtagggtaggtagggtcgggacggtactaacgtaccggtacgtccgaacgtaacggtaaggtttacggtacggcccgggtcgtaccgtaccgaaccggttaggacccggacggtacggtccgtacccgtaaagaacgtaacgtacggttaggttaagtagttaggtacgttacgaaggacgtaccgaggttaccgtagggtacgttccggaacgacccggaggtcccgtaattcggtagtttaagtggcggtagggacggtaggaccgggtaaaggggccgtaaagacggtaagttaaacggtcgggttacccccgtacccgggg

SEQ ID NO: 225647 - DNA, 304 bp, Homo sapiens
  misc_feature: GYAE6OF01EHSDE.19.86.H09.1.454.CMB.1.raw
  modified_base (298)..(304): a, c, t, g, unknown or other
  misc_feature (298)..(304): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggtcgacccctggggccagggaccctggtcaccgtctcctcagcctccaccaagggcccatcggtcttccccctggcgccctgctccaggacgcaccgtccgagagcacagccggccctgggctgcctggtcaaggactacttcccagagagtactgagcgggctggcaaggcgcatagnnnnnnn

SEQ ID NO: 225648 - DNA, 686 bp, Homo sapiens
  misc_feature: GYAE6OF01ELS31.19.86.H09.1.454.CMB.1.raw
  modified_base (672)..(672): a, c, t, g, unknown or other
  misc_feature (672)..(672): n is a, c, g, or t
  modified_base (676)..(686): a, c, t, g, unknown or other
  misc_feature (676)..(686): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgtattctcgtggcgagtacggtctcggccgcctcacgtccttccctggccctagtcaggacgggtcctccgtaggtctaggaacgtagtggaggtcttaggtaatttaacgtttactggtagactaagtcggtagggaatacggaacgtaggttacgggttaccgggttaaacccggggtttcccggggttttacggggaccgggggtaacgggaacccggtaaggtcccgttaaccggtacccggttacccggttaaacggttccgaacggtacccgaacggtcccgtccccggtcccccgttcggtaccctaccgttccgttcccgttacccctacccccgttcccgtacccgtaccgacggtacgtaccgtaggtacgggcggccgtacggacggaccggcgacgtagtacgntagnnnnnnnnnnn

SEQ ID NO: 225649 - DNA, 551 bp, Homo sapiens
  misc_feature: GYAE6OF01BUS7W.19.86.H09.1.454.CMB.1.raw
  modified_base (497)..(497): a, c, t, g, unknown or other
  misc_feature (497)..(497): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctcctgcgaggtctttggatacaccttcagtcattatcatatactctgggtgcgacacggcccctggacaagggcttgaggtggagtagggcggatccgacgggtggtagtgggtggcgcagtacgtcgcacgagtaagtttcgacgggccgcgtcaccgagtcggccaagggtccgcgtccgacgaatacgagtgtatatggtacttgagcagccgtggacggtctggaccgacgaccggccagttgttattagttggtgnggagggcgagggacggggactaaagggcaagtaacggtcggtccgtaccccggg

SEQ ID NO: 225650 - DNA, 542 bp, Homo sapiens
  misc_feature: GYAE6OF01DOQML.19.86.H09.1.454.CMB.1.raw
  modified_base (318)..(318): a, c, t, g, unknown or other
  misc_feature (318)..(318): n is a, c, g, or t
  modified_base (530)..(542): a, c, t, g, unknown or other
  misc_feature (530)..(542): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaagtcccaggacggccccaaatcgtcatctataatgacgctgagcggttccttaagggtccctgaccgtattctctggcgagaggtctaggcgcctcagccttcctggcccatcagagggctccagtctgagntgaggctgattattactgtgcaatctggatgacgagtgtgtaacgggttccggttttcggcggagggaccaaggtctcgaccgtctaagtcgtacggacccgaaggtcctaccgccccctcgggtcctactccgttccgttcccccacccttcctacccacgtacgacgttactggacgtccgggctacggcgtaacggccgaccagtacgnnnnnnnnnnnnn

SEQ ID NO: 225651 - DNA, 658 bp, Homo sapiens
  misc_feature: GYAE6OF01ACK3A.19.86.H09.1.454.CMB.1.raw
  modified_base (162)..(162): a, c, t, g, unknown or other
  misc_feature (162)..(162): n is a, c, g, or t
  modified_base (322)..(322): a, c, t, g, unknown or other
  misc_feature (322)..(322): n is a, c, g, or t
  modified_base (631)..(631): a, c, t, g, unknown or other
  misc_feature (631)..(631): n is a, c, g, or t
  modified_base (645)..(645): a, c, t, g, unknown or other
  misc_feature (645)..(645): n is a, c, g, or t
  modified_base (653)..(654): a, c, t, g, unknown or other
  misc_feature (653)..(654): n is a, c, g, or t
  modified_base (656)..(656): a, c, t, g, unknown or other
  misc_feature (656)..(656): n is a, c, g, or t
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgttctgcaagcagctcgaacatcgggancagtggtgtgatgtggtatcagaaagtcccaggaaccgcccccaaatcgcatctataatgacgctgagcggtccttaagggtccctgaccgtattctcgtggcgagaggtctggcgcctcagtcttccctggcccatcgagcgggctccagtcctagagntgaggctgtatttatctgtgctaagtcgaggtatgacgtggtggtacggtaaccgggtttccgggtttaccgggacgggtaacgggaccaacggtcgtacgggtacctaccgttaaggtcccgaacggtacccaaacgggtccctccggtccccccgttacgggtacctacccgttccgttacccggtttccccccaacccgttcccctaccgaacccgggttaacgtaccgtttaccgtacgggtaacccgggtcccggggaacccgttcgggaacccgaagggtccccgtaaccgtagtaaccgggncgaagtcgaccggngtcgatgnngngc

SEQ ID NO: 225652 - DNA, 581 bp, Homo sapiens
  misc_feature: GYAE6OF01DQEBC.19.86.H09.1.454.CMB.1.raw
  modified_base (353)..(353): a, c, t, g, unknown or other
  misc_feature (353)..(353): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggacgccgtggggcctcgagtgaaggtctcctgcgaggcttttggatacaccttcagtcattatcatatactctgggtgcgacacggccctggacgagggcttgagtggagtagggcgatcgacggtggtagtgggtggcgnagtacgtcgcacgagtaagtttcgacgggccgcgtaccaccgtagtcgggaccgaagggtccgaccgtaccaacgaatacgtagtagtagtagtcggtacttggagtcgacgccgtaggacggtcgtaggaccgacgaccgcctagttgtatttagtcggtagcggaggtcgagggacgggtacgtaaagggactaagttaaacggtcgggttacccgtaccccgggg

SEQ ID NO: 225653 - DNA, 577 bp, Homo sapiens
  misc_feature: GYAE6OF01ENBCF.19.86.H09.1.454.CMB.1.raw
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctccgtgcgaggtcttttggatacacctttcagtcattatcatatactctgggtgcgacaggcccctggacaaggcttgagtggatagggcggatccgacggtggtagtgggtggcgcagtacgtcgcacgagtaaggtttcgagggtccgcgttacaccagtcggaccaagggtcgccggtaccaacggaatacagtgtaagtagtgggactttggagcgacgtccgtggaggttctaggacgacgaccggcctaatgttattagttgtggacggaggcgaaggggacggggacgtaaacgggctaaaggttaaacggttcggtccggtaacccccgggg

SEQ ID NO: 225654 - DNA, 646 bp, Homo sapiens
  misc_feature: GYAE6OF01D5SGA.19.86.H09.1.454.CMB.1.raw
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (331)..(331): a, c, t, g, unknown or other
  misc_feature (331)..(331): n is a, c, g, or t
  modified_base (629)..(629): a, c, t, g, unknown or other
  misc_feature (629)..(629): n is a, c, g, or t
  modified_base (634)..(634): a, c, t, g, unknown or other
  misc_feature (634)..(634): n is a, c, g, or t
  modified_base (637)..(637): a, c, t, g, unknown or other
  misc_feature (637)..(637): n is a, c, g, or t
  modified_base (639)..(642): a, c, t, g, unknown or other
  misc_feature (639)..(642): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcagaaacgtcccgaggaaccggcccccaaacgtcgtcatctataatgacgctagagcggtacttaaggtcctgaccgattcngtggcgagngtctgcgcctcacgtcttcccgtggccagtccgagacgggcctcgagtctagaagangagctagtatttagtacgtgtacgactaagtcgtaggatagacgtagtggtacgggtaaccgggtttccggtttacgggacggggtaacggaccgtaaggtccgtacggaacccgtacgtaacggtaccgaaccgacccggtaacggtccgtccccggtcccccgttacggtaccctaccgttcccgttacccgttacccccctacccttaccccgtccgaaccggtaacgtacgttaccgtcggaccgggccgggtaccgtacgggacggtaccggaccgacgtaacgtacggcacncgcgngcncnnnngngn

SEQ ID NO: 225655 - DNA, 522 bp, Homo sapiens
  misc_feature: GYAE6OF01EKFCT.19.86.H09.1.454.CMB.1.raw
  modified_base (443)..(443): a, c, t, g, unknown or other
  misc_feature (443)..(443): n is a, c, g, or t
  modified_base (474)..(474): a, c, t, g, unknown or other
  misc_feature (474)..(474): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacacttcagtcattatcatatactctgggtgcgacaggcccctggacaagggcttgagtggatagggcggatccgacggtggtaggtgggtggcgcagtacgtcgcacagtaagtttcgagggccgcgtcaccgatggccaagggtcgcgtccagaactacagtgtatatggacttgagcagcctaggngtctgacgacacggccatgttattattgtgngaggcgagggacggggactaaaggcaagtaagtggtccgtaccccggg

SEQ ID NO: 225656 - DNA, 597 bp, Homo sapiens
  misc_feature: GYAE6OF01D6SWQ.19.86.H09.1.454.CMB.1.raw
  modified_base (588)..(597): a, c, t, g, unknown or other
  misc_feature (588)..(597): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctagaacgatgagctgtattattactgtgctaatcgtggatggactagtgtacggtaaccggttccgggttttacggcgggtaacgggaccgtaaaggtcgtacggaaccgttccttaaacggtacccgacgaccccgaaggcccgttccgccccccgttcgggtacctaccttccttaccggttcccccaacccctcccgtaacccaccggtaacgtacgtacccgtggtaacggccgggtcgtcgggaccgaacgggtcaccgagtaggcagcnnnnnnnnnn

SEQ ID NO: 225657 - DNA, 627 bp, Homo sapiens
  misc_feature: GYAE6OF01EUHS1.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggagccgtggggcctcaggtgaaggtctccgtgcgaggtcttttggactacaccttcagtcattatcatatactcgtgggtgcgacgacggcccctggacgagggtcttggaggtggagtagggcggtatccgacggtggtaggtgggtggcgcgacgtacgtcgacacgtaaggtaagtttcgacgggccgtcgtccaccgtagtcggaccgtaaggtccgcgtacaacgtaatacgaggtacgtatagtggtacttgacgacacggtccgtagggacggttacgttacggaccggaaccgacgggacctagttagttaacttagttacggttgggacggtacgggacggtaacgggggacgggggtaacctaaacgggactaaacggttaaagggttcggttaacccgggg

SEQ ID NO: 225658 - DNA, 700 bp, Homo sapiens
  misc_feature: GYAE6OF01DJP4K.19.86.H09.1.454.CMB.1.raw
  modified_base (148)..(148): a, c, t, g, unknown or other
  misc_feature (148)..(148): n is a, c, g, or t
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
tcagtactctcgtgcacgaccggtgctcgatttagtgctatagacttgggtttggggagagcatcacccagcaaccacatctgtcctctagagaatcccctgagagctccgttcctcaccatggactggacctgggaggatcctcctnttggtggcagcagcccaccggagcccactcccaggtgcagctggtgcagtcgtggggctggaggtgaagggngccgtggggcctcgagtgaggtctcngcgagtctttggatacaccttcagtctattatcatatactcgtgggtcgcgacgtacggcccgtaggacgaagggtcttaggaggtggagtaggggcgtacgtccggtagggttcgggtaggttcggggtcgggccgtacgtaacgttacggtccggacaaaccgtaaggttaaagttttccggacggggtccgtccggttaccaaccgagttacgggacccgtaacgggtccgaccgtaccgacgtaactacgtagttagtaattagtagtacgttgacggtacacgtccgtagggtacggtcgtcgaaccggacgaacccgggtccgtaagttagtttagtttaacgtttggtagggaccgggaacggggtaccggaaggggggtaaaccggggtaagtaaaaacgggtccgttaaaaaggttaaacggggttcgggttaaaccccccgggg

SEQ ID NO: 225659 - DNA, 730 bp, Homo sapiens
  misc_feature: GYAE6OF01AT8KZ.19.86.H09.1.454.CMB.1.raw
  modified_base (213)..(213): a, c, t, g, unknown or other
  misc_feature (213)..(213): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtgggctgaggtgaaggngccgtgggcctcgagtagacggtctcgtgcgtaggtcgtttggactactaccttcagtctattatctatacgttactcgtggggtgaccggtaccgaccggtcccccgtagggaaccggtaacggggtcgttaggtagggtagggtaacggtacggggtaccggtacgtacccggtacggggttaggttacgggtggggtcgggccggacgtacgttaccggtcgaccgaacgtaaggtaacggtttcggacggggtcccgacgtaccgaaccgtagtcggaccgtaacgggtccgaccgtaccgaacgtaagtacgtaagtagtattacgtggtacgttaggacgtacgacgtaccgtacgggtacggttaccgtaggaccggaaccgtaccggacccgttagttagttaggtttacgttgggtcgtacgggtacgggacggaacggggaccgggtaacggtaaacgggtacgtaaaggttaacggttccggggttaccccggtaacccccggggg

SEQ ID NO: 225660 - DNA, 564 bp, Homo sapiens
  misc_feature: GYAE6OF01C48V5.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacgacggccctggacaagggtcttgagtggatagggcgatccgacggtggtagtggtggcgcagtacgtcgcacgagaagtttcgagggccgcgtacaccgagtcggaccaagggtcgcgtaccaacgatacagtgtatatggtacttgagcagccgtagaggtctagaccgacgacggcctagttgtactttagtggtcggcggaggcgaacggggaacggggtactaaaacgggactaaaggttaaacggtcgggttacccggtaaccccgggg

SEQ ID NO: 225661 - DNA, 612 bp, Homo sapiens
  misc_feature: GYAE6OF01BRFEQ.19.86.H09.1.454.CMB.1.raw
  modified_base (288)..(288): a, c, t, g, unknown or other
  misc_feature (288)..(288): n is a, c, g, or t
  modified_base (333)..(333): a, c, t, g, unknown or other
  misc_feature (333)..(333): n is a, c, g, or t
  modified_base (600)..(610): a, c, t, g, unknown or other
  misc_feature (600)..(610): n is a, c, g, or t
  modified_base (612)..(612): a, c, t, g, unknown or other
  misc_feature (612)..(612): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcaggaaagtcccaggaaccgcccccaaatcgtcatctataatcgacgctgagccggttccgttaagggtccctgaccgattcgctggcgagacggtctggcgcctnagtccttcccgtggccatcaggacgggtctccagtcgtagaagtntagagcttagtactttattactgtagactaagtcgtaggatggaactaggttggtacggtaccgggttaccgggtttcggacgggtaacgggaacctaaggtccgttacggacccgtacgtaacgtcgaacggacccgtaacgggcctacccgtcccccgtcggtacctaccgttcctcccgttacccctccccttcctacccgacggtaaccgtacggtacctagggacggtcgggacgtcgaccggaacggtccgaagacgtgannnnnnnnnnngn

SEQ ID NO: 225662 - DNA, 679 bp, Homo sapiens
  misc_feature: GYAE6OF01CHPSK.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggacgcccactcccaggtgcagcgtggtgcagtcgtggggctggaggtgaaggagccgtggggcctcgagtggaaggtctccgtgcgaggtcttttggactactaccttcagtacattatcatatactcgtgggtcgcgacacggcccctgggacgaagggtcgttggacggtgggacgtaggggcggacgtccggtacgggtcgggttaggtgggtggccgacgtacgtacggtcggacctaacgtaacggtaacgttttcggacggggtcccgtacgtaccacccgtagtcgggaccgtaacgggttccggaccgttacccgaacgtaacgtacgtaggttagtaatagttagggactttaggacgcgacggtcccgtaggacggttaccgacggtaccgacgaccggtccgtagttacgttagtttagttcggtggacggtacgggacgaacgggggaccgggtacggtaaaggaccgtaaaggttaaacgggttcgggttaaccccggg

SEQ ID NO: 225663 - DNA, 681 bp, Homo sapiens
  misc_feature: GYAE6OF01BP0W5.19.86.H09.1.454.CMB.1.raw
  modified_base (164)..(164): a, c, t, g, unknown or other
  misc_feature (164)..(164): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (649)..(649): a, c, t, g, unknown or other
  misc_feature (649)..(649): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
tcagtactctcgtgcacgaccggtgctcgatttagtgctatagacgttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcgagaaagtcccaggaaccgccccaaatcgtcatctataatgacgctgagtcggtaccttaagggtccctgaccgtattcgtctggcgagaggtctggccgtcctcacgccttcccgtggccatcagacgggcctcgagtcngaagntgacgctgtattattactgtacgctaagtcgtagggtattcgaacgtaggttacggtacggtaaaccgggtttccgggtttacgggacgggtaacgggaaccgtaacggctacggtaccccgtacgtaagttccgaacgtaccccgtaaggtcccgtaccgtcccccgtcggttacctacccgttccgtccgtttacccccgcccctttacccgtacccgtaaccgggttaacgtaaccggttaccgtacgggtaaccggggtcccggtcggttaacgggaacccggttaacgggaccccgtacgttaacggtaccggntaccgtcagacgtcgtccacgtancncgcgtc

SEQ ID NO: 225664 - DNA, 685 bp, Homo sapiens
  misc_feature: GYAE6OF01B0A5F.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctggaggtgaaggagccgtggggcctcaggtgaacggtctccgtgcgaggtcttttggactacaccttcagtctattatctatatactcgtgggtcgcgacgacggcccgtggacgacgggtcttggaggtggagtagggacggtacgtccggacggtaggtacggtgggtcggcgacgtagtaccgtcgaccacgtaaggtaacgtttacggacggggtacccgtcgtaccgaccgtagtcggaccgtaacgggtcgaccgtaccgaacggtaacgtacgtagttgtaacgtaggtacggtacgttaggacgtcgaacggtcccgtagggtacgggttcctacgggaaccgaccgtaaccgggcccttaaggttaccggtttaagttaggtttcggtggaacgggtacgggacggtaacgggggaacggggtaacgtaaacgggacctaagggttaaacgggttccgggttaaccccggg

SEQ ID NO: 225665 - DNA, 776 bp, Homo sapiens
  misc_feature: GYAE6OF01CYCW3.19.86.H09.1.454.CMB.1.raw
  modified_base (119)..(119): a, c, t, g, unknown or other
  misc_feature (119)..(119): n is a, c, g, or t
  modified_base (754)..(754): a, c, t, g, unknown or other
  misc_feature (754)..(754): n is a, c, g, or t
  modified_base (759)..(759): a, c, t, g, unknown or other
  misc_feature (759)..(759): n is a, c, g, or t
  modified_base (762)..(763): a, c, t, g, unknown or other
  misc_feature (762)..(763): n is a, c, g, or t
  modified_base (768)..(768): a, c, t, g, unknown or other
  misc_feature (768)..(768): n is a, c, g, or t
  modified_base (770)..(770): a, c, t, g, unknown or other
  misc_feature (770)..(770): n is a, c, g, or t
  modified_base (772)..(772): a, c, t, g, unknown or other
  misc_feature (772)..(772): n is a, c, g, or t
  modified_base (774)..(774): a, c, t, g, unknown or other
  misc_feature (774)..(774): n is a, c, g, or t
  modified_base (776)..(776): a, c, t, g, unknown or other
  misc_feature (776)..(776): n is a, c, g, or t
tcagtactctcgtgcacgaccggtgctcgatttagtgctatagacttgggtttgggggccgttcctgggcccagtctgtgctgactcaggcaccctcagcgtcgtcgggacccccgggnagacggtcaccatcgcttgttctgcaagcagctcgaacagtcgggagcagtggtgtgagtgtggtatcaagaaacgtcccgaggaaccgaccccaaatcgtacatctaataatgacgtctagacgccggttaccgttaacgggtcccctaggaccgtatttccgtcggtacgggacggaaggtacgggtcgtcggccgtccctacgacgtcccttcccgtcggcctagtaccgaggtacgggcctccgtagtctaggaagacgttaggaggtacgttagtaattttaacgttacgtagttacgactaaacgttcggtagggtatacggaacgtaggttacggttacggttaaccggggttttccgggttttacgggaccggggtaagggtaacccgtaacggtaccggtacggtaacccggttaaccgtaaacggtccgaaccggtacccgaacgggtcccttacccggtcccccggttacggtaccctacccgtttcccgtttaccccgggttaccccccgtaccccgtttacccgtacccgtaacggaacggtttaccggtacccggtacgggaccgggtcccggggacggttaccgggaccgggtaaaccgggccgttaacgacgttacggntacgngcnncgtcnancngngn

SEQ ID NO: 225666 - DNA, 579 bp, Homo sapiens
  misc_feature: GYAE6OF01A7IPH.19.86.H09.1.454.CMB.1.raw
  modified_base (261)..(261): a, c, t, g, unknown or other
  misc_feature (261)..(261): n is a, c, g, or t
  modified_base (322)..(322): a, c, t, g, unknown or other
  misc_feature (322)..(322): n is a, c, g, or t
  modified_base (565)..(566): a, c, t, g, unknown or other
  misc_feature (565)..(566): n is a, c, g, or t
  modified_base (570)..(579): a, c, t, g, unknown or other
  misc_feature (570)..(579): n is a, c, g, or t
tcagtactctcgtgcacgaccggtgctcgatttagtgctatagacttgggtttgggggccgttcctgggcccagtctgtgctgactcgggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgtattcnctggcgaggaggtctggcgcctcacgccttccctggccatcagagggctccagtctgaagntggaggctgtattattactgtcactaatcgtgggactgacgaggtgtacggtaccgggtttccggtttcgggcgggacgggaccgaggcgtcggtacccgttaccgtaagtcgacgcccgaacggtcctcccgtcccccgtcggtcctaccgttccgttcccgttccccaccctccccgtacccgtaacgacgtacgtaccgtaggacggcgggtaccgtcgggacgacggccgcgagtacgnnagcnnnnnnnnnn

SEQ ID NO: 225667 - DNA, 781 bp, Homo sapiens
  misc_feature: GYAE6OF01BSZHV.19.86.H09.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcaggtgaaggtctcctgcgaggcttttggatacaccttcagtcattancatatactctgggtncgacaggcccctggacaagggcttgagtggatagggcgatccgagggtggtaggtggtggcgcagtacggtcgcgaacgaggtaagtttcgacggggtccncgtaccaccgtaagtgggacccgtaaaggtcggcccgttaccaacggtaataaccgagttagtatagttggacttaggagtccgagtccctaggacggttctaggaaccgacgaccgggtaccctaagttcgttaatttacgttagggtcgtacggtaacgggacggtaacgggaccgggggtaacgtaaacgggtaccgtaaagttaaacgggttcgggttaacccggtaaccccgggttagggggacccgtaaacgggggaacccctttaggggtacccgtacccggtaccgttccgtaccgtaccggtccccgtaacccgtaacccggtaacccgggtcccaacggtttccccgggttacccctttacccccggccgggtccccgtcccgtccgtacccggtacccgacggtccgacccgtaccccgtaccgacggtaccgacccaacggaaccggtcccggtcccggtaccggtcccggg

SEQ ID NO: 225668 - DNA, 541 bp, Homo sapiens
  misc_feature: GYAE6OF01D2CA2.19.86.H09.1.454.CMB.1.raw
  modified_base (117)..(117): a, c, t, g, unknown or other
  misc_feature (117)..(117): n is a, c, g, or t
  modified_base (475)..(475): a, c, t, g, unknown or other
  misc_feature (475)..(475): n is a, c, g, or t
  modified_base (528)..(530): a, c, t, g, unknown or other
  misc_feature (528)..(530): n is a, c, g, or t
  modified_base (533)..(541): a, c, t, g, unknown or other
  misc_feature (533)..(541): n is a, c, g, or t
tcagtactctcgtgcacgaccggtgctcgatttagtgctatagacttgggtttgggggccgttcctgggcccagtctgtgctgactcaggcaccctcagcgtctgggacccccgggnagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgattctcgtggcgagaggtctggcgcctcagccttccctggcctatcgagagggctccagtctagaagatgacggctgaatttattactgtgctaatcgtggatgactagtgtggtaacggttcggtttcggacggacgggacaagtctacgaccgtcgtaagtcgacgcccgaaggcctaccgccccgtcggtcctacttccgtcgttccccgccctccnccgacggagtacgtcgtggacgtcgggctcgggacgtacgggcgacgagtagnnngcnnnnnnnnn

SEQ ID NO: 225669 - DNA, 717 bp, Homo sapiens
  misc_feature: GYAE6OF01AK599.19.86.H09.1.454.CMB.1.raw
  modified_base (299)..(299): a, c, t, g, unknown or other
  misc_feature (299)..(299): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggagccgtggggcctcgaggtgaaggtctccgtgcgaggtcttttggatactaccttcagtcattatctatatactcgtggtgcgacncggccctggacgaggctgagtggagtagggcgatccgacggtggtaggtgggtggcgacgtacgtacggtcgacgaacgaggtaacggtttcgacggggtcccgtcgttaccgaaccgtaggttcgggacccgtaaacggggttcccgaccggttacccgaacggtaaacgtacgtaggttagttaacgttacgtacgggtacgtttaggacgtacgaacggtcccgttagggtacggttccgtacggaaccggaaccgtaccgggtaccgtaagttcggtttaaacgtttaggtttcgggtacgggtacccgggtaagggtaccggaacgggggtaacccggggggttaactaaaacggggaccttaaaagggtttaaacgggttccggggtttacccccggtaaacccccgggggg

SEQ ID NO: 225670 - DNA, 509 bp, Homo sapiens
  misc_feature: GYAE6OF01CESNA.19.86.H09.1.454.CMB.1.raw
  modified_base (163)..(163): a, c, t, g, unknown or other
  misc_feature (163)..(163): n is a, c, g, or t
  modified_base (261)..(261): a, c, t, g, unknown or other
  misc_feature (261)..(261): n is a, c, g, or t
  modified_base (321)..(321): a, c, t, g, unknown or other
  misc_feature (321)..(321): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (494)..(495): a, c, t, g, unknown or other
  misc_feature (494)..(495): n is a, c, g, or t
  modified_base (498)..(499): a, c, t, g, unknown or other
  misc_feature (498)..(499): n is a, c, g, or t
  modified_base (503)..(509): a, c, t, g, unknown or other
  misc_feature (503)..(509): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancaggtggtgtgatgtggtatcagaaagtcccaggaaccgccccaaatcgtcatctataatgacgctgagcggtaccttaagggtccctgaccgattcncgtggcgagaggtctgtcgcctcagcttcctggccatcagacgggctccgagtctgaagntgaggctgattattactgtgcaagtcgtggatgacgagtgtagtacggttcggtttcggcggtacggaccagcgtcgaccgtacgtaacgtcacgaccaaggctacgcccctggtcactctcgtccccncctccncacgngacgtcgngagcggtcnggcacggcacagtcgnngtnncgannnnnnn

SEQ ID NO: 225671 - DNA, 678 bp, Homo sapiens
  misc_feature: GYAE6OF01BX9DI.19.86.H09.1.454.CMB.1.raw
  modified_base (215)..(215): a, c, t, g, unknown or other
  misc_feature (215)..(215): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaagggngccgtggggcctcgagtggaaggtcctcctggcgaggtcgttttggataccgtaccttcagtctattatctatatactgtgggtgcgacacggccctggacgaagggtcttgagtggagtagggacgagtccgacgggtggtaggtgggtcggcgctagtacgtcgacgacaggtaacgtttcgagggcccgcgtaccgacctagtcgggtacccaacgggttccgccggttacccgaacgtaaagtaccgtagttacgtaagtacgtagggaacctttggacggtacgaacggtccgtagggtaacggtcgttacggaaccggaaccggaccggaccgtaagttacggttaatttacgtttgggtacgacgggtacggggacgaacggggggaaccggggtacgtaaaacggggacttaaagggttaaacgggttccgggttcccgggtaaacccccggggg

SEQ ID NO: 225672 - DNA, 828 bp, Homo sapiens
  misc_feature: GYAE6OF01DQIGC.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggactcctcctcttggtggcagcacgccaccggacgccccactcccgaggtcgcagcgtggtgctaggtcgtggggcgtggagggtaggaagggacgtccggtcgggggtcctacgtaggtacggtaaggtcctccgtggccggtaggttcgttttaggaacttaacctaccgttcgtagtacctaatttatcctaattacttacgtcggtttggggacgtaccggaaccgaccgggtacccccgtagggaaccggtaacggggtcgttagggaagggtacggggtaacggttaacgggggaccggtaccgttacccgggtaagggggttacggggttagggtcggggtcgggtcggaacgtacgttaccgggtaccgtacgtaaacggtaacggttaacggtttaccggaccggggtcccgtaccgtaccgaacccgtaggttaccgggacccggttaacggggtcccggtacccgttaaccgaacgtaagtaccgtaggttaacgttagtacgtacgggtaacttacgggacgtcgaacggtaccgtagggtacgttccggtaaccgacgtaaccggccgtaccgtaattacggtttacttaggttgggacggtacgggacggtacgggacgggaacgggtactaaacgggtactaaagggttaacgttccgggtacccggtaaccccgggg

SEQ ID NO: 225673 - DNA, 326 bp, Homo sapiens
  misc_feature: GYAE6OF01BV2E4.19.86.H09.1.454.CMB.1.raw
  modified_base (232)..(232): a, c, t, g, unknown or other
  misc_feature (232)..(232): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (311)..(326): a, c, t, g, unknown or other
  misc_feature (311)..(326): n is a, c, g, or t
tcagtactctcgtgcacgaccggtgctcgatttagtgctatagacttgagcagcctgaggtctgacgacacggccatgtattattgtgcgaggcagggacggggctaaaggcataaagtggttcgacccctggggccagggaaccctggtcaccgtctcctcagccctccaccaaacgggcccatccggtccttcccccgtggccgccctgctccgaggagcacctccgganacgcacgagccggcctgggctgacctggacaaggacttactaccagagngtacngagtcggntggcaagcgcanagntnnnnnnnnnnnnnnnn

SEQ ID NO: 225674 - DNA, 699 bp, Homo sapiens
  misc_feature: GYAE6OF01CAG72.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggacgcccactcccgaggtgcagcgtggtgcgagtcgtggggctggaggtgaaggcgccgtggggcctcgaggtgtaaggtctcgtggcggtaggtcgtttttggactacctaccttcagttctacttatctattactactcggtgggtcgacggaccgacggccccgtagggaaccgaacgggtcgttaggaggtagggaggtacggggacggtacgtaccggtacgggttggtaggtgggtcggcgtacgtacgtacggtcgacgaacgtaaggttaacgtttcggacggggccgtccgtacgacgtacgtcgggaccgtaagggtcccgccgtaccgaaacgtatacgagttagtagtacgttggacttgacgcgacggtccgtagggtagtcgtacgggaccgaaccggtaccggtctaagttacggttaatttaggtggtacggagggacggaccggtaagggggtaacgggtaacggtaaagggaacgttaagggtttaaacgggtccggttacccgggtaaccccgggg

SEQ ID NO: 225675 - DNA, 437 bp, Homo sapiens
  misc_feature: GYAE6OF01CZKUU.19.86.H09.1.454.CMB.1.raw
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
  modified_base (417)..(437): a, c, t, g, unknown or other
  misc_feature (417)..(437): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattatgtgcgaggcaggacgggctaaaggcataaagtgtcgaccctggggccagggaaccctggtcaccgtctcctcagcctccaccaagggcccatccggtcttccccctggccgccctgctccaggacgcacctccgagagcacacgcggccctgggctggcctggtcaaggctactcccacgagancgtgagcgggctgggcaagggcncagtagnnnnnnnnnnnnnnnnnnnnn

SEQ ID NO: 225676 - DNA, 723 bp, Homo sapiens
  misc_feature: GYAE6OF01CEPM6.19.86.H09.1.454.CMB.1.raw
tcagtactctcgtgcacgaccggtgctcgattagtgctatagacttgggtttgggggaagaggaagactgacggtcccactcccaggtgcagctggtgcagtctggggctgaggtgaaggagcctggggcctcagtgaaggtctcctgcgaggtcttttggatacaccttcagtcattatcatatactcgtggggtgccgacacggcccctggacaagggcttggagtggagtagggcggatccgagggtggtagtggtggcgcagtacgtcgacacgagtaaagttccgagggccgcgtcaaccgagtcgggaccgtaagggtccgaccgttaccgaacggtaaactaccgaggttcggttaattagtggggtaaccttgaagcaggcctaggacggttctaggaaccgacgacccgggcctaagttgtaatttagttggtcggacggagggaccggacgggggtaacggggtactaaagggactaaggttaaagggttccggttaacccgggaccccgttacggggggaccctaacgggggtaacccccttgggtacccgacccgttccgttccccgcgtaaccgcccctacccgaaccggtaaccggcccttaacgttcccggttccctccccggtagcccgtaccgtccgaccgtcccgaaggcccgacctccccgacggtagaccgccaccggacgggccccggtccgtcggggtccc

SEQ ID NO: 225677 - DNA, 813 bp, Homo sapiens
  misc_feature: GYAE6OF01A2JP2.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggagccgtggggcctcgagtgaaggtcctccgtgcgaggtcgtttggactacctaccttcagtctattatctaatactaccgttcgtgggtcgcgacgaccggcccgtaggaacgaacgggtcttaggagtgggagtacgggcggtacgtccggtacggggtggttaggtcgggtgggccgacgtaacgttacggtcgaccgaacgtaacgggttaacggtttaccggaacggggtcccgtaccggtaccaaccgtacggtaccgggacccggtaacgggtcccggtaccgtacccgtaacgtaaacgttaccgtaaggttagttaacgtaggtacggttaacgttggaaccgtacgtaaccggtaccggttacggtaacgggttccggtaacggaacccggaaccggtacccgggttaccgttaaggtttacggttttaaacgtttaacgggtttacgggtaccgggtacggggaacggggtaacccgggaaacgggggggtaaaccggggttaaaccgggtaaaaacggggttaccggttaaaaacggggttttaacggggtttccccggggttaaccccccggggtaacccccgggggg

SEQ ID NO: 225678 - DNA, 554 bp, Homo sapiens
  misc_feature: GYAE6OF01ETQFO.19.86.H09.1.454.CMB.1.raw
  modified_base (348)..(348): a, c, t, g, unknown or other
  misc_feature (348)..(348): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggtcttttggatacacctttcagtcattatcatatactctgggtgcgacaggccctggacaaggcttgagtggagtagggcgatccgaggtggtagtggtggcgnagtacgtcgcacgagtaagtttcgaggggccgcgtcaccatgggccaagggtccgacgtccaacgaactacaggtatagtatgggacttgagcaggcctggacggttctacggacgtacacgggccagttcgttattagttggtgtacggaggcgaggggacgggacgtaaaggcaaaggttaaacgtcgggttaccgaccccggg

SEQ ID NO: 225679 - DNA, 677 bp, Homo sapiens
  misc_feature: GYAE6OF01D236J.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggacgccccactcccaggtgcagctggtgcagtcgtggggctggaggtggaaggacgccgtggggcctcgaggtgaaggtctccgtgcggtaggtcgttttggatacctaccttcagtctattatctatatactcgtgggtcgcgacgacggcccgtggacgaagggtctggagtggagtagggcggtacgtccggacgggtggtaggtgggtggcgacgtacgtacggtcgacacgtaagtaaggtttccgacgggcccgtcgtaccgaacgtacgtcggaccgtaacgggtcccgcgtaccgaacgtaactacgagttagtaagtagtcggtacgttagacgtcgacgtccgtaggacgggttaccgtaggaacccgaacgaccgggtcctagttaggttaatttagtttcgggagggtacggagggacggaacgggggtaacggggtaaacgtaaacggggacgttaaaggtttaaacgggttccgggttaaccccgggtacccccggggg

SEQ ID NO: 225680 - DNA, 778 bp, Homo sapiens
  misc_feature: GYAE6OF01CYJPS.19.86.H09.1.454.CMB.1.raw
  modified_base (392)..(392): a, c, t, g, unknown or other
  misc_feature (392)..(392): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctggaggtggaagggagccggtggggccctcgaggtggaaggtcctccgtggccggtaggtcgttttggaactaccgtaccttcagtcctaatttatacattatacgtcgtgggtcgcgtacgcggtcccgtaggacgagggtctagaggtggagtagggcggacgtccgtaggtggtaaggttgggnggcgactagtaccggtccgacgtaacgtaacggttaaacgtttccggaacgggggtcccgtaccgttacccgaaccggttaacggttacgggacccggtaaacggggtttcccggaccgttaacccggaacggtaaaacttaccggtaaaggtttaggtaaacgtttaaggttacgggttaaccgtttaaggaaccggagtaccgggtaccgtaggggtacgttccgtaacggaaccgaccggtacccggtacctaaagttcgggttaaattttacggttacgggtaggtaccgggaaacggggtaccgggaagggggtaaccggggaaccgggtttaaaaacggacgttaaaagggtaaacgggtttcggggttaaacccccggg

SEQ ID NO: 225681 - DNA, 626 bp, Homo sapiens
  misc_feature: GYAE6OF01AU8SQ.19.86.H09.1.454.CMB.1.raw
  modified_base (213)..(213): a, c, t, g, unknown or other
  misc_feature (213)..(213): n is a, c, g, or t
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggngcctggggcctcagtgaaggtctcctgcgaggcttttggatacaccgttnagtcattatctatatactctggggtncgacaggccctggacagggcttgagtggagtagggcgtatccgacgggtggtagtgggtggtcgcgtacgttacggtcggacacgaggtaagtttcgaacgggtccgcgttacacctagcggtccaaagggtcgaccgtaccacggaataccgagtacgtatagtggacgtttgagtcacggccgtggagggtcttacgggaaccgacgacccgggacctaagttgggttaaacttttaggtacggttggaccgggttaagggaccgtaagggggacgggggtaacgtaaacgggacggtaaagttaaacgggtgggtttaacccggaaccccgggg

SEQ ID NO: 225682 - DNA, 705 bp, Homo sapiens
  misc_feature: GYAE6OF01DNBKS.19.86.H09.1.454.CMB.1.raw
  modified_base (260)..(260): a, c, t, g, unknown or other
  misc_feature (260)..(260): n is a, c, g, or t
  modified_base (319)..(319): a, c, t, g, unknown or other
  misc_feature (319)..(319): n is a, c, g, or t
  modified_base (677)..(677): a, c, t, g, unknown or other
  misc_feature (677)..(677): n is a, c, g, or t
  modified_base (697)..(697): a, c, t, g, unknown or other
  misc_feature (697)..(697): n is a, c, g, or t
  modified_base (702)..(702): a, c, t, g, unknown or other
  misc_feature (702)..(702): n is a, c, g, or t
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgttctgcaagcagctcgaacatcgggagcagtggtgtgatgtggtatcaagaaagtcccaggaccgccccaaactcgtcatctataatgacgctgagcggtccttaagggtccctgaccgtattcnctggcgagaggtctggcgcctcagccttccgtggccatcagagggctccagtctgaagngtgagctgtattattactgtgacaatcgtgggtatgacgtaggtcgtcggtaaccgggtttccggttttacgggacgggtaacgggaccgtaaggtccgtacggtaaccccgttaccgttaaaacggttcccgaacggtaaccccctaaacggggtcccttacccggtccccccccggttcgggttaccctacccgtttcccgttaccccgttttaccccccgaaccccccgtttccccgtaaccccgtaaccgggtaaccggttaaccggttaacccggttcgggaacccgggtccgggggtaccttaccggggtaacccgaaacggggtcccggaccgttaaggttaaccgggtanacgcgacgtcgacgcgacancgtgngag

SEQ ID NO: 225683 - DNA, 735 bp, Homo sapiens
  misc_feature: GYAE6OF01AT2TW.19.86.H09.1.454.CMB.1.raw
  modified_base (118)..(118): a, c, t, g, unknown or other
  misc_feature (118)..(118): n is a, c, g, or t
  modified_base (711)..(711): a, c, t, g, unknown or other
  misc_feature (711)..(711): n is a, c, g, or t
  modified_base (720)..(720): a, c, t, g, unknown or other
  misc_feature (720)..(720): n is a, c, g, or t
  modified_base (725)..(725): a, c, t, g, unknown or other
  misc_feature (725)..(725): n is a, c, g, or t
  modified_base (728)..(730): a, c, t, g, unknown or other
  misc_feature (728)..(730): n is a, c, g, or t
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttctgcaagcagctcgaacagtcgggagcaggtggtgtgatgtggtatcaagaaacgtcccgaggaacccggacccccaaactcgtacatactaataagtcgacgcgtagacggtccggttaccgttaacgggtccctaggaccgtatttccgtacgtcgggacgaaggtacggtccgtcgggccgtccctcgacggtcccctttccccgtcgggaccctacgtacggtaacgggaccgggtcccttaccggacgttacgtaggaaacggtagtacgggacggtacgttagttaattttaacgttacgttggtacgtaactaagttcggtaggtatacggacgtaggttcgggtaccggttaccggggtttccgggttacgggacgggacggtaaccgaggtccgtaccggtaccgttacgtacgtaccgaacgtacccggtacgccgtacccgtcccgtcggtaccctaccgttcccgttcccgttcccccgtccctaccgtaccgaacggtacgtacgttaccggacggtacgggccgggtacgtccggacggacggtaccgagtacgtcgncgtagctgngtacncgnnngngng

SEQ ID NO: 225684 - DNA, 677 bp, Homo sapiens
  misc_feature: GYAE6OF01ADBZD.19.86.H09.1.454.CMB.1.raw
  modified_base (659)..(659): a, c, t, g, unknown or other
  misc_feature (659)..(659): n is a, c, g, or t
  modified_base (672)..(673): a, c, t, g, unknown or other
  misc_feature (672)..(673): n is a, c, g, or t
  modified_base (675)..(677): a, c, t, g, unknown or other
  misc_feature (675)..(677): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctggaccgtattctcgtggcgagaggtctggcgcctcagcttcccgtggccatcgagacgggcctccgagtctaggaagagtgaggctgatttattacgtgtgacaagtcgtggtatgacaggttgtaggtaaccgggttccggttttacgggcgggtacgggaccgaaggtccgtacggaacccggttaccgtaaacggttcctaacggtaccccgaaacgggtcccgtcccgggtaccccccggttaccgggttacccgtaaccgtttcccgttacccgggtttcccccgtaccccccgttccccgttccccgaaccggtacgggtaacgttaccggtacggtacgggtccggggtacccggttcggggaccgtaaacggggccgtacccgtaaggttccggagtacgntacgcgcgtcacnncnnn

SEQ ID NO: 225685 - DNA, 846 bp, Homo sapiens
  misc_feature: GYAE6OF01D40AL.19.86.H09.1.454.CMB.1.raw
  modified_base (118)..(118): a, c, t, g, unknown or other
  misc_feature (118)..(118): n is a, c, g, or t
  modified_base (164)..(164): a, c, t, g, unknown or other
  misc_feature (164)..(164): n is a, c, g, or t
  modified_base (252)..(252): a, c, t, g, unknown or other
  misc_feature (252)..(252): n is a, c, g, or t
  modified_base (826)..(826): a, c, t, g, unknown or other
  misc_feature (826)..(826): n is a, c, g, or t
  modified_base (829)..(829): a, c, t, g, unknown or other
  misc_feature (829)..(829): n is a, c, g, or t
  modified_base (837)..(837): a, c, t, g, unknown or other
  misc_feature (837)..(837): n is a, c, g, or t
  modified_base (841)..(841): a, c, t, g, unknown or other
  misc_feature (841)..(841): n is a, c, g, or t
  modified_base (843)..(844): a, c, t, g, unknown or other
  misc_feature (843)..(844): n is a, c, g, or t
  modified_base (846)..(846): a, c, t, g, unknown or other
  misc_feature (846)..(846): n is a, c, g, or t
tcagtactctcgtgcacgaccggtgctcgatttagtgctatagacttgggtttgggggccgttcctgggcccagtctgtgctgactcaggcaccctcagcgtcgtcgggaccccgggnagacggtcaccatcgcttgtctgcaagcagctcgaacagtcgggancagtggtgtgatgtaggtatacagaaaacgtcccgaagggaaccggtacccccaaaactcgtacaacttactaattaaagtcgaacgnttacggagtaccgggttaccttaaacgggtcccctagtacccggtatttccgtcgtggaccggaggaggtcgtcggccgtccgtaccacgtcctttcccgtaggaccctagtaccgaaggggtaaccgggtcctaccccgtaaggttaccgttaaggaaacggtaagttacgggaacggttaccgttaaggtaaattttaacgtttaaacgttggtacgtaacgaaacgttgttaacgggtaagtacgtaaacggtagttacggggtaacgttaacccggggggtttacccgggtttttacggggaaccggggtaaacgggtaaaccccgtaaaggttacccgggtaccggttaaccggttaaccccggttaaacggttaccgaaccggacccgtaaaaccgggtcccggttacccggtacccccccgggttaacggttacccgtaacccgttttcccgttacccggttttaccccccgtacccgttacccgttaaccccgggaaacgttaaccgggtaacgttaccggttacggacgccgggtacgtacggacggtacggcgacgtagtacgnacnctgatcancgancnngn

SEQ ID NO: 225686 - DNA, 574 bp, Homo sapiens
  misc_feature: GYAE6OF01CGKWC.19.86.H09.1.454.CMB.1.raw
  modified_base (258)..(258): a, c, t, g, unknown or other
  misc_feature (258)..(258): n is a, c, g, or t
  modified_base (348)..(348): a, c, t, g, unknown or other
  misc_feature (348)..(348): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (569)..(571): a, c, t, g, unknown or other
  misc_feature (569)..(571): n is a, c, g, or t
  modified_base (573)..(574): a, c, t, g, unknown or other
  misc_feature (573)..(574): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacgtcaccatcgcttgttctgcaagcagctcgaacatcgggagcagtggtgtgatgtggtatcagaaagtcccaggaaccggcccccaaatcgtcatctataatgacgctgagccggtccttaagggtccctgaccgnttctctggcgagaggtctggccgcctcagtccttcccgtggccatcagacgggctccgagtctagaagatgagtctgtattattactgtnactaagtcgtaggatcgacagtggtacgtaacgggttccggtttacggcggtacgggaccgtaagcgtacgaccgtacctacgtcgacgccgaagtcctaccgccccgtcgtccaccgtctccgttccccacccctcctcccgaacgagtacgtacgttggacgtccgggtacgtacggaccgacgggaccgtaccgagttcgatcgcgtanccgtncgcnnngnn

SEQ ID NO: 225687 - DNA, 776 bp, Homo sapiens
  misc_feature: GYAE6OF01ELGWJ.19.86.H09.1.454.CMB.1.raw
  modified_base (570)..(570): a, c, t, g, unknown or other
  misc_feature (570)..(570): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggacgcccactcccaggtgcagctggtgcaggtcgtggggctggaggtgaagggcgcccggtgggtccacgtaggtaggacggtcctccgtcggcggtacggtttcgtttaggaacttacccttaccttacgtacgttactaatttactactaattactaccgttcggtggtcggaccgtacgcccggtcccgtaggaacggtagggttcgttaggtaggtggtaacgggtacgggacgtacgtaccgggtagggttgggtagggtgggtcggacgtacgtaacggtacggcgactaacgtaggttacgttcgggaccgggcccgtcgtaccacgtggtaccggaacggtacggtccgaccgtacaacgtatacgtggtacgtatcggtacgttacgtggacgntaccggtcgtgggtaaccgttcgtacggaaccgtaccggaccgtacgttagttacgggtttaaatttcgggttaggtacccgggaacggggtacgggtaacccgggggtaaacgggggggtaaacccgggttaaacgggtaaaacccggttaagttaaaacgggttttaaaccgggggttcccccggggttaaacccccccggggg

SEQ ID NO: 225688 - DNA, 501 bp, Homo sapiens
  misc_feature: GYAE6OF01B9CUB.19.86.H09.1.454.CMB.1.raw
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
  modified_base (472)..(501): a, c, t, g, unknown or other
  misc_feature (472)..(501): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaagggcataaagtggttcgaccccgtggggccagggaaccctggtcaccgtctcctcagcctccaccgagggccccatccggtaccttcccccgtggcccncccctgcctccaggacnccaccctccgagacgccacacggccggcccgtgggcctcggcccttgggtaccaacggacctaccttccccgaggacgaacgtactggaggccggggtctacgggacgaacgggccgacctagtacgnnnnnnnnnnnnnnnnnnnnnnnnnnnnnn

SEQ ID NO: 225689 - DNA, 616 bp, Homo sapiens
  misc_feature: GYAE6OF01CHYN8.19.86.H09.1.454.CMB.1.raw
  modified_base (163)..(163): a, c, t, g, unknown or other
  misc_feature (163)..(163): n is a, c, g, or t
  modified_base (604)..(604): a, c, t, g, unknown or other
  misc_feature (604)..(604): n is a, c, g, or t
  modified_base (609)..(610): a, c, t, g, unknown or other
  misc_feature (609)..(610): n is a, c, g, or t
  modified_base (612)..(616): a, c, t, g, unknown or other
  misc_feature (612)..(616): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggccccaaatcgtcatctataatgacgctgagtccggtaccttaagggtccctggaccgtatttccgtctgggacggtaggacggtcgtggccgcctccgagtccttcccgtcggccagtcgacggtacgggctccgagtctgaagagtgaggtctagtattattactgtgactaatcgtggatgtacgaggtgtagtacgggttccgggttttcggacgggtacgggaaccgagcgtacgaccgtaccgtaacgtccgacgtaccgaacggtcctcccgtccccgtcggtcctaccgtccttcccgttcccctaccccttcccgtaccgaaccgtacgtacgttaccgtacggaccggtaccgggtcgtcgggaccgtaacgggccgaacgacgttacgagtngcagnncnnnnn

SEQ ID NO: 225690 - DNA, 538 bp, Homo sapiens
  misc_feature: GYAE6OF01BZ2BV.19.86.H09.1.454.CMB.1.raw
  modified_base (525)..(525): a, c, t, g, unknown or other
  misc_feature (525)..(525): n is a, c, g, or t
  modified_base (528)..(538): a, c, t, g, unknown or other
  misc_feature (528)..(538): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagccttccctggccatcaggagggctccgagtctgaagatgagctgattattactgtgcaatcgtgggatgactagtgtcggtaacggttccggtttcggcggagggaccaagcgtacgaccgtactaagtcacgcccaaggtcctccgcccccgtcggtcctaccgtctaccgttccccaccccttcctccgaaccgtacgacgtacgtgacggcggtcgtggcaaggcgacgagtaggncgnnnnnnnnnnn

SEQ ID NO: 225691 - DNA, 629 bp, Homo sapiens
  misc_feature: GYAE6OF01EQ0EH.19.86.H09.1.454.CMB.1.raw
  modified_base (544)..(544): a, c, t, g, unknown or other
  misc_feature (544)..(544): n is a, c, g, or t
  modified_base (616)..(616): a, c, t, g, unknown or other
  misc_feature (616)..(616): n is a, c, g, or t
  modified_base (619)..(629): a, c, t, g, unknown or other
  misc_feature (619)..(629): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagccggttccttaagggtccctgaccgtattctcgtggcgagacggtctcggccgcctcacgtccttcccgtggcctagtcgaggacgggtcctccgagtctagaagatggagtctagtatttagttacgtgtcgactaagtcgtaggatgacgtaggttgtacgggtaacgggtttccgggtttacgggacgggtaacgggaacctaaggtccgttacggtaacccgttaccgttaaggtacccgaaccgtaccccgaaggtcccgtcccggtcccccgttacggtacctaccgttccgttcccgttacccccncccttacccgtcccgaacggtacgtacgtacgtcggacggccggtacgtacggtacgaacggccgatagtgncgnnnnnnnnnnn

SEQ ID NO: 225692 - DNA, 735 bp, Homo sapiens
  misc_feature: GYAE6OF01B804X.19.86.H09.1.454.CMB.1.raw
  modified_base (163)..(163): a, c, t, g, unknown or other
  misc_feature (163)..(163): n is a, c, g, or t
  modified_base (706)..(706): a, c, t, g, unknown or other
  misc_feature (706)..(706): n is a, c, g, or t
  modified_base (719)..(719): a, c, t, g, unknown or other
  misc_feature (719)..(719): n is a, c, g, or t
  modified_base (727)..(727): a, c, t, g, unknown or other
  misc_feature (727)..(727): n is a, c, g, or t
  modified_base (730)..(730): a, c, t, g, unknown or other
  misc_feature (730)..(730): n is a, c, g, or t
  modified_base (732)..(732): a, c, t, g, unknown or other
  misc_feature (732)..(732): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaacgtccaggaaccgccccaaactcgtcatctataatgacgctgagccggttaccgttaacgggtccctgaccgtattcctcgtggcgaggacggtcgtggccgcctcgacgtccttcccgtggccatcgaggacgggtctccgtagtctagaagtgtggaggtctagtatttacgttacgtggtcacgtaagttcgtagggtatacgtaacgtaggttcggtacgggtaacccgggttttccggggttttacggggaccgggtaacgggtaaccgtaacggtccggttaaccggtaacccgttaccgttaaacggtccgaaaccggtaccccggtaaacggttcccgtccccgggttacccccccgtttacgggttaccccgttaacccgtttcccgtttcccgtttacccccccgtaccccgttacccgtacccgtaaccggtacgtaaccggttaccgtacggacgggtcccgggacggtacggaacccggaacgggtccgtaaccgtagttacggntacgcgcgtacgngtcgagancgngngcg

SEQ ID NO: 225693 - DNA, 564 bp, Homo sapiens
  misc_feature: GYAE6OF01A58M5.19.86.H09.1.454.CMB.1.raw
  modified_base (542)..(542): a, c, t, g, unknown or other
  misc_feature (542)..(542): n is a, c, g, or t
  modified_base (550)..(551): a, c, t, g, unknown or other
  misc_feature (550)..(551): n is a, c, g, or t
  modified_base (553)..(555): a, c, t, g, unknown or other
  misc_feature (553)..(555): n is a, c, g, or t
  modified_base (558)..(564): a, c, t, g, unknown or other
  misc_feature (558)..(564): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctcgtggcgagaggtctggcgcctcagccttccctggccatccgaggacgggctccagtctaggaagatgaggctgatttattactgtgcaatcgtgggatgactagtggtaggtaaccgggtttccgggttttcgggcgggaagggaccaagcctggaccgttctaagtcacgcccgaacggcctccgcccccgtcggtcctacttccgtccgttccccgccccttcccgtaccgacgacggtacgtacgtcggacggcgggcgtcgggacgacggtccgngtagtcgnncnnncgnnnnnnn

SEQ ID NO: 225694 - DNA, 722 bp, Homo sapiens
  misc_feature: GYAE6OF01E3C27.19.86.H09.1.454.CMB.1.raw
  modified_base (221)..(221): a, c, t, g, unknown or other
  misc_feature (221)..(221): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctgggaggatcctcctcttggtggcagcagccaccggacgccccacctcccgaggtgcagctggtgcaggtcgtggggctggaggtgaaggngccgtgggcctcgagtggacggtctccgtgcgtaggtcgttttggactacaccttcagtcattatcatatacgtcgtgggtcgcgacgacggccccgtaggacgaggtctaggagtggagtgggcgtagtccggacgggtggtaggtgggtgcgcgtagtaccggtcgacgaacgtaggtaacggttccgacggggtccgtaccgtaccaccgtaacggtcgggaccgtaagggtcccgaccgtacccgaacgaacgtacgtaggttagtaacgtagtggtacttggacgcgtacgcccggtaggtacgggttaccgtacggaacccgaaccggtacccggtaccgttaagttacgtttaagtttacggtttgggtacgggtaccgggaacgggggtaccggaaacggggggtaaccgggggttaaaccggtaaaaacggggtacttaaaaaggggtttaaacgggttccccggggttaaccccgggtaacccccgggggg

SEQ ID NO: 225695 - DNA, 543 bp, Homo sapiens
  misc_feature: GYAE6OF01DECVY.19.86.H09.1.454.CMB.1.raw
  modified_base (360)..(360): a, c, t, g, unknown or other
  misc_feature (360)..(360): n is a, c, g, or t
  modified_base (502)..(503): a, c, t, g, unknown or other
  misc_feature (502)..(503): n is a, c, g, or t
  modified_base (505)..(510): a, c, t, g, unknown or other
  misc_feature (505)..(510): n is a, c, g, or t
  modified_base (512)..(543): a, c, t, g, unknown or other
  misc_feature (512)..(543): n is a, c, g, or t
tcagtactctcgtgcacgaccggtgctcgatttagtgctatagacaagggcttgagtggatagggcggatccacggtggtagtggtggcgcatacgtcgcacagaagtttcagggcccgcgtcaccatggccaaggtcgcgtccacgaatacagtgtatatggacttgagcagcctgaggtctgacgacacggccatgtattattgtgcgaggcagggcggggactaaaggcagtaaagtggttccgaccccgtggggccaagggaaccctggtcaccgtctccctcacgccctccaaccgaacgggcccctacgtccgggttccccttccccctgggcccgtccctgcctccagggacncctacccgtccggacgacgctacgacggccggccccgtaggggcctcggccgtggtccaaacggtacctaccgttccccaacgtagtaacgtacgtaggacgggtccgggtacgtcgggacgaaacgggcgactaagttagnngnnnnnngnnnnnnnnnnnnnnnnnnnnnnnnnnnnnnnn

SEQ ID NO: 225696 - DNA, 627 bp, Homo sapiens
  misc_feature: GYAE6OF01AZ8KK.19.86.H09.1.454.CMB.1.raw
  modified_base (116)..(116): a, c, t, g, unknown or other
  misc_feature (116)..(116): n is a, c, g, or t
  modified_base (180)..(180): a, c, t, g, unknown or other
  misc_feature (180)..(180): n is a, c, g, or t
  modified_base (220)..(220): a, c, t, g, unknown or other
  misc_feature (220)..(220): n is a, c, g, or t
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
  modified_base (607)..(607): a, c, t, g, unknown or other
  misc_feature (607)..(607): n is a, c, g, or t
  modified_base (614)..(614): a, c, t, g, unknown or other
  misc_feature (614)..(614): n is a, c, g, or t
  modified_base (619)..(619): a, c, t, g, unknown or other
  misc_feature (619)..(619): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
tcagtactctcgtgcacgaccggtgctcgatttagtgctatagacttgggtttgggggccgttcctgggcccagtctgtgctgactcaggcaccctcagcgtctgggacccccggnagacggtcaccatcgcttgttctgcaagcagctcgaacatcgggatgtggtgtgatgtggtatnagaagtccaggacggaccccaactgtcatctataatgacnctgagtcggtccttaacggtcctgaccgattctcgtggcgacgaggtccgtggacgcctacgacgtccttacccgnggcctatccgaggacgggtcctccgaagttctagaaagcgtgaacggtcttagattttacgttacnggttcacgtaactcgttaggggnttggaacgtagttcggtacgtaaccggggtttcgggtttcgggaccggtagggacctagtacgtcgtaaccgttctaacggtcgaacgaccgaaggccgtccgtccccgtgtaccaccgttaccgttccgtacccctacccgtaccgacccgaacggtacgtacggtctcgggtaaggccggtacgtacgggacgtaacggcgtaaccgagtacgctaggcngagtccncgacncancntng

SEQ ID NO: 225697 - DNA, 623 bp, Homo sapiens
  misc_feature: GYAE6OF01AWDCO.19.86.H09.1.454.CMB.1.raw
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (547)..(547): a, c, t, g, unknown or other
  misc_feature (547)..(547): n is a, c, g, or t
tcagtactctcgtgcacgaccggtgctcgattagtgctatagacttgggtttgggggaagaggaagactgacggtcccactcccaggtgcagctggtgcagtctggggctgaggtgaaggagccgtggggcctcagtgaaggtctcctgcgaggcttttggatacaccttcagtcattatcatatactctgggtgcgacacggcccctggacaagggtcttggagtggagtaggggcgatccgacgggtggtagtggtgcgcagtacgtcgcacagaagtttcgagggccgcgtcacntcggcaaggtcgcgtccacgtaatacagtgtatagtggacttgancgacgctggacggtctaggaccacgacggctaagtgtatttagttgtgcgaggcgaagggacgggacgtaaaggcaagtaaaggttcggtaccggacccgtggggacccgaacgggtaccccgttgggtacccacccgttctccgaccacgccctacccgaccggaaccggtcccacgttcccgttaccctccccgtcggcccncccgtcgccctaccggcggacgccctaacccggtccgaacgaccgaccgacgacccggcccggcccgtgggtcccg

SEQ ID NO: 225698 - DNA, 434 bp, Homo sapiens
  misc_feature: GYAE6OF01DDBDR.19.86.H09.1.454.CMB.1.raw
  modified_base (426)..(434): a, c, t, g, unknown or other
  misc_feature (426)..(434): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataagtggttcgacccgtggggccagggaaccctggtcaccgtctcctcagcctccaccaaggcccatccggtcttccccctggccgccctgctccgaggacgccacctccgagacgcacagccggccctgggctgcctggtcaaggacctacttccacgagacgtactgacgcgggctggcaagggcgcatagcnnnnnnnnn

SEQ ID NO: 225699 - DNA, 668 bp, Homo sapiens
  misc_feature: GYAE6OF01DL264.19.86.H09.1.454.CMB.1.raw
  modified_base (174)..(174): a, c, t, g, unknown or other
  misc_feature (174)..(174): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (501)..(501): a, c, t, g, unknown or other
  misc_feature (501)..(501): n is a, c, g, or t
tcagtactctcgtgcacgaccggtgctcgattagtgctatagacttgggtttgggggaagaggaagactgacggtcccactcccaggtgcagctggtgcagtctggggctggaggtgaaggagccgtggggcctcaggtgaaggtctcctgcgaggtcttttggatacaccttnagtcattatcatatactcgtggggtgcgacacggcccctgggacaagggcttgaggtggagtagggcgatccgagggtggtagtggnggcncatacgtcgcacagtaagttcgagggccgcgtccaccagtcggaccgaagggtccgccgtacccaacggtaataccgaggttgtatagtggacttggacgcgagcctggaggtctaggaccgacgacggacctagttagtatttagttggtgcggtaggcgagggacgggactaaagggctaagtaaaggttcggtaccgaccccggtggggaccacggggtaccctgggtacccnccggttctcccgtcgacgtcccctaccgaacccggacgggtcccctacgttcccggttacccgttcccccgtcggcccgtcccgtcgtccctccggaacgggaccgtacccaccccggtaccgacggaccgacccgacgaccgggtcccggcccggtgggtccccgg

SEQ ID NO: 225700 - DNA, 662 bp, Homo sapiens
  misc_feature: GYAE6OF01EDGOU.19.86.H09.1.454.CMB.1.raw
  modified_base (345)..(345): a, c, t, g, unknown or other
  misc_feature (345)..(345): n is a, c, g, or t
  modified_base (649)..(650): a, c, t, g, unknown or other
  misc_feature (649)..(650): n is a, c, g, or t
  modified_base (652)..(662): a, c, t, g, unknown or other
  misc_feature (652)..(662): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacagtcgggagcagtggtgtgatgtgtatcagaagtcccaggaaccgcccccaatcgtcatctataatgacgctgacgtccggttaccttaacgggtccctgaccgtattcgtcgtggacgaggtacggtcgtcggccgcctcgacgtccttcccgtggcctatcgaggacggtcctccgagtctagaagngtgagcgtagtattagttactgtacgtactaagtcgtagggatcggaacgtaggtcggttaccgggtaaccgggttttccggggtttaccggggaccgggtaacgggtaacccgtaaggtccgttaccggtaacccggttaccgtaacggtaccgaccggacccgtacgggtcccgtcccggtccccccgtcggtaccctacccgttcccgttcccgttccccctcccctacccgtacccgaccggtacggtacgttaccgtaggaccgggtcggtccgtacgggaccgacgggcgacagtcgnngnnnnnnnnnnn

SEQ ID NO: 225701 - DNA, 751 bp, Homo sapiens
  misc_feature: GYAE6OF01CCESF.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggactcctcctcttggtggcagcagccaccggagcccactcccgaggtcgcagcgtggtcgcgtagtcgtgggctggaggtgaaggacgtcgtcgggcctcgagtcggaacgtctccgtggcggtaggtcgttttcggacttacgtaccgttgacgttacctaattactctaattacttacgtcgttgggtcgccgtaaccgaccggtaccccgtagggaacgtaacggggttctagggtaggtacgggtaacgtacggggtccgtaacgtcccggtaaggggttcggttaaggtgggtacgggcgtaacgtacgttaaccggcgtacgaacgtaaggttaacggtttcggacgggtcccgtacgtaccgaaccgtaggttaccggaccggtaacgggtcccgtaccggttaccgaacgtaacgtaccgtaggttacgttaactacggttcggttaaccgtgtaaccgtcgtacccgtacgtacggtacgtccgaacgggacccgacgtacgtacttagttagtactttggtcggtacgtaggacggtacgggaacggtaccgggtaaagtaccggaacgttaaggttaccgggttcccgggtacccgtacccgggg

SEQ ID NO: 225702 - DNA, 700 bp, Homo sapiens
  misc_feature: GYAE6OF01DHDV0.19.86.H09.1.454.CMB.1.raw
  modified_base (556)..(556): a, c, t, g, unknown or other
  misc_feature (556)..(556): n is a, c, g, or t
  modified_base (590)..(590): a, c, t, g, unknown or other
  misc_feature (590)..(590): n is a, c, g, or t
tcagtactctcgtgcacgaccggtgctcgatttagtgctatagacttgggtttgggggagagcatcacccagcaaccacatctgtcctctagagaactcccctgagagctccgttcctcaccatggactggacctggaggactcctcctcgttggtgcagcacgccgaccggacgcccactcccgaggtcgcagcgtggtgcgtaggtcgtggggctaggaggtaggaaggcggccggtcggggcctacgaggtaggtaacggtcctccgtaggcggaggttcgttttaggaactacctaccgtttacgagtactaattacactagtacttacgtcggttggacgacgaccgaccggtcccgtacggaacggtaaggtcttagggagtacgggaagtacggggacgtacgtccggtaacgggtggtagggtgggtacggacgtacgtaacgttacgtcgaaccgaaacgtaggttaacggttcgggaaccgggtcccgtacgtacccaacgtgacgggtacgacggttcgacctacgaagtaacgtcgagtagtanacggtgtacgttgacgcgagtcgtagtcggtacnggaaccgtcgaaccgacgttagtaggttaattagtcggaggacggaggtacggaaggggttccgggaaacgtaagggtactaaaacgggttaggtccggttaaccccggg

SEQ ID NO: 225703 - DNA, 599 bp, Homo sapiens
  misc_feature: GYAE6OF01BAT69.19.86.H09.1.454.CMB.1.raw
  modified_base (215)..(215): a, c, t, g, unknown or other
  misc_feature (215)..(215): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagcgtggtgcagtcgtggggctgaggtgaaggngccgtgggcctcgagtgaggtctcgtggcgaggtcgttttggatacgtaccttcagtctattatcatatactcgtgggtgcgacacggcccgtggacgagggtcgttaggagtggagtagggcggatccgacgggtggtaggtgggtggcgcgtagtacggtcgcacgaagtagtttcgacgggccgcgtacaccgagtcggaccgagggtccgcgtccaaggaactacgagtagttatagtgtacgttggagtcgacgtccgtggtaggtcgtcggaacgacgaccggactagttagttagttacgttggtggtacggaggacgaggggtacgggaacgtaaacgggcaaagtttaacgggtccggtcgggtaacccccgggg

SEQ ID NO: 225704 - DNA, 802 bp, Homo sapiens
  misc_feature: GYAE6OF01EXLUP.19.86.H09.1.454.CMB.1.raw
  modified_base (97)..(97): a, c, t, g, unknown or other
  misc_feature (97)..(97): n is a, c, g, or t
  modified_base (99)..(99): a, c, t, g, unknown or other
  misc_feature (99)..(99): n is a, c, g, or t
  modified_base (371)..(371): a, c, t, g, unknown or other
  misc_feature (371)..(371): n is a, c, g, or t
  modified_base (414)..(414): a, c, t, g, unknown or other
  misc_feature (414)..(414): n is a, c, g, or t
  modified_base (615)..(616): a, c, t, g, unknown or other
  misc_feature (615)..(616): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (765)..(765): a, c, t, g, unknown or other
  misc_feature (765)..(765): n is a, c, g, or t
  modified_base (800)..(802): a, c, t, g, unknown or other
  misc_feature (800)..(802): n is a, c, g, or t
tcagtactctcgtgcacgaccggtgctcgatttagtgctatagacttgggtttgggggccgttcctgggcccagtctgtgctgactcaggcccctcncncgtcgtcgggcccggggccgacgacggtccgaccactcgtcttcgtttcgttcgtcgaacgacttacgcgtacgaactaacgtacgggtacggacgaggtagggttggtggtagtggttaggtacgtacgaacgtaaacgtaaccgaaccggaacccggaaccccgaaacccgtaccgtactactactaactaatacgacgcgtcgacgcggtaccggttacggtaccgtcgtaccgtacttactcgttggcggagacggtcgtcggccgtncgtctaccgtcggttcccctaggtccaactacggacggtaccntaccgtaccgtacgaacgtacgtaaggtaacgtacgtacggtacgttacgttaacgtttacgtttacgtacgtacgtacgtaacggtacgtacggtacgtagtacgtacggttacgggttacgggttaccggggttaccgggcgtttacggggtaccggtaacgggtaccgtaacggtaaccggttaccggtaaaccggtnnacccgtaacgggtacccgtncnccggtaccccgtaaccgggtacccccgttacccgggttacccccgttacccgggttacccgttacccgttaccccgttacccggttaccccgtacccgtaccgtaccgaacggtacgtacgtacggnacggacggcggtcgacggacggacgtacacgagcnnn

SEQ ID NO: 225705 - DNA, 607 bp, Homo sapiens
  misc_feature: GYAE6OF01BEQRD.19.86.H09.1.454.CMB.1.raw
  modified_base (222)..(222): a, c, t, g, unknown or other
  misc_feature (222)..(222): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
tcagtactctcgtgcacgaccggtgctcgatttagtgctatagactttggggtttggggagcatcacccagcaaccacatctgtcctctagagaatcccctgagagctccgttcctcaccatggactggacctggaggatcctccttcttggtggcagcagccaccggagcccactcccgaggtgcaggctggtgacagtcgtggggactggaggtgaaggngccgtggggcctcgagtgacggtctccgtgcgaggtcttttggatacactttcagtctattatctatatactcgtgggtgcgacacggtccccgtaggacgaagggtcttaggaggtggagtaggggcggatcccggagggtcggtaggtgggtggcgctacgtacgtcgcgacgtaggtagttcgacgggccgcgtacacgtgtcggcgaaggtcgcgtccaacgtaatacgnggttntagngtagacttggagtcacgtcctaggcgttctaggaccggtacgacgtccgtatagttattagttggcggtacggagggtcggaggggacgggtaacgtaaacggctaaagggttacggttccgggttcccgtaaccccggggg

SEQ ID NO: 225706 - DNA, 873 bp, Homo sapiens
  misc_feature: GYAE6OF01D26BE.19.86.H09.1.454.CMB.1.raw
  modified_base (540)..(540): a, c, t, g, unknown or other
  misc_feature (540)..(540): n is a, c, g, or t
tcagtactctcgtgcacgaccggtgctcgatttagtgctatagacttgggtttggggagcatcacccagcaaccacatctgtcctctagagaactcccctgagagctccgttcctcaccatggactggaccgtggaggactcctcctcgttggtggcagcacgccgaccggacgcccaccgtcccgaggtcgcgaggcgtgggtacgcgtaggtcggtgggggtccgtggaagggttaggaacgggcgtccggtcgggggacctacgaggtacggtaacggtcctaccgtggtacggtacggttccgttttaggaaccttacctaccgtttacacgttacctatttacgtactaagttaacttccgttacgggttcgggtacgaccggtaccggaccgggtacccccggtaggaaccggtaacgggtccgttaggtacgggtagggtaacgggtacggggaccggtaaccgtccgggttacggggttagggtagggttcggggtcgggacccgtacgtaacggttacccgggaccggtanaaaccgggttaacgggttacggttaccgggacgggggtcccacggttaccaccggtacggtaccgggaccggtaacgggtccggtaccgtaaccgtaacgtaactacgtacggttagtactaggtacggtacgtaggacgacgacgtacgtggtaccggttcgaacggaaccgacggtaccgtaccgtaagtttacggttaacgttacgggttacggtacgggtacgggtacgggaaccgggtaaacgggggtaccggttaaaccgggtaaacgggtaacgttaaaagggtttacccggggttaaccgggtcccccgggggttaaccccgggg

SEQ ID NO: 225707 - DNA, 677 bp, Homo sapiens
  misc_feature: GYAE6OF01BU63S.19.86.H09.1.454.CMB.1.raw
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (661)..(661): a, c, t, g, unknown or other
  misc_feature (661)..(661): n is a, c, g, or t
  modified_base (665)..(665): a, c, t, g, unknown or other
  misc_feature (665)..(665): n is a, c, g, or t
  modified_base (669)..(669): a, c, t, g, unknown or other
  misc_feature (669)..(669): n is a, c, g, or t
  modified_base (671)..(673): a, c, t, g, unknown or other
  misc_feature (671)..(673): n is a, c, g, or t
  modified_base (675)..(677): a, c, t, g, unknown or other
  misc_feature (675)..(677): n is a, c, g, or t
tcagtactctcgtgcacgaccggtgctcgatttagtgctatagacttgggtttgggggccgttcctgggcccagtctgtgctgactcaggccaccctcagcgtctcgggacccccgggcagaccggtcaccatcgcttgttctgcaagcagctcgaacagtcggagcagtggtgtgatgtggtatcagaaacgtcccgaggaccgccccaaatcgtcatctataatgacgctgagtcggtaccttaacgggtccctgacctnttcncgtggcgaagnggtctggcgtcctnacgcgttcccnggcctactcgaggacgggcctccgtagtcgtagaagacgtgtacggtcgtagtaactttagttacgtggttcgactaacgttcggtgggacttggaaccgtaggtcgggttacgggtacccgggtttccgggtttcgggacgggtacgggaaccgtaacggtccgtaaccgggtacccttaccggttaacgtacccgtaaccggaccgtaccggtacccggttccgtacccccggttcgtaccccgtaccgttcccgttcccgttacccccgtacccctttacccgccccgtaacgtaccggtacggtaaccgtcggaaccgggtcggacgtcggaccgtacggaccgcgtagtcgcancgtntgcncnnncnnn

SEQ ID NO: 225708 - DNA, 725 bp, Homo sapiens
  misc_feature: GYAE6OF01DS06J.19.86.H09.1.454.CMB.1.raw
  modified_base (117)..(117): a, c, t, g, unknown or other
  misc_feature (117)..(117): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (708)..(708): a, c, t, g, unknown or other
  misc_feature (708)..(708): n is a, c, g, or t
  modified_base (715)..(715): a, c, t, g, unknown or other
  misc_feature (715)..(715): n is a, c, g, or t
  modified_base (720)..(722): a, c, t, g, unknown or other
  misc_feature (720)..(722): n is a, c, g, or t
  modified_base (724)..(725): a, c, t, g, unknown or other
  misc_feature (724)..(725): n is a, c, g, or t
tcagtactctcgtgcacgaccggtgctcgatttagtgctatagacttgggtttgggggccgttcctgggcccagtctgtgctgactcaggcaccctcagcgtctgggacccccgggnagacggtcaccatcgcttgttctgcaagcagctcgaacatcgggagcagtggtgtgatgtggtatcaagaaagtccaggaccgccccaaatcgtcatctaataatcgacgctgagtcgtaccgttaacgggtccctgaccgtnttcncgtggcgagaggtctcggcncctcgacgtccttccgnggcctatccgaaggacgggtcctccgagttcctaggaagtagtaggtacggtctaggtaaatttacgttaacgtggtacgactaacgttcggtagggacttacgacgtaggttcgggttacggtaccgggttttccgggtttacgggacgggtaacgggtacgaacgtccgtacggtaaccccgttacgtaacggtcgaaccggtacccgtaacggtccccgttcccggtacccccggtttaccggttcccgttaacccgtttccccggttttaccccgttaccccccccgtaaccccgtttcccccgttaaacccggtaaccggttaaacgggtaccgttaaccggttcggacggggtcccggtacggttcgggaacccggaacgggtccgtacgtaacgagtcgngacgtgncgcannngnn

SEQ ID NO: 225709 - DNA, 480 bp, Homo sapiens
  misc_feature: GYAE6OF01B6NI1.19.86.H09.1.454.CMB.1.raw
  modified_base (352)..(352): a, c, t, g, unknown or other
  misc_feature (352)..(352): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (469)..(480): a, c, t, g, unknown or other
  misc_feature (469)..(480): n is a, c, g, or t
tcagtactctcgtgcacgaccggtgctcgatttagtgctatagacttgggtttggggccgttccgtggcccagtctgtgctgactcagacaccctcagcgtctgggaccccgggcagtacggtcaccatcgctttgttctgcaagtcagctcgaacatcgggagcagtggtgtgatgtggtatcaggaaagtcccaggaacggccccaaagtcgtcatctataatgacgctgagcggtccttaaggccctgaccgattctctgcgagaggtctggcgctcagcttcctggccatcagaggctccagtctagaagatgagctgattatactgtgcaatctgggatgacagtgngaacggtcgtttacggcgagggaccaagatgacgctaagtcagccaagactgccctcggcatcngttccacctctcacganagtctaganacgggtctggcgaagnccgataggctnnnnnnnnnnnn

SEQ ID NO: 225710 - DNA, 680 bp, Homo sapiens
  misc_feature: GYAE6OF01EDDHE.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagcccaccggacgccccacctcccaggtgcagcgtggtgcagtcgtggggctggagggtaggaaggacgccgtggggcctcgaggtgaaggtcctccgtggcggtaggttcgtttaggactacctaccttcacgttctaattactactattactacttcggtgggtcgcgaccgacggccccgtaggaacgagggtcgttaggtaggtggtaggtacgggacggtacgtaccggtacgggtggtaggtgggtggcgcgtacgtaccgtcgacgaacgtaggtaacggtttcggacgggtccgtcgtaccaccgtaggtcggaccgtacgggtccgaccgtaccgaacggtaatacgtagttagtaattacgtaggtacttagacgtacgacgtccgtaggccgttacgtaggaccgaccgacggtacctagttagttagttagttggacggacggaggacggacggggaccgggtaagtaacggaacgtaaggttaacgggttccgggtaccggtaccccgggg

SEQ ID NO: 225711 - DNA, 593 bp, Homo sapiens
  misc_feature: GYAE6OF01DINH6.19.86.H09.1.454.CMB.1.raw
  modified_base (213)..(213): a, c, t, g, unknown or other
  misc_feature (213)..(213): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggngccgtggggcctcgagtgaaggtctcctgcgaggtcttttggatactaccttcagtctattatctatatactcgtgggtgacgacgacggcccctggacgaagggtcttagagtggagtagggcggagtcgacggtggtagtgggtggcgcagtacgcgcacgagtaaggtttcgagggccgtcgtctaaccgagtcggaccgaaggtccgcgtacccgaacgaatacgagttacgtatagttggtacgttgagtcgagtccgtaggaagggtctaggacgacgtaccgggacctagttcgttatttagttggtgaccggtagggcgaggggaacgggactaaagggactaaggtaaggttcgggttaccggaccccggg

SEQ ID NO: 225712 - DNA, 540 bp, Homo sapiens
  misc_feature: GYAE6OF01CPAIZ.19.86.H09.1.454.CMB.1.raw
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (481)..(481): a, c, t, g, unknown or other
  misc_feature (481)..(481): n is a, c, g, or t
  modified_base (511)..(515): a, c, t, g, unknown or other
  misc_feature (511)..(515): n is a, c, g, or t
  modified_base (517)..(540): a, c, t, g, unknown or other
  misc_feature (517)..(540): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaaggcaagtaaagtggttccgaccccgtggggaccacgggaaccctggtccaccgtctcctcacgcctaccaccgacgggcccagttccggtcccttcccccgnggcccgccctcgcctccgaggacnccacccgtccgagacgaccgaccgacggcccggtccctggggcctcggcccgttacgggtaccgaaacggtccctttaacccgttcccccgaaggacgtaacgtacgtagggaccggccggggtacncggggacgaaacgggtccgactaatacggnnnnngnnnnnnnnnnnnnnnnnnnnnnnn

SEQ ID NO: 225713 - DNA, 728 bp, Homo sapiens
  misc_feature: GYAE6OF01BILRZ.19.86.H09.1.454.CMB.1.raw
  modified_base (166)..(166): a, c, t, g, unknown or other
  misc_feature (166)..(166): n is a, c, g, or t
  modified_base (703)..(703): a, c, t, g, unknown or other
  misc_feature (703)..(703): n is a, c, g, or t
  modified_base (710)..(710): a, c, t, g, unknown or other
  misc_feature (710)..(710): n is a, c, g, or t
  modified_base (716)..(717): a, c, t, g, unknown or other
  misc_feature (716)..(717): n is a, c, g, or t
  modified_base (720)..(720): a, c, t, g, unknown or other
  misc_feature (720)..(720): n is a, c, g, or t
  modified_base (722)..(728): a, c, t, g, unknown or other
  misc_feature (722)..(728): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcaggacggtcaccatcgcttgttctgcaagcagctcgaacagtcgggancagtggtgtgatgtggtatcaagaaacgtcccgaggaaccggcccccaaatcgtacattctaataatcgacgcgtggacgtccggttacccgtttaacgggtccctaggacccgtactttccgtcggttggccggtaaggtacggttccgttcgggccgcccttacacggtcctttccccgtcgggtcccaactcgaacgggacggggtcctccgtaggttccgttaggaaacggtacgttagggacgggtcttaggttaattttaactttacggtgttacggacttaaagttccggtaggggtatacggtaacgtaggttcggtacggggttaaccgggtttccggggttttaccgggccggggtaacgggacgaaggtccgtaaccggtaccgtaccgtaacgtaccgaccgaccgaacggcccgtcccgtccccgtcggtcctaccgttcccttcgttccccctcccttaccgcccgaacgtacggtacgttacgtcggacggtccgggtcgtcgggaaccgacgggccgtaanacggtancggacnncgncnnnnnnn

SEQ ID NO: 225714 - DNA, 714 bp, Homo sapiens
  misc_feature: GYAE6OF01CTTOF.19.86.H09.1.454.CMB.1.raw
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (701)..(701): a, c, t, g, unknown or other
  misc_feature (701)..(701): n is a, c, g, or t
  modified_base (704)..(714): a, c, t, g, unknown or other
  misc_feature (704)..(714): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggaccccaaactcgtacatctaataatgacnctgagcgtcttaacggtccagaccgnttctgtggcgagaggtcnggcncctnagcctttccgtcggccagtcaggacggtcctccgagtctggaaagtgtacggacggtacttgtaacttttaacgttacttacggtgaccttaaagtttccggtaagggtactacggtaacctaggggttacggttacggggttaacccggggttttccccgggggtttttacgggaacgggggaccggggtaaccgaacgggtccgttaccggtaacccgggttacccgttaaacggttacccgaacggtacccgtaaacgggtcccgtttacccggtacccccgttccgggtccctaccgttaccgtttccccgttcccccctaaccccgttcccgtacccgtaacggtaccggtaacgttaccgtacggtaccgggtacgggtccgtacggacggtacgaccgtacgtacgtacgncgnnnnnnnnnnn

SEQ ID NO: 225715 - DNA, 751 bp, Homo sapiens
  misc_feature: GYAE6OF01CCDDO.19.86.H09.1.454.CMB.1.raw
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctagaggtggaaggacggccgtggggcctcgaggtacggaacggtcgtccgtggcggtacggtcttttaggactacctaccgttcagttctattatctaattataccgtgtgggtcgacgacgacggtcccctagggacgaacggtcgtggaggtggacggtagggacggtactccggacgggttggtagggtgggtcggcgatacgtacggtcgacgacgaaggttaggttcgacgggtccgcgtacgaccgtgtacggaccgtacgggtcctaccggtacccgaacgtaacgtacgttaacggtagtaacgttagtcggtaacgttcggacggtcgaacggtccgtaggaccgggtttcgaccgggtaaccaccgggtaccggtaccgttaggtttacgtttaagtttacggtttacgggtcggtacccggggttaacgggaccggggtacggggggtaaacccgggttaacggtaaaacgggtacccgttaaaagggtttaaaccgggggtttcccgggttacccccggtaaaccccccggggggg

SEQ ID NO: 225716 - DNA, 649 bp, Homo sapiens
  misc_feature: GYAE6OF01DWV0X.19.86.H09.1.454.CMB.1.raw
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (632)..(632): a, c, t, g, unknown or other
  misc_feature (632)..(632): n is a, c, g, or t
  modified_base (636)..(638): a, c, t, g, unknown or other
  misc_feature (636)..(638): n is a, c, g, or t
  modified_base (640)..(640): a, c, t, g, unknown or other
  misc_feature (640)..(640): n is a, c, g, or t
  modified_base (643)..(645): a, c, t, g, unknown or other
  misc_feature (643)..(645): n is a, c, g, or t
  modified_base (647)..(648): a, c, t, g, unknown or other
  misc_feature (647)..(648): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacgtcaccatcgcttgtctgcaagcagctcgaacatcgggagcagtggtgtgatgtggtatcaagaaagtcccaggaaccgcccccaaatcgtcatactataatgacgctgagcggttccgttaacgggtccctagaccgattcncgtggcgagaggtctggcncctcgactccttccncggccaagtcgaaggacgggtcctccgagtctagaagagtcgaggcttagtaagtttattactggtacgtactaagttcggtaggtagtacggaacgtagggttacggtacgggttaacccgggtttccgggttttacgggaccgggtaacgggaaccgaaggtccgtacggtaacccgttacgtaacgtacgaccgaccgtaacggccgtcccgacccccgttcggtcctaccgtccgttcccgttaccctaccccgttcctacccgacgacgtaacgtaccgtacggtacgggccgggtctacggacggaacggtacccgagtacgtaacgnacgnnncnacnnngnng

SEQ ID NO: 225717 - DNA, 567 bp, Homo sapiens
  misc_feature: GYAE6OF01CIZYE.19.86.H09.1.454.CMB.1.raw
  modified_base (255)..(255): a, c, t, g, unknown or other
  misc_feature (255)..(255): n is a, c, g, or t
  modified_base (522)..(522): a, c, t, g, unknown or other
  misc_feature (522)..(522): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcncatacgtcgcacagaagtttcagggccgcgtcaccatggccaaggtcgcgtccacgaatacgagtgtatatggacttgagcagcctgagtctgacgacacggcatgtattatgtgcgaggcagggacgggactaaggcaataaagtggttcgaaccccgtggggaccagggaacccgtcggtcctaccgtctacctcacgccctacgaccgaacgggtcccagtccgtaccttccccgtggtccgtccctcgcctaccgtacgggancgtaccctccggagacgtaccacgagcccggtcccgtgggtcccg

SEQ ID NO: 225718 - DNA, 766 bp, Homo sapiens
  misc_feature: GYAE6OF01E1DBP.19.86.H09.1.454.CMB.1.raw
tcagtactctcgtgcacgaccggtgctcgatttagtgctatagacttgggtttggtgagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctggaggtgaaggcgccgtggggcctcgagtgaggtctcgtgcgaggtctttggatacaccttcagtcattatcatatactcgtgggtgcgacgacggcccgtggacaagggtcttgaggtggagtagggcggactccgacgggtggtaggtgggtggcgacagtacggtcgcaacgtaggtaaaggtttcgacggggtcccgtacgtaccgtaacccgtagtacgggaccgtaaacgggtccggtaccggttacccgaaaccggtaaacgttaaccgtaagggtttacggtttaaacgttaaggttacggggttaaccgttttagggaacggtacccgtaacgggtcccgttaggggtaacgggtttacccgtacgggtaaccgggaacccggtacccgggtaccccgttagtttaaacggtttaacgtttttaacggtttgggttacggggtacccgggtaagggggacccggtaaacggggggtaaacccggggggtaaccggttaaaacggggaccttaaagggtttaaaaccgggttccggggtttaaaccccccggggg

SEQ ID NO: 225719 - DNA, 773 bp, Homo sapiens
  misc_feature: GYAE6OF01CC4C7.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagcccgaccggacgccccacctcccaggtgcagcgtggtcgcgagtcgtggggctaggaggtagaaggacgccggtcggggcctcgaggtaggaacggtcctccgtggaccggtaggttcgtttttacgggaacttacccgtaacccgtttcgtagttacctaatttactactaattaacttacgtcgtgggtcgaccgacgaccggtcccgtaggaacgaacgggtcgttaggaggtggtaggtacgggacggtacgtccggtaagggttgggttagggtcggggtacggacgtacgtaacgtaccggtaccgaccgtaacggtaaaggttacggtttacggacggggtaccccggtacgttaccccgaaccggtacggttaccgggacccggtaacgggtcccgacccggtaacccgaaacgtaacgtacgtaggtacgtagttacgtaggtacgttagacgtccgagtccggtaggtacggtcgtaacggaccgtaccggacggtacttagttacgttattaggttggagggtacggacgggacgggaaacggggtaccgggtaagttaaacgggagtaaacgggttaacgggttccgggtaacccccggg

SEQ ID NO: 225720 - DNA, 642 bp, Homo sapiens
  misc_feature: GYAE6OF01CIGFR.19.86.H09.1.454.CMB.1.raw
  modified_base (174)..(174): a, c, t, g, unknown or other
  misc_feature (174)..(174): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggaccgtggaggactcctcctcttggtggcagcacgccaccggacncccactcccgaggtcgcagcgtggtgcgaggtcgtggggctggaggtagaaggcgccggtggggcctgaggtgaacgtcctcgtggcggtagtctttgactacncttcgagtcattanctattatacgtggtgggtagaccgacgaccggcccgtaggaacggtaacggtcttaggnggtaggagtagggccgtataccggaggtaggtagtgggcggcgactagtcggcacgtagaagttacgtcggacgccgtcgtacgacgtagcggaccgtaacggtccgacgtaccgaacgtaacgtaacgtagttacggtaagtacggtacggtataggacgcgacgtcgtaggtacggttcacggaccgacgacccggtagtactgttagtacggttcggaggacggaggcggtaacggggacggtaacggtaaacgtcgtaaacggttaacgggtccggttaaccccggg

SEQ ID NO: 225721 - DNA, 1012 bp, Homo sapiens
  misc_feature: GYAE6OF01BVS9I.19.86.H09.1.454.CMB.1.raw
tcagtactctcgtgcacgaccggtgctcgatttagtgctatagacttgggtttggggagcatcacccagcaaccacatctgtcctctagagaactcccctgagagctccgttcctcaccatggactggaccgtggaggattcctcctcgttggtggcagcacgcccgaccggacgcccactcccaggtcgcagcgtggtcgcgtaggttcggtcggggctggaggttaggaagggacggccggtcggggtcctacggtaggtacggtaacggttcctccgtaggccggtacggttcgtttttacggaaccttaaccgtaccgtttacgtaacgttaccttaatttaacttactaacgtttaaccgtttaaccggttcgggtacgggggttccgaaccgggtaacccggtaacccggggtacccccggttaaggggaaaaccggtaaccgggggtttccgtttaagggggtaacggggttaggggtaaacgggttaacgggggaccgggttaaacggttaccccgggttaagggggtttacggggtttaagggttcggggggtccgggtaccgttaaccggtaacgttaacccgggtaccggtaaccggtaaaccggtaaacgggtttaaccgggttttacgggaacccgggggtaccccggttaccgggtaaacccgtaccggttaaccgggtacccggggtaaaccggttaaacccgggggtccccgttaaaccggtaaccccgtaaaacggtaaaacgtttacccggtaaggttttaacggtaaacggtttaggtaccggtttaaacgttcgggaacgttaccggaacggttccgtttaagggaacggttccgtacgggaaccgaaccgggtacggtaaccttaagggttacgttagtttcggttcgggacggtcggtaacggggaaccggtagggggaaacccgttaaacgggtaacggtaccgtttaaaaggttcccgggttaccgggttcccggtaaaccccggggg

SEQ ID NO: 225722 - DNA, 701 bp, Homo sapiens
  misc_feature: GYAE6OF01AOHOY.19.86.H09.1.454.CMB.1.raw
  modified_base (117)..(117): a, c, t, g, unknown or other
  misc_feature (117)..(117): n is a, c, g, or t
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
  modified_base (677)..(677): a, c, t, g, unknown or other
  misc_feature (677)..(677): n is a, c, g, or t
  modified_base (683)..(683): a, c, t, g, unknown or other
  misc_feature (683)..(683): n is a, c, g, or t
  modified_base (693)..(693): a, c, t, g, unknown or other
  misc_feature (693)..(693): n is a, c, g, or t
  modified_base (695)..(696): a, c, t, g, unknown or other
  misc_feature (695)..(696): n is a, c, g, or t
  modified_base (698)..(698): a, c, t, g, unknown or other
  misc_feature (698)..(698): n is a, c, g, or t
  modified_base (700)..(700): a, c, t, g, unknown or other
  misc_feature (700)..(700): n is a, c, g, or t
tcagtactctcgtgcacgaccggtgctcgatttagtgctatagacttgggtttgggggccgttcctgggcccagtctgtgctgactcaggcaccctcagcgtctgggacccccgggnagacggtcaccatcgcttgttctgcaagcagctcgaacatcgggagcagtggtgtgatgtggtatcagaaagtcccaggaaccggccccaaatcgtcatctataatgacntgagcggtcttaaggtccctgaccgtattcnctggcgagaggtctggcgcctcagtcttcccgtggccatccaggaggtcctccagtctagaacgatggaggtctagatttacttacgtgtgtacaagttcgtagggactgacgtagtggttacggtaacgggtttccgggttttacgggaccgggacgggtaacccgaacggtaccgtacggttacccggttaccgtaacggtttaccgaacggaaccccgaacgggtaccccgttcccggtacccccccgtttccgggtaccctaaccctttccgttaccccgtttacccccttacccccgttccccgttaccccgtaacggtaccgggtaaccggtttacccgtacgggtacgggtacccgggggtcgtccgggttaacccggtaacgggtacccgtacgtaaacgttaccgggacncgtcgnagacgcacgngnngngng

SEQ ID NO: 225723 - DNA, 760 bp, Homo sapiens
  misc_feature: GYAE6OF01DPB57.19.86.H09.1.454.CMB.1.raw
tcagtactctcgtgcacgaccggtgctcgatttagtgctatagacttgggtttggggaggcatcacccagcaaccacatctgtcctctagagaatccccctgagagctccgttcctcaccatggactggacctggaggatcctcctcgttggtggcagcagccaccggagcccactcccaggtgcagcgtggtgcaggtcgtggggctggaggtgaagggacgccgtggggcctcgagtggaacggtctccgtgcgtaggtcgttttggattacgtccttcagtactattatcaattatacctcgtggggtcgaccgacgaccgggtccccgtaggaccgaaggggtcttggaggtggagtacggggccgtacgtccgacggggttggtaggtgggtcgggcgtacgaacgttaccggtcgaccgacgtaacggttaaggtttccgacggggtccccgtccgtaccaccgtacggtccgggaccgtaacgggtccggtaccggtacccaaacgggtaacttacggtaagttacggttaacttaggttacggtaactttcggaaggtcgtaacgtcccggttaggtacggggtacgtacgggtaaccgtaccggacggaccgttagttacgttagtttaggtttcggtacgggacggtaccggggtcgaaaccggggggtaccggggtaaacggtaaaacgggttaaccgtaaaagggttttaacgggtccggggtttaccccggtaaaccccccgggggg

SEQ ID NO: 225724 - DNA, 700 bp, Homo sapiens
  misc_feature: GYAE6OF01ESWXO.19.86.H09.1.454.CMB.1.raw
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (683)..(683): a, c, t, g, unknown or other
  misc_feature (683)..(683): n is a, c, g, or t
  modified_base (687)..(688): a, c, t, g, unknown or other
  misc_feature (687)..(688): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (695)..(695): a, c, t, g, unknown or other
  misc_feature (695)..(695): n is a, c, g, or t
  modified_base (697)..(697): a, c, t, g, unknown or other
  misc_feature (697)..(697): n is a, c, g, or t
  modified_base (699)..(700): a, c, t, g, unknown or other
  misc_feature (699)..(700): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtccaggaaccggcccccaaactcgtcatctataatgacgntggacgtccggtaccgttaacgggtccccnggaccgtacttccgttcgtcggacgaggtacggtctgggccnccttacgacgtccttccccgtggacctagtcgaggcgggtctcccaggttccgtagaagntaggcggtctagtaatttactacgttcgtagtacctaagtcggtagggtactaggacgtaggtgtaccgggttaccgggtttccgggtttacgggaccgggaacgggtaccgaacggtcgtaccggtaacccgtacgttaacggtccaaccggtacccggtaacggtcccgtacccgggttcccccgttacggttaaccctccgtttcccggttacccgtttaccccccacccccgtttacccgaacccggtaacggtacggttaaccggttcgttaccgggacggtccgggtcgtacggaccggacgccgacgagtcggangcgnncgnanancngnn

SEQ ID NO: 225725 - DNA, 849 bp, Homo sapiens
  misc_feature: GYAE6OF01DRUAS.19.86.H09.1.454.CMB.1.raw
tcagtactctcgtgcacgaccggtgctcgatttagtgctatagacttgggtttggggagcatcacccagcaaccacatctgtcctctagagaatcccctgagagcctccgttcctcaccagtggactggaccgtggaggtactccctcctcgttgggtggcaacgcacggcccgaccgggacgccccacctcccgagggtcgcgagcgtgggtcgcgtaggtcggtggggtctagggagggtaggaacgggcggccgggtcggggtcctagtacgggtaggtaacggttccgtccggtcgggtacggtacgggtttcgttttaggtaaccttaccgtaccgttacgtagttacttaattacgtactaagttacgttccgtcggtgggtacgaccggaccgtacccggtccgtagggaaccggtaaggtccgtaggtaggtagggtacgggtacgggcggtaccgtacgggtacgggttggtagggtcggggtagcgtacgtacgtaccggtcggaacgtacggtacggttaacggttcgggaccgggccgtaccgtcggaaccgttacgggtaccggaaccgggttaccggaccggtaccggtaaccgtaaggtaaacgtacggttagtaggttaaacgtggtaccggttaacgtagggaaccgtcgtaacgggttacggtacgggtaccggttaacgacccggtaacgtacccgggtacgtaacccgttaggttagttaccggtagtcggggtaaccggcggggaaggtacccgggaagggggtaacgaaccggtaaacgggcgttaaaagggtttccggggtacccgtcccggggggtaacccgggg

SEQ ID NO: 225726 - DNA, 729 bp, Homo sapiens
  misc_feature: GYAE6OF01BNAZ4.19.86.H09.1.454.CMB.1.raw
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatctcctcttggtggcagcagccaccggagtcccactcccgaggtgcagctggtgcagtcgtgggctgaggtggaagngccgtgggcctgacgtgacgtctcgngcgaggtcgtttagactacctaccttacgagttctatttatcctattactacttggtcggtggtaccgacggaccggtccgtaggaccgtagggtcttaggagtagggagtacgggcggtacgacggtagggtcggtaggtcggtcggcgacgtacgtaccggcgactacgaaggtaacggtttccgacgggtccacgggtaccacgaggtaccggaccgtaacggccgtaccgaccgtaacgtaactacggagtttaccgtaagttccgtaggttacgttacggagtaccgttaccggacgtttacggacgggtttaccgacggtaaccggaccggtaaccgtaccgttaggttaacgtttaccggttttaagtccgggttaacgacgggttacggggaccggaacggggggtaacgggtaaccggttaaacgggaccgtttaaacgggttaaggggttcccggttaccccgggtaaaccccgggggg

SEQ ID NO: 225727 - DNA, 842 bp, Homo sapiens
  misc_feature: GYAE6OF01DNIR3.19.86.H09.1.454.CMB.1.raw
tcagtactctcgtgcacgaccggtgctcgattagtgctatagacttgggtttggggggaagaggaagactgacggtcccactcccaggtgcagctggtgcagtctggggctgaggtgaaggagctggggcctcagtgaaggtctcctgcgaggtcttttggatacaccttcagtcattatcatatactcgtgggtgcgacacggcccctgggaaccaagggcttggagtggagtagggcgactccgacgggtggtaggtggtggccgcgtatacggtcgacacgaaggtaagttcgacgggccgcgtcaccgagtcggaccgaaggtccgccgtaccacgtaatacgagtagtatagtcgtaactggactcgacggcctaggacggttctacggaaccgtaccggaccggcctaagttaggttaagttttacgtttacgggtggaaccgggtacggacgggtaacggggggtaccggggtaaccgtaaaaggggacttaaaacgggttaaaacgggtttcccggggtttacccggaacccccggggttacgggggtaccccggtaaacggggtaaccccgttggggtcccccgttaaccccggttccctttaccccgtccgaacccggttcccccaacccggtaaccccggaccggggttaacccctacccgggtttcccggttaccccccgttaccccccggttccggggccccgtacccccgtttcgggaccccgttaacccgggcgggtaacccgtacccctaacccccgggtacccggaacgggaccgtacccggaacggtaccccggggcccggtacccccgggttgggtaccccgg

SEQ ID NO: 225728 - DNA, 847 bp, Homo sapiens
  misc_feature: GYAE6OF01DU30R.19.86.H09.1.454.CMB.1.raw
  modified_base (299)..(299): a, c, t, g, unknown or other
  misc_feature (299)..(299): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggactcctcctcttggtggcagcagcccaccggagccccactcccgaggtcgcgagcgtggtcgcgagtcggtggggcgtggagggtggaagggacggccggtcggggcctcgaggtaggaacggtctccgtggcggtaggttcgttttaggactacctaccttnagttactattatactattactacgttcggtggggtcgaccggacgtaccgggtacccccgtagggaaccggtaacggggtcgtttagggacgggttagggaacggttacgggggaccggtaacgtccgggtaacgggggttagggttaggggtcgggtaccggacgtacgttaacggtaccgggtaccgaacggtacggtaaaggttaacggtttaccggaaccgggggtcccgtacggtaccaaccggtacggtaccgggaaccggtaaaccggggtcccggaaccggttaccgaaacgggtaaactacggtaaggttacgttaagttacggtacggtaccgtttaggacggtctacggccggtaggtacgggttacgacggaacgtacccggacggtaccttaagttgtttaaacgtttaggttcgggtacggacgggtaaggggtaccgggtaaacgggggtaaccggggtaaaccgtaaaacgggtaccgttaaaaggggtttaaccgggttcccggggttaaccccgggtaaacccccggggg

SEQ ID NO: 225729 - DNA, 888 bp, Homo sapiens
  misc_feature: GYAE6OF01CKEDM.19.86.H09.1.454.CMB.1.raw
  modified_base (173)..(173): a, c, t, g, unknown or other
  misc_feature (173)..(173): n is a, c, g, or t
  modified_base (884)..(884): a, c, t, g, unknown or other
  misc_feature (884)..(884): n is a, c, g, or t
  modified_base (886)..(886): a, c, t, g, unknown or other
  misc_feature (886)..(886): n is a, c, g, or t
  modified_base (888)..(888): a, c, t, g, unknown or other
  misc_feature (888)..(888): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgngatgtgtatcagaaacgtccgaggaaccgacccccaaatcgtacatctaataactgacgctgacgtccggttaccttaacgggtccctaggaccgtatttccgtacgtcgggacgaggtacgggttcctcgggccgtcccttacgacggttccctttccccggtagggcccctaacgttccggaaagggtaccggggtacccttacccgtaacggttaccgttaagggaaaacgtagttagggaacgggtaccgtttaggttaaacgttttaaacgttttaccgttaggtttacgaaccgttaaaggttttcccgggtaaggggttagtttaacggaaaccgttaagggtttacggtttaaacggggtttaaacccggggtttttcccggggttttacggggaaccggggttaaaccggggaaccgtaacgggttacccgttaaccgggtaaccccggtttaaccgttaaaacgggtacccgtaaacccggtacccgtaaaccgggtccgttaccccgggtccccccgtttaccggttaccctaacccgtttccctttccccggtttacccccccgtaaccccttcccgtaaccccgtaacgggtaccggtaaccggtttaaccggacgggttaaccgggcccgggtacgggttacggaaccggtaaccgggcctaacggtaacgtacgacagcgacgtcgagcgacagcngngn

SEQ ID NO: 225730 - DNA, 605 bp, Homo sapiens
  misc_feature: GYAE6OF01A6OAM.19.86.H09.1.454.CMB.1.raw
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacacggcccctggacgaagggcttgagtggagtagggcgatccgacgggtggtaggtggtggcgcagtacgtcgcacgagagtttcgagggccgcgtacaccgatcggccaaggtccgcgtccacgaatacagtgtatagtggacttgacgcagtcctagaggtctagacgacgacggcctagtgttatttagtggtgcggaggcgagggacgggagtaaggcaagtaagtcggtcgacccgtgggccgaacgggtacccgtggtccaccgtctcctcgacgccctaccaccgacggccctacgtcccggtacccttccccgcggcccgccgtccgccgtacccgacggacgacccgacccgtaccgacggacgaccgacgaccgggcccggtcccggtcgggtcccg

SEQ ID NO: 225731 - DNA, 509 bp, Homo sapiens
  misc_feature: GYAE6OF01A0PCY.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggactttgagcagcctgagtctgacgacacggcatgtattattgtgcgaggcagggacgggctaaacggcaataaaggtggttcgaccccgg

SEQ ID NO: 225732 - DNA, 816 bp, Homo sapiens
  misc_feature: GYAE6OF01ADA2J.19.86.H09.1.454.CMB.1.raw
  modified_base (128)..(128): a, c, t, g, unknown or other
  misc_feature (128)..(128): n is a, c, g, or t
  modified_base (362)..(362): a, c, t, g, unknown or other
  misc_feature (362)..(362): n is a, c, g, or t
  modified_base (388)..(388): a, c, t, g, unknown or other
  misc_feature (388)..(388): n is a, c, g, or t
tcagtactctcgtgcacgaccggtgctcgattagtgctatagactttggggtttgggggggaagaggaagactgaccggtcccactcccaggtgcagctggtgcagtcgtggggctggaggtgaaggngccgtcgggcctcagtgagtctccgtgcggaggtctttggactacctaccttcagtctattatcattatcgttcggtgggtcgaccgaccgaccggtccccgtaggaacggtaacgggtcgtttaggaggtagggaggtacgggcgtaccgtcgggacgggttgggtaggtgggcggtccgactacgtaccgtcgacctaagacgttacggttccgacggccgtactaccacgngtacggaccgtacggtccgcgaccanacgtacgtagttagacgtagtcggactagacgcgtacgtcgtaggtacgtcgtacgaccggaccgacggccttagttagttatttacggtgacggtcggaccgggtaacgggaccggggtaaggtaaccgtaaacggggtaagtaaacggtttaacggggttccgttacccccggggaccggttacggggacccccgtaacgggttacccggttcccggtaccgttccccgtaccgtcccgtaacccgtacccgacccgtaacccggtaaccggtccccgggtacctacccgggttcccgtttacccccggtcccgcccggttccccgcccgtccgggtacccgtaccggccggtacctaccccggacccgaccggaccggtaccaacccgggtccgacccggggttcccggcgggtcccggtcccgg

SEQ ID NO: 225733 - DNA, 639 bp, Homo sapiens
  misc_feature: GYAE6OF01EUFR9.19.86.H09.1.454.CMB.1.raw
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccacctcccaggtgcagctggtgcagtcgtggggctggagggtgaaggacgccgtggggcctacgaggtaggaaggtcctccgtggcggaggtcttttaggactacctaccttcagtctattatcattatactcgtgggtgcgacgacggtcccgtggacgaggtcttggagtggagtagggcgacgtccggacggtggtaggtgggtggcgcagtccgtcgacacgtagtacgttcgacgggccgcgtcacctacgcggaccgtaacgggtccgtaccgtaccgaacgtaactacgtaagttcgttaatacggttagggtactttcggaagccgtaggtccgtaggacgggttcacggtaaccgacgtaccggtactagttacgttactttaggtggtcggacggacgggcggacggggtacgggaacgtaaggtacgaaagtacgggttcggtacccggtaccccggg

SEQ ID NO: 225734 - DNA, 474 bp, Homo sapiens
  misc_feature: GYAE6OF01DDBPK.19.86.H09.1.454.CMB.1.raw
  modified_base (452)..(452): a, c, t, g, unknown or other
  misc_feature (452)..(452): n is a, c, g, or t
  modified_base (458)..(474): a, c, t, g, unknown or other
  misc_feature (458)..(474): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggactaaaggcataaagtggttcgacccgtggggccagggaaccctggtacaccgtctcctcagcctccaccgaaggcccatcggtccttccccctggccgccctgcctccgaggacgccaccgtccgagacgccacgacgccggcccgtgggctcggcccgtggtacgaaaggtaccctaccttacccgaacgagtacgtacgtggaacggcgggcctagggcaaagggcncatagnnnnnnnnnnnnnnnnn

SEQ ID NO: 225735 - DNA, 701 bp, Homo sapiens
  misc_feature: GYAE6OF01C8QOM.19.86.H09.1.454.CMB.1.raw
  modified_base (272)..(272): a, c, t, g, unknown or other
  misc_feature (272)..(272): n is a, c, g, or t
  modified_base (681)..(681): a, c, t, g, unknown or other
  misc_feature (681)..(681): n is a, c, g, or t
  modified_base (685)..(686): a, c, t, g, unknown or other
  misc_feature (685)..(686): n is a, c, g, or t
  modified_base (691)..(691): a, c, t, g, unknown or other
  misc_feature (691)..(691): n is a, c, g, or t
  modified_base (696)..(698): a, c, t, g, unknown or other
  misc_feature (696)..(698): n is a, c, g, or t
  modified_base (700)..(701): a, c, t, g, unknown or other
  misc_feature (700)..(701): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacgtcaccatcgcttgtctgcaagcagctcgaacatcgggagcagtggtgtgatgtggtatcaagaaacgtcccgaaggaacccggacccccaaatcgtcatctaataatgacgctgagccggtaccttaacggtccctagaccgattccgngtcggcgagtacggtcgtcggcgcctcgacgtccttccgtcggccacgtacgacggacggccgtccgtacgtcgtacggtaagagtgaggtactaggggggtaatttacgttacgtagtcgtacgtaacgttacggtacgggtagtacgtacgtaggttacggtacgggttaaccgggtttccgggttttcgggacggggtaacgggtaccgaacggtacgtaccggtacccgttaccgtaacgtaccgtacgacccgtaacggtcccgtcccgtaccccgttacccggtaccgtacccgttcccgttacccgttcccccgtaccccttcccgtacccgtaccggtacgtaaccgtacgtacggaccggtaccggcggtcggaccgacggaccgtacgtacgagtacgngtcnncgtancgacnnngnn

SEQ ID NO: 225736 - DNA, 858 bp, Homo sapiens
  misc_feature: GYAE6OF01B0T4N.19.86.H09.1.454.CMB.1.raw
  modified_base (185)..(185): a, c, t, g, unknown or other
  misc_feature (185)..(185): n is a, c, g, or t
tcagtactctcgtgcacgaccggtgctcgatttagtgctatagacttggggtttgggggagagcatcacccagcaaccacatctgtcctctagagaactcccctgagagctcccgttcctcaccagtggactggaccgtgggaggactccctccttcgttgggtggcagcacgcccgaccggacnccccacctcccgaggtcgcgacgtcgtgggtgcgtaggtcggtgggggctagggagggtaggaacgggacggtccgggtcggggtaccctagtaggtacggtaacggttcctccgtggacggtacggtttcgttttaggacttaccgtaccttcgtacgttactaatttacactaattactaccgttcggtgggggtacgaccggtaccggacccggtccccggtagggaaccggtacggggtacgttagggaagggtagggtaacggtaccgggggtacggttaccggtaccgggtagggttggggttacggggttcggggtaccggacgtaccgtaacgttacccggtccgacgtaaacggtaaggttaaccggtttccggggaccgggtcccgtaccggtacccgaaccgggtacgacccggggtaacccggtaccggggtacccgtaccggttaaccgaaaccgttaacggaaccgtttagggtacgtttaagtcggttaaggtccgttagacggcgtacgtccggtaggtaccgtacggacggaccgacgccggtatagttacggttacgtttggtcggtacgggacggtcgggacggggtaaccgggggtaacgtaaacgggtaagtaccggtaaagggttacccgggttcccgggtaaccccgggg

SEQ ID NO: 225737 - DNA, 806 bp, Homo sapiens
  misc_feature: GYAE6OF01CO3LC.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagcccaccggacgccccactcccgaggtgcagcgtggtgcaggtcgtgggggctggaggtggaaggcggccgtgggggccctcgaggtggaacgggttctccgtggcggtaggttcttttaggacttaccgtaccttcagttctattatactattacttacgtcggttgggtcgaccgaccgtaccggtccccgtagggaaccggtaagggtcgttagggaagggttagggaagtacgggggtaccgggtaacgttcccggtaacggggttggggtagggttcggggtacggaccgtagtaccgttaccggtacgaccgtaacgtaaggttaacggtttccggacggggacccgtaccgtccaaccgtacggtccggaacccggtaacggtcccgtaccggtacccgaaacggtaacttacggaaggttagttaacgtaggttacgggtacttagggacgtccgacggtccgtagggtacggtacctaccgggaacgtacccggaccggttcctaaggtttacgttagtttaacggttcgggtacggaccgggtaaggggacccggtaaaggggggtaacccgggtaaacggttaaacgggacgttaaaacgggttaaaccggggttccccgggttaaaccccgggg

SEQ ID NO: 225738 - DNA, 682 bp, Homo sapiens
  misc_feature: GYAE6OF01CETWW.19.86.H09.1.454.CMB.1.raw
  modified_base (256)..(256): a, c, t, g, unknown or other
  misc_feature (256)..(256): n is a, c, g, or t
  modified_base (660)..(660): a, c, t, g, unknown or other
  misc_feature (660)..(660): n is a, c, g, or t
  modified_base (669)..(669): a, c, t, g, unknown or other
  misc_feature (669)..(669): n is a, c, g, or t
  modified_base (675)..(678): a, c, t, g, unknown or other
  misc_feature (675)..(678): n is a, c, g, or t
  modified_base (680)..(680): a, c, t, g, unknown or other
  misc_feature (680)..(680): n is a, c, g, or t
  modified_base (682)..(682): a, c, t, g, unknown or other
  misc_feature (682)..(682): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacgtcaccatcgcttgtctgcaagcagctcgaacagtcgggagcagtggtgtgatgtggtatcagaaagtcccaggaaccggccccaaatcgcatctataatgacgctgagccggtccttaagggtccctgaccgtnttcgtctggacgagaggtctggcgcctcacgccttcccgtggccatcgaggacgggtcctaccgaggtctaggaagagtagaggtctagtaatttattacgtgtgactaagttcgtagggatgaactaggtagtcgggtaaccgggtttccgggttttcggggacgggtaacgggtaccgaacggtccgtcggtaacccggtaccttaaccgggtactaaccggacccgtaaacgggtcccgtcccgggtacccccccgtcgggttaccccttaccgttcccgtttacccccggtttccccccgtaccccccttacccgtaccccgacggtaaccggtacgttacgtacggaccgggtcgggtaccggtacgggaaccggtacgggcccgagtaacggtacgancgtagcgtncgtcgnnnngngn

SEQ ID NO: 225739 - DNA, 721 bp, Homo sapiens
  misc_feature: GYAE6OF01BYP6N.19.86.H09.1.454.CMB.1.raw
  modified_base (166)..(166): a, c, t, g, unknown or other
  misc_feature (166)..(166): n is a, c, g, or t
  modified_base (232)..(232): a, c, t, g, unknown or other
  misc_feature (232)..(232): n is a, c, g, or t
  modified_base (716)..(716): a, c, t, g, unknown or other
  misc_feature (716)..(716): n is a, c, g, or t
  modified_base (718)..(718): a, c, t, g, unknown or other
  misc_feature (718)..(718): n is a, c, g, or t
tcagtactctcgtgcacgaccggtgctcgatttagtgctatagacttgggtttgggggccgttcctgggcccagtctgtgctgactcaggcaccctcagcgtcgtcgggacccccgggcagacggtcaccatcgcttgttctgcaagcagctcgaacagtcgggancagtggtgtgatgtggtatcgaagaaacgtcccaaggaaccgccccaaatcgcatctataatgacngtgacgtcgtacgttaacggtcctgaccgtattcctcgtggcggaggtacggtcgtcgggccgcctcacgtccttcccgtcggacctactcgaggacgggtcctaccgaggtcgtaggaagtagtaggtacggtcttaggtaactttacttacgtgtacgtacgtaagttcgggtaggtactacggagtaggtaggtacggtaacccgggtttcggtttcgggacggtaacggaacgtacggtcgtaccgtaaccgtacgtaacgtaccgaccggaacccgtaacggcccgttaccccgtccccgttaccggtaccttcccgttcccgttccccggtttaccccctccccgttacccgtaaccggtaaccggtaccggtaaaccggttccggtacgggccgggtaccggggtaccgttacgggaacccgggtaacggtacccgaacgttaacggccgagacgcggtccgcgacgtcgacgatcngngcg

SEQ ID NO: 225740 - DNA, 527 bp, Homo sapiens
  misc_feature: GYAE6OF01BYO9B.19.86.H09.1.454.CMB.1.raw
  modified_base (273)..(273): a, c, t, g, unknown or other
  misc_feature (273)..(273): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
tcagtactctcgtgcacgaccggtgctcgatttagtgctatagacttgggccttgagtggatagggcggatccacggtggtagtggtggcgcatacgtcgcacagaagtttcacggccgcgtcaccatggccaaggtcgcgtccacgaatacagtgtatatggacttgagcagcctgaggtctgacgacacggccatgtattattgtgcgaggcgaggacgggctaaaggcaataaagtggttcgacccgtggggccaggacctggcacgtcnctcagcctccacacgggccagtccggtcctcccgtggcctcctgcctccgagcgcacctcgagacgcacgagccgccgtgggctcggccgtggacaacggcctacctccgagacgacgtacgacggacggcggcgtaggacgaagggtcgacgaagttacggnactancgtancgngcgagngtcncganacgacgtacgcagacgcgngtgtacgngtcgtgtcgngacgtcgcncncgtcncagcncgcgcg

SEQ ID NO: 225741 - DNA, 686 bp, Homo sapiens
  misc_feature: GYAE6OF01CY9UW.19.86.H09.1.454.CMB.1.raw
  modified_base (98)..(98): a, c, t, g, unknown or other
  misc_feature (98)..(98): n is a, c, g, or t
  modified_base (119)..(119): a, c, t, g, unknown or other
  misc_feature (119)..(119): n is a, c, g, or t
  modified_base (165)..(165): a, c, t, g, unknown or other
  misc_feature (165)..(165): n is a, c, g, or t
  modified_base (349)..(349): a, c, t, g, unknown or other
  misc_feature (349)..(349): n is a, c, g, or t
  modified_base (669)..(669): a, c, t, g, unknown or other
  misc_feature (669)..(669): n is a, c, g, or t
  modified_base (674)..(674): a, c, t, g, unknown or other
  misc_feature (674)..(674): n is a, c, g, or t
  modified_base (677)..(682): a, c, t, g, unknown or other
  misc_feature (677)..(682): n is a, c, g, or t
  modified_base (684)..(686): a, c, t, g, unknown or other
  misc_feature (684)..(686): n is a, c, g, or t
tcagtactctcgtgcacgaccggtgctcgatttagtgctatagactttgggtttgggggccgttcctgggcccagtctgtgctgactcaggcaccctnagcgtctcgggacccccgggnagacgtcaccatcgcttgttctgcaagcagctcgaacagtcgggancagtggtgtgatggtggtatcgaagaaacgtcccgaaggaacccgacccccaaatcgtacattactaataagtcgacgtcgtagacggtccggttaccgtttaaacgggtccctagaccgtatttccgtacgttgggacgaaggtacggttcgtcgggcccgtacctcgacgtccctttcccgnggacccagtccgacggtacgggtcctaccgtagtcgtagaaagtgtaggaggtctaggttaatttattacgttgtacgaccgtaagttcggagggtataggaccgtaggtttcggaacgggtttaaccgggtttccggggtttacgggaaccgggtaacgggtaccgaacgtccgtacgtacccgttacgtaacgtcgacgaccgtacgcccgtcccgacccgtcggtccctacgttccgtccgtaccccgtcccgttccgaccgtacgacgtacgtcgaggacggcggtcgacggtacggacggtcgaccgtaagtcgntacgngcnnnnnncnnn

SEQ ID NO: 225742 - DNA, 717 bp, Homo sapiens
  misc_feature: GYAE6OF01AH3B5.19.86.H09.1.454.CMB.1.raw
  modified_base (167)..(167): a, c, t, g, unknown or other
  misc_feature (167)..(167): n is a, c, g, or t
  modified_base (705)..(705): a, c, t, g, unknown or other
  misc_feature (705)..(705): n is a, c, g, or t
  modified_base (707)..(707): a, c, t, g, unknown or other
  misc_feature (707)..(707): n is a, c, g, or t
  modified_base (709)..(717): a, c, t, g, unknown or other
  misc_feature (709)..(717): n is a, c, g, or t
tcagtactctcgtgcacgaccggtgctcgatttagtgctatagactttggggtttgggggccgttcctgggcccagtctgtgctgactccaggcaccctcagcgtctcgggaccccgggcagacggtcaccatcgcttgttctgcaagcagctcgaacagtcgggancagtggtgtgatgtggtatccaagaaacgtcccaggaacccggcccccaaatcgtcatctagtaatgacgctgacgtcggtccgttaacgggtccctgaccgtattcctcgtggcgaggtacggtcgtggcgtcccttcgacgtccttcccgtcggctactcgaggacggtcctccaggttcgtagaagtagtggaacggtcgttagtaacttttattacgttcggtacgtacctaaagttcgggttagggacttacggtaaccgttaggtttacggggtaccgggtttaaacccggggttttcccggggttttacgggggaccgggtaacgggtaacccgtaacggtccgtaccggtacccgttaccgtaacgtccgacggtaccccggaggtcccgtaccccggtccccgttaacggcccctacgtttcccgtccccggttacccccaccccgttaccgttaccgaaacgggtacgtaaccggttcggtaacgggacggtccgggtcgaacggccggaaggccgttaccaagtgcntnannnnnnnnn

SEQ ID NO: 225743 - DNA, 680 bp, Homo sapiens
  misc_feature: GYAE6OF01CI4R9.19.86.H09.1.454.CMB.1.raw
  modified_base (237)..(237): a, c, t, g, unknown or other
  misc_feature (237)..(237): n is a, c, g, or t
  modified_base (277)..(277): a, c, t, g, unknown or other
  misc_feature (277)..(277): n is a, c, g, or t
  modified_base (424)..(424): a, c, t, g, unknown or other
  misc_feature (424)..(424): n is a, c, g, or t
  modified_base (625)..(625): a, c, t, g, unknown or other
  misc_feature (625)..(625): n is a, c, g, or t
  modified_base (657)..(657): a, c, t, g, unknown or other
  misc_feature (657)..(657): n is a, c, g, or t
  modified_base (667)..(667): a, c, t, g, unknown or other
  misc_feature (667)..(667): n is a, c, g, or t
  modified_base (676)..(676): a, c, t, g, unknown or other
  misc_feature (676)..(676): n is a, c, g, or t
tcagtactctcgtgcacgaccggtgctcgatttagtgctatagactttgggtttgggggccgttcctgggcccagtctgtgctgactcaggcaccctcagcgtctcgggacccccggcagacgtcaccatcgcttgtctgcaacgcagctcgaacagtcgggagcgagtggtgtgatggtgtatcgaagaaacgtcccaacggaccgaccccaaactcgtcatctataacgtcgacncgtgacggtccggttccgttaacgggtccctaggaccgtnttcctcgtcggcgagtacggtcgtcggcgccgtcgacgtccttcccgtggccactcgaaggacggtccttaccgagttcgtaggtaacgtaggtggacggtgtagtaatttaagttaccgtgttacgtataacgttcggtacgggtntaacggacgtggttacgggttacgggtaaccgggtttcgggtttacgggacgggtacggtaccgacgtccgtacgtaccgttacacgtaccgacgaccgacgtccgtcccgtccccgtcgtacccgtaccttcccttacccgtcccctaaccgtcccgtcccgtaacgtaccggtaccgtcggacggccggtccgggtacncgggacgaccggtcacggtaccgtgtcgatcncgatgcgtcnccggagtcnggtc

SEQ ID NO: 225744 - DNA, 513 bp, Homo sapiens
  misc_feature: GYAE6OF01AUITD.19.86.H09.1.454.CMB.1.raw
  modified_base (334)..(334): a, c, t, g, unknown or other
  misc_feature (334)..(334): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
  modified_base (484)..(485): a, c, t, g, unknown or other
  misc_feature (484)..(485): n is a, c, g, or t
  modified_base (487)..(513): a, c, t, g, unknown or other
  misc_feature (487)..(513): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgcacggccatgtattattgtgcgaggcaggacggggctaaaaggcaataaagtgggttccaccccgtgggggacctagggaaccctggtccaccgtctcctcgacgccctccaccaacgggcccctaattcccgggtcctttcccccgngggcccgcccttaggcctcccgaggtacnccgaccctcgagacgcaacgnggccgtcccctggggacctgccgtggtcgaaaggtacctaccgttccccaaggacgtagtaccgtgacggcgggtctgggaccaagggctactaagacgnntnnnnnnnnnnnnnnnnnnnnnnnnnnn

SEQ ID NO: 225745 - DNA, 507 bp, Homo sapiens
  misc_feature: GYAE6OF01A9EL3.19.86.H09.1.454.CMB.1.raw
  modified_base (484)..(507): a, c, t, g, unknown or other
  misc_feature (484)..(507): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgccgtccacgaatacagtgtatatggacttgagcagcctgaggtctgacgacacggccatgtattatgtgcgagcaggacggggctaaaggcataaaagtggttcgacccctggggccacgggaaccctggtcaccgtctcctcacgccctccaccgaacgggcccccagtcccgggtccttcccccgtcggcccgtcccctgcctcccgacgggacgcccgaccctcccggaaggacgccaacgacggccggcccctcggggctcggccctggtccaaacggacgttaccttccccgaagacgtacgtacgtgacggcgggactgggacgaacggccgacaatgcnnnnnnnnnnnnnnnnnnnnnnnn

SEQ ID NO: 225746 - DNA, 821 bp, Homo sapiens
  misc_feature: GYAE6OF01AWD0F.19.86.H09.1.454.CMB.1.raw
  modified_base (163)..(163): a, c, t, g, unknown or other
  misc_feature (163)..(163): n is a, c, g, or t
  modified_base (804)..(804): a, c, t, g, unknown or other
  misc_feature (804)..(804): n is a, c, g, or t
  modified_base (808)..(808): a, c, t, g, unknown or other
  misc_feature (808)..(808): n is a, c, g, or t
  modified_base (815)..(821): a, c, t, g, unknown or other
  misc_feature (815)..(821): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaccggcccccaaatcgtcatctataatgacgctggagccggttccgttaagggtccctgaccgtattcctcgtgggaccgaggacggttccgtcgggccgtcccttaccacggtccctttccccgtcgggtaccccacgttccgaagggtaccggggtcctacccgtaacggttcgttaggaaacggtacgttgggaacgggttccgtttaaggttaattttaaccttttaacgttcggttacgtaacctaaaacgtttccggttaaggggtaacttacggtaaccggtagggtttacgggttaaccgggttaaacccgggggtttttccccggggtttttaccgggacgggggtaacgggtaacccgtaaacggtccggttaaccgggttaaccccggttaccgttaaacggtacccgtaaccggaacccccggtaaacgggttccccgttaccccggtacccccccggtttacgggttaaccctcccgtttcccgtttccccggttcccccccgtccccttaacccgtcccgaaacggtacggtaaccggttaccgtacgggtaccggccgggtactacgggaccggtacggccgacgtagacggnacgnactgctnnnnnnn

SEQ ID NO: 225747 - DNA, 669 bp, Homo sapiens
  misc_feature: GYAE6OF01DPVCK.19.86.H09.1.454.CMB.1.raw
  modified_base (119)..(119): a, c, t, g, unknown or other
  misc_feature (119)..(119): n is a, c, g, or t
  modified_base (270)..(270): a, c, t, g, unknown or other
  misc_feature (270)..(270): n is a, c, g, or t
  modified_base (356)..(356): a, c, t, g, unknown or other
  misc_feature (356)..(356): n is a, c, g, or t
  modified_base (653)..(655): a, c, t, g, unknown or other
  misc_feature (653)..(655): n is a, c, g, or t
  modified_base (657)..(659): a, c, t, g, unknown or other
  misc_feature (657)..(659): n is a, c, g, or t
  modified_base (661)..(665): a, c, t, g, unknown or other
  misc_feature (661)..(665): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
tcagtactctcgtgcacgaccggtgctcgatttagtgctatagacttgggtttgggggccgttcctgggcccagtctgtgctgactcaggcaccctcagcgtcgtcgggacccccgggnagacggtcaccatcgcttgttctgcaagcagctcgaacatcgggagcagtggtgtgatgtggtatcaagaaagtccaggaaccgccccaaatcgcatctataatcgacgcgtgacgtcggtaccgttaacgggtccctagaccgtatttcncgtggcgtaaggcgtcgtcggcgtccgtcacgtccttccgtcggcctagtcgaggacgggctccgagtcgtagaagatggaggtcnggtatttattacgtgtcgtataacgttcgtaggtagtaggtacgtaggttcggtacgggtttaaaccggggttccggggttttacggggacggggtaacgggtaaccggtaacggtcgtaccggtaaccgtacgttaaacgtcgaacgacccggtaacggtcccgtacccgtccccgttaccggtctccgttccgttcccgttacccccgtaccctcccgtaacccgtacgggtaacgtaaccgtccgtacgggtacgggccgggtacggtcggaaccgaaggtccgactacggtannngnnngnnnnngngn

SEQ ID NO: 225748 - DNA, 679 bp, Homo sapiens
  misc_feature: GYAE6OF01A5R7Z.19.86.H09.1.454.CMB.1.raw
  modified_base (323)..(323): a, c, t, g, unknown or other
  misc_feature (323)..(323): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaacgtcccaggaaccggcccccaaactcgtcatctataatgacgctgagcggtccttaagggtccctgaccgattctctggcgagaggtctggcgcctcagcttccgtggccatcgagagggctccagtctgaacgntgaggctgtattattactgtgactaatcgtagggatgacgtaggtcgtacggtaacgggtttccggttttcgggcgggtacgggaccgaagtcgtacggacccgttaccgtaagtccacgcccgaaggtccgtaccgtcccccgttcgggtcctaccgttccgttcccggttacccccgcccccgtttcccgtacccgtaaccgggtacggtaaccggttaccgttcggggaaccgggtcccgggggtaccgttacgggggaaccgttaaccggggggaccccgtttacgggaaaaccggttttaacccggggacgtacggtacgtacgtacgacgtacgcgtcgcgtcgtcgtcg

SEQ ID NO: 225749 - DNA, 740 bp, Homo sapiens
  misc_feature: GYAE6OF01CVZB6.19.86.H09.1.454.CMB.1.raw
  modified_base (119)..(119): a, c, t, g, unknown or other
  misc_feature (119)..(119): n is a, c, g, or t
  modified_base (167)..(167): a, c, t, g, unknown or other
  misc_feature (167)..(167): n is a, c, g, or t
  modified_base (724)..(724): a, c, t, g, unknown or other
  misc_feature (724)..(724): n is a, c, g, or t
  modified_base (728)..(728): a, c, t, g, unknown or other
  misc_feature (728)..(728): n is a, c, g, or t
  modified_base (731)..(736): a, c, t, g, unknown or other
  misc_feature (731)..(736): n is a, c, g, or t
  modified_base (738)..(739): a, c, t, g, unknown or other
  misc_feature (738)..(739): n is a, c, g, or t
tcagtactctcgtgcacgaccggtgctcgatttagtgctatagacttgggtttgggggccgttcctgggcccagtctgtgctgactcaggcaccctcagcgtcgtcgggacccccgggnagacggtcaccatcgcttgttctgcaagcagctacgaacagtcgggancgaggtggtgtgagtgtggtatacaagtaacgtcccgaaggaacccgaccccctaaagtcgtacatactaataagtcgacgcgtagacggtccggttaccgttaacgggtccctagtaccgtacgtttccgtagtcggacggtaacggtacggtcggtcggccgtccgtacgtcgtccgttcccgtcggacctacgtacgacggacggccgtaccgtacgtacgtaggtaacgtagtaggtagtacgtagtaagtttacgttacgttcgtagtacgtaagttcccccggtaggtacgtagtacggtaggttacggttacgggttaccgggtttaccgggtttacgggaccgggtaacgggaccgtacggtaccggtaccggtaaccgtacggtaaccggtacgtaccgacccgtacggtacccgtacccgtaccccggtaccgtaccgttaccgttcccgttccccgttacccgtacccctacccgtaccgtaaccgtacgtaccgtacgtacggacggtacggtcggtacggtacggacggcgacgtagtacgagngcancgnnnnnngnng

SEQ ID NO: 225750 - DNA, 760 bp, Homo sapiens
  misc_feature: GYAE6OF01ALXCB.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatccctcctcttggtggcagcacgccgaccggacgcccactcccgaggtgcgagcgtgggtcgactacggtcggtggggctagggaggtaggaaagggcgccggtcggggcctacgtaggtacggtaacggtccttccgtggaccggtaggttcgttttaggacttacctaccgttcaggttcctaattacgtctaatacttacgttcgtcgggtcgtaccggaccgaccggtccccggtaggaacgtaacgggtccgttaggaggtaggaggtacggggcggtacgtccggtacggggttaggtacgggttgggtacggcgtacgtaacggtaccggtacgacgtaacggtaaggttaacggtttccggaccggggtacccgttaccggtaccgaacgtacggtaccggaccggtaacggtccgtaccgtaccgaacgtaacgtacgtaggtagtacgttagtacggtgtagacgtacgtacgacgtcggagtaccgaaggaccgacgtaaccggccttagtacgttagttaggtacggtcggacgggtacggacgggacggggtaacggaaacgtaacggtaacgtaaggttaacggttccggggtcccggtaaccccgggg

SEQ ID NO: 225751 - DNA, 745 bp, Homo sapiens
  misc_feature: GYAE6OF01BKJ4Z.19.86.H09.1.454.CMB.1.raw
  modified_base (150)..(150): a, c, t, g, unknown or other
  misc_feature (150)..(150): n is a, c, g, or t
  modified_base (657)..(657): a, c, t, g, unknown or other
  misc_feature (657)..(657): n is a, c, g, or t
  modified_base (661)..(661): a, c, t, g, unknown or other
  misc_feature (661)..(661): n is a, c, g, or t
  modified_base (677)..(677): a, c, t, g, unknown or other
  misc_feature (677)..(677): n is a, c, g, or t
tcagtactctcgtgcacgaccggtgctcgatttagtgctatagacttgggtttggggagcatcacccagcaaccacatctgtcctctagagaactcccctgagagctccgttcctcaccatggactggaccgtggagatcctctcttggnggcagcacgccgaccggacgcccacgtcccgagggtcgcgacgcgtggtcgcgacggttcggtcggggcgtagggagggtaggaaacgggcggtccggtcggggcctcggtaaggtacggtaacggttccgtccggtggtacggtacggttcgttttaggaaccttacctaccgttcaagttaccttattaactacttagttaacgtacgttcgggtcgggttacgcggaaccgccgggtccccgtaggaacggtacgggtcttagggacggtagggtacgtacggggtcgtaacggttcgggtacgggtagggttagggcggggtacgcgtacggacgttaccggtcgacgtaacgaacggttaacggtccggaacgggccgtacgtaccacggacgtcgggtaaccgaggtccgacgtaccgtaaacgtagtacgagtagtttaacgtaggtacgtacgtacggacgacgtagtaccggtggaacgtcgaggaccgacgacggtnttangttaaattgggtacgnggacggttacggcggacggggaccgtaaagtacggacgtaaggtaccggtcgggtaccccgtacgggg

SEQ ID NO: 225752 - DNA, 881 bp, Homo sapiens
  misc_feature: GYAE6OF01DWRWE.19.86.H09.1.454.CMB.1.raw
  modified_base (120)..(120): a, c, t, g, unknown or other
  misc_feature (120)..(120): n is a, c, g, or t
  modified_base (143)..(143): a, c, t, g, unknown or other
  misc_feature (143)..(143): n is a, c, g, or t
  modified_base (168)..(168): a, c, t, g, unknown or other
  misc_feature (168)..(168): n is a, c, g, or t
  modified_base (864)..(865): a, c, t, g, unknown or other
  misc_feature (864)..(865): n is a, c, g, or t
  modified_base (868)..(868): a, c, t, g, unknown or other
  misc_feature (868)..(868): n is a, c, g, or t
  modified_base (870)..(870): a, c, t, g, unknown or other
  misc_feature (870)..(870): n is a, c, g, or t
  modified_base (874)..(879): a, c, t, g, unknown or other
  misc_feature (874)..(879): n is a, c, g, or t
  modified_base (881)..(881): a, c, t, g, unknown or other
  misc_feature (881)..(881): n is a, c, g, or t
tcagtactctcgtgcacgaccggtgctcgatttagtgctatagacttgggtttgggggccgttcctgggcccagtctgtgctgactcaggccaccctcagcgtcgtcgggacccccgggnagacggtcaccatcgcttgttcngcaagcagctacgaacagtcgggancgaggtggtgtgagttggtggtatcgaagtaaacgtcccgaacgggaacccggaccccctaaaagtcgtacattacgtaataagtcgacgtcgttaggacgtaccggtttaccgttaacgggtccctaggaccgttatttccgtcgtcgggacgtacggtacggttccgtcgggcccgtccgtcgtacggttccctttccccggaggtaccctacgttcggaacgggtaccgggtccttaccgtaggttaccgtaaggaacgtagtacgggacggttacgtttaggttaaacttttacgtttaccggtaggttacgtaactaacggttcggtaaggggtatacggtaacggttaggtttacgggttaaccggggtttaacccgggggtttcccggggttttacgggggacccggggtaaacgggggtaacccctaacgggttcccggttaaccgggttaaccccggttaaccggtttaaaccggtacccgggtaaacccgtaaccccgggtaaccgggttcccccgttacccccggggtaccccccggtttacgggtaccccgtttaaccccgttttcccggttaccccccgtttaacccccgacccccgttacccgtaccggaaaccggttacggtaccgttacggtacgggacggtcccggtacgtaccgggacgtacgggccacgtagtcggnngcncngcgnnnnnngn

SEQ ID NO: 225753 - DNA, 762 bp, Homo sapiens
  misc_feature: GYAE6OF01ACMCE.19.86.H09.1.454.CMB.1.raw
tcagtactctcgtgcacgaccggtgctcgatttagtgctatagacttggggtttggggagcatcacccagcaaccacatctgtcctctagagaatcccctgagagctccgttcctcaccatggactggacctggaggatcctcctcttggtggcagcacgccaccggacgcccactcccgaggtgcagcgtggtagctagtcggtggggctggacggtgaaggacgccggtggggcctgaggtaggacggttcctcgtggcggtaggttcgttttaggactacctaccgttcgagttctaattatacctattacttaccgtcggtggggtaccgccggtaaccgaccgggtaccccgttagggaaccgtaggggttcttagggaggtgggacggtacgggccgtacgtccgggtaggggttagggttacggtcgggtacggccgtaacgtacgttacggtcgacgaacgtaacggtttaacggttccgaccggggccccgtacgtaccgaaccggtaggttaccgggaccgtacggggtccgtacccgtaaccgaacgttaaacgtcggtaggtttacgtaacgttaggtacggtacttaggacgtcgtaacgtcgtagggtaccgttcgacggtaaccggaccgtaccgtcgttaggttagttacgtttagtgggtaccggacgggtacggtacgggaacggggtacgggaacggtaaacggtacgtaaggtaccgggttccggtacccggtacccggggg

SEQ ID NO: 225754 - DNA, 653 bp, Homo sapiens
  misc_feature: GYAE6OF01BEQQ9.19.86.H09.1.454.CMB.1.raw
  modified_base (415)..(415): a, c, t, g, unknown or other
  misc_feature (415)..(415): n is a, c, g, or t
tcagtactctcgtgcacgaccggtgctcgatttagtgctatagacttggggtttggggagcatcacccagcaaccacatctgtcctctagagaatcccctggagagctccgttcctcaccatggactggacctggaggatcctcctcttggtggcagcagcccaccggacgcccactcccaggtgcagctggtgcagtcgtggggctggaggtgaaggcgccgtggggcctcgagtggacggtctccgtggcggtaggtctttggataccgtaccttcgagtctattatctattatactcgtgggtgccgacgcggccccgtaggacgaggtctggagtggagtagggcgtacgtccgacggtggtaggtgggtaggcgacgacgtacgtcgacacgagtacgttcgacgggccncgtacaccgtgtcggaccgtacgggtccgcgtaccgaacgtaatacgagttagtaatagtacggtacttggacgtacgtacggtccgttaggacgggttacgtcggaacccgacggtaccggaccgtagttaggtttaactttaggttacggtggaccgggtagggccgggaggggtaaccggggaacgtaaacgggcctaaagggttaacggttcgggtacccgggtaaccccgggg

SEQ ID NO: 225755 - DNA, 757 bp, Homo sapiens
  misc_feature: GYAE6OF01DPDJW.19.86.H09.1.454.CMB.1.raw
  modified_base (435)..(435): a, c, t, g, unknown or other
  misc_feature (435)..(435): n is a, c, g, or t
tcagtactctcgtgcacgaccggtgctcgatttagtgctatagacgttgggtttggggagcatcacccagcaaccacatctgtcctctagagaactcccctgagacgtcctccgttcctcaccatggactcggacgtggagtctcctccgttcgtggtcgcgacgcgaccgcccgaaccggacgacccctaccgtacccgaggtcgcgacgtcgtcggtcgcgtcggtcggtcgggtcgtagggtacgggtaggaacgggtccggtccgggtcgggtaccttcggaaaggtcggtaaccggttccgtccggtacgggtacggttacggtttcgttttaacggaccttaacctccgttaactagttacttaattactacgtaacttacgtcgtggtggacgcgacgtccgccgagacgtaggtcgtggaacggtgnggtcgacggtcctacgggtggaggtcggtgcggtactgaacgtcgtaacgactacgtaacgggttcgaccgggcgtccgagaccgtacgacgtcggaccggtacgaccgtccgaacgtacgtaagcgtaagtacgtaagtgtacgtagtgaccgtcgcgtacgtcggtacgtaacgccgaacgtaccggcttacgtagtttacgttaggttagtagggaccgggtaggtaccgggaaacggggtaacggggtaaaccgtaaaggtaaaccggtaaggttaaaccgggttacggttacccggtaacccggggtaaccccgggg

SEQ ID NO: 225756 - DNA, 507 bp, Homo sapiens
  misc_feature: GYAE6OF01AZUKQ.19.86.H09.1.454.CMB.1.raw
  modified_base (319)..(319): a, c, t, g, unknown or other
  misc_feature (319)..(319): n is a, c, g, or t
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
  modified_base (473)..(473): a, c, t, g, unknown or other
  misc_feature (473)..(473): n is a, c, g, or t
  modified_base (490)..(490): a, c, t, g, unknown or other
  misc_feature (490)..(490): n is a, c, g, or t
  modified_base (494)..(495): a, c, t, g, unknown or other
  misc_feature (494)..(495): n is a, c, g, or t
  modified_base (497)..(507): a, c, t, g, unknown or other
  misc_feature (497)..(507): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcgtccttaagggtccctgaccgattctctggcgagaggtctggcgcctcagcttccctggccatcagcgggctccagtctagaagntgacggtctgatttatacgtgtgacaattcgtggatgacagtgtagacggttccggtttggcgggaggacaagcgtagaccgtctaagtcacgacccgaagtcncgtccccgtcgtcactctcggtcccncctcctccacgtagacgtactcgnggcgcgtggccaggctnagtnngnnnnnnnnnnn

SEQ ID NO: 225757 - DNA, 873 bp, Homo sapiens
  misc_feature: GYAE6OF01D7EJ4.19.86.H09.1.454.CMB.1.raw
tcagtactctcgtgcacgaccggtgctcgatttagtgctatagacttgggtttgggggagagcatcacccagcaaccacatctgtcctctagagaatccctgagagctccgttcctcaccatggactggacctggaggatcctcctcgttggtggcagcagcccaccggacgcccactcccaggtgcagctggtgcagtcgtggggctggaggtgaaggcgccgtggggcctcgagtgaaggtctcgtgcgaggtcttttggacttacgaccttcgagttctatttaatactattaattaccgttcggttggggtcggaccggtaacgtaccgggccccgttacggggacgtaacggggtcgttaggaacggtagggtacgtaaggggccggtaacgtaccggtaagggttacgggttaaggttcggggtagggtacggtacgtaaacggttaccggtccggtaccgaaaccggttaaaggtaaacggttttcgggaaccgggggtcccgtaccggttacccgaaccccggtaaggttacccgggaccggttaaaccgggtccggacccggttaaccggaaaccggtaaactttaacggtaacggtttaggttaacttaaggttcggttaacgtttacgggaaacggtcccgtaaggtacccggttgggtaaaccgggttgttaaccgggaccggttaaaccccgtccggggtaccctaaggttttacggtttaaaggttttacggtttgggggtaaccggacgggttaaacggggaccgggtaaacggggggtaaacccgggggtaacgttaaaaacgggggacctaaaaacggggttttaaaacgggttccggggtttaaaccccccgggg

SEQ ID NO: 225758 - DNA, 822 bp, Homo sapiens
  misc_feature: GYAE6OF01DZ713.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctccttcttggtggcagcagccaccggacgcccactcccgaggtgcagcgtggtcgcgaggtcggtggggcgtaggagggtaggaacgggacggtcccggtggggtccctacgacggtaggtacggtccgttccgtggtcggtagggttcgttttaggaacttaaccctaccttttcgacgttactatttactactagttacttaccgtcggtggggtcggaccggtaccggaccgggtccccgtaggggaacgtaacggggtcgttagggacgggtaggtaagggtacgggtacgggtacgtacccgggtacgggggttagggttacgggtcggggtagcggtaccgtaaggttaccgtcggaaccgtaacggtaacggttaacggtttccgggaccgggtcccggtacgtacccaacccgtacggttaaccggggacctaaccggggtcccggaccgtaacccggtaaacggtaacttaacgtaggttacgttagttaggtacggtacgttaggacgtcgaacggtcccgtaggtacgggttcacggacgtaccgacccggtactagttagttagtttacggttcgacgggtacgggagggaccgggaacggggaccgggtaaacggtaaccgggtacgtaaaggttaaccgggtcggggttaccccggtaaccccggggg

SEQ ID NO: 225759 - DNA, 663 bp, Homo sapiens
  misc_feature: GYAE6OF01C6RQW.19.86.H09.1.454.CMB.1.raw
  modified_base (612)..(612): a, c, t, g, unknown or other
  misc_feature (612)..(612): n is a, c, g, or t
  modified_base (630)..(630): a, c, t, g, unknown or other
  misc_feature (630)..(630): n is a, c, g, or t
  modified_base (638)..(638): a, c, t, g, unknown or other
  misc_feature (638)..(638): n is a, c, g, or t
tcagtactctcgtgcacgaccggtgctcgattagtgctatagacttgggtttgggggaagaggaagactgacggtcccactcccaggtgcagctggtgcagtcgtggggctggaggtgaaggagccgtggggcctcaggtgaaggtctcctgcgaggtcttttggatacaccttcagtcattatcatatactcgtgggtgcgacgacggcccctaggacgaagggtcttgaggtggagtagggcggatccggacggtggtaggtgggtaggcgacagtacgtcgacacgaaggtaacgtttcgacgggccgcgtaccaccgtagtcggaccgtaagggtccgaccgttaccgaacgtaaataccgtagttagtaatacgtggtacttgagtccgagtccgtaggacggtctacggaaccgtacgaccggcctaagttgttaattacgttggcgacggtacgggcgaacggggacgggtaacgtaaagggactaaaggttaaacggtcgggtacccgtacccggtaggggaccctaacggggtaccctcgggtaccctaccggtcctctaccgacgccctacgacccgaacggccctagtcccgtcctcccgngcctccgcgctccgagcnccgtaccncgagacgcacgcgcgccgtggtccg

SEQ ID NO: 225760 - DNA, 542 bp, Homo sapiens
  misc_feature: GYAE6OF01ESOJR.19.86.H09.1.454.CMB.1.raw
  modified_base (117)..(117): a, c, t, g, unknown or other
  misc_feature (117)..(117): n is a, c, g, or t
  modified_base (163)..(163): a, c, t, g, unknown or other
  misc_feature (163)..(163): n is a, c, g, or t
  modified_base (523)..(523): a, c, t, g, unknown or other
  misc_feature (523)..(523): n is a, c, g, or t
  modified_base (526)..(526): a, c, t, g, unknown or other
  misc_feature (526)..(526): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
tcagtactctcgtgcacgaccggtgctcgatttagtgctatagacttgggtttgggggccgttcctgggcccagtctgtgctgactcaggcaccctcagcgtctgggacccccgggnagacggtcaccatcgcttgttctgcaagcagctcgaacatcgggancagtggtgtgatgtggtatcagaaagtcccaggaacggccccaaatcgtcatctataatgacgctgagcggttccttaagggtccctgaccgtattctctggcgagaggtctggcgctcagtccttcctggccatcgaggacgggctccgagtcctagaacgattgaggtctaggtatttattactgtagcctaatcgtggatgacagtgtaggaacggttcggtttacggcgggtaggaccagctacgaccgtctaagcacgccaaggtcctcgcccctggtaccacgtcgtcgttcccacctccaccgtacgacgtacgtacgtggacgcgggactggaccgacggtcacgtagtagnacntagcagcatncgtngc

SEQ ID NO: 225761 - DNA, 898 bp, Homo sapiens
  misc_feature: GYAE6OF01CSA5J.19.86.H09.1.454.CMB.1.raw
  modified_base (116)..(116): a, c, t, g, unknown or other
  misc_feature (116)..(116): n is a, c, g, or t
  modified_base (161)..(161): a, c, t, g, unknown or other
  misc_feature (161)..(161): n is a, c, g, or t
  modified_base (225)..(225): a, c, t, g, unknown or other
  misc_feature (225)..(225): n is a, c, g, or t
  modified_base (875)..(875): a, c, t, g, unknown or other
  misc_feature (875)..(875): n is a, c, g, or t
  modified_base (887)..(887): a, c, t, g, unknown or other
  misc_feature (887)..(887): n is a, c, g, or t
  modified_base (892)..(892): a, c, t, g, unknown or other
  misc_feature (892)..(892): n is a, c, g, or t
  modified_base (897)..(897): a, c, t, g, unknown or other
  misc_feature (897)..(897): n is a, c, g, or t
tcagtactctcgtgcacgaccggtgctcgatttagtgctatagacttgggtttgggggccgttcctgggcccagtctgtgctgactcaggcaccctcagcgtctgggacccccggnagacggtcaccatcgcttgtctgcaagcagctcgaacatcgggancagtggtagtgatgtggtatccgaagaaacgtcccgaaggaaccggacccccaaaagtccgtanaacgttctaataagtggaaccgccgttaggaacggtccggttaccgtttaaaggggccccttaggaaccccgttaatttccgtacgttacggacggaacggtaacggtccgtacgggccggtccctacgtaacggccctttaccccgttagggaccctaacgttccgaaggtaacggggcccttaccccgaaggtttcctacggtaaaggtacgttaggaacgggtcttacggtacttttaacgttaaccgttggttacggacttaaacgttccggttagggtactaggtaaccgtaggttacgttacgggtaaaccgggtttcccggggttttacgggacgggttaacgggaccgtaaacggtccgttaccggtaacccggtttaacccgttaaacgggttaccccgtaaccgggaacccccgtaaacggggttccccttaccccgggtaaccccccggtttaccggggtttaaccctaacccgtttcccggtttacccgtttacccccgttaacccccgtttcccggttaacccgaaccgggttaacggtaaccgggtttaacccgtacgggtaaccggttacccggggaccgttacgggaacccgtaaacgggtcccgacgtaacgtagggtaccctagacgacgtnaccgtagtaacngtacngtcgng

SEQ ID NO: 225762 - DNA, 654 bp, Homo sapiens
  misc_feature: GYAE6OF01EKUVW.19.86.H09.1.454.CMB.1.raw
  modified_base (377)..(377): a, c, t, g, unknown or other
  misc_feature (377)..(377): n is a, c, g, or t
tcagtactctcgtgcacgaccggtgctcgatttagtgctatagacttggggtttggggagcatcacccagcaaccacatctgtcctctagagaatcccctgagagctccgttcctcaccatggactggacctggaggatcctcctcttggtggcagcagccaccggacgcccactcccaggtgcagctggtgcagtctggggctggaggtgaaggagccgtggggcctcagtaggaacggtctccgtgcggtaggtcttttggactacaccttcagtcattatctactactactcgtgggtgcgacgacggcccgtggacgagggcgttagaggtggagtacgggacggtactcgacgggtggtaggtgggtggcgnacgtacggtcgacacgacggtagtttcgacgggtccgtacgtaccaccagtcggaccgacggtcgtacgtaccgagtaactactagttgtaatagtcggtaacttggacgtacacggtactaggtacgggttcgtacggaaccgacgaccggtacctaggttagttaagtttagttacgggtcggtacgggtaagggtacggaacgggggtaaccggggacgttaaacgggactaaaggtttaaacgggttccggttaccccggtaaaccccggggg

SEQ ID NO: 225763 - DNA, 844 bp, Homo sapiens
  misc_feature: GYAE6OF01C3I5Y.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcgtggtggcagcacgccaccggagcccactcccgaggtgcagctggtgcgaggtcgtggggctggaggtggaaggagccgtgggcctcgagtgaacggtctccgtgcggtaggtcgtttggactacctaccttactagtactattatctaatactaacttcggtaggggtcgtaccggaacgaccgggtcccccgttagggaaccggtaacgggttccgttagggtaggtacgggtaaggtacgggggaccggtacgttaccccggtagggttaccggggttagggttggggtaccgggtacggtaccgtaaacggttaccggtacgtaccgtaaacccggtaagggtttacggttttaccgggaaccggggtcccggtaccgttacccgacgtaacggtaccggaccggtaaacgggttcccggaccgtaacccgaagtaacgtaacgtaggtacgttagtagtacgggtacgttaggacgtacgacgaccggttagaccgggtttcgaagggtaacccgttacccgggaacccggtcgttaacccggtttaggttaacgtttaacggtttcgggtaccgggacgggtaacccgggtaaccggggtaacgggggtaaaccgggggtaaaccggtaaaacggggtaagtttaaaacggtttaaaccgggggtccggggttttaaaccccccgggggg

SEQ ID NO: 225764 - DNA, 856 bp, Homo sapiens
  misc_feature: GYAE6OF01COJBZ.19.86.H09.1.454.CMB.1.raw
  modified_base (180)..(180): a, c, t, g, unknown or other
  misc_feature (180)..(180): n is a, c, g, or t
  modified_base (273)..(273): a, c, t, g, unknown or other
  misc_feature (273)..(273): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcggaggctttggatacaccttcagtcattancatatactcgtgggtgcgacaggcccctggacgaagggtcttggagtggagtagggcgatccgacgggtggtagtgggtggcgcatacgtcgnacgagtaagttcgacgggtccgcgtacgaccagtcggaccaagggtccgcgtaccgaacggtaactacgaggtacgtaagtagtacgggtaactttggaaagccgaaggtcccgttaggtacggttacgtacggaaccggtaacgaaccgggtaccctaagttacgggttaattttagtttacggtacggtcgggtaaacgggtaccggaagggggtaacccggggggtaacgttaaaaacggggaccgtaaaaggttaaaacggggtttaccgggttacccggtaaccccccggggtaggggggtaacccggtaaacccgggggtaaccccggttacggggtaccccgtacccgggttacccgttcccgttaacgacccgggtaacccccttacccgaaaccccggtaaaccggggtaccccgttaacgtttccccggggttaccccctttccccccggttaccggggccccgtacccccggtttccgcccggttacccgaaccgggtaccgacccggtaccccgttcccgaacggtacgacccgtaaccggaccggtacccgggtccccgtcggggtcccg

SEQ ID NO: 225765 - DNA, 729 bp, Homo sapiens
  misc_feature: GYAE6OF01C1F78.19.86.H09.1.454.CMB.1.raw
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
tcagtactctcgtgcacgaccggtgctcgatttagtgctatagacttgggtttgggggagcatcacccagcaaaccacatctgtcctctagagaatcccctgagagctccgttcctcaccatggactggacctggaggatcctctcttggtggcagcagccaccggagcccactcccaggtgcagctggtgcagtcgtggggctgaggtgaaggcgccgtggggcctgaggtgaaggtctccgtgcgaggtctttggntaccacttcngtactattatctaatatactcgtgggtcgacggacgaccggtcccgtaggaaccgaacggggtctttggaggtaggacgtaggggcgtacgtccgtacgggtggtaggtgggtggcgtctagtacggtcgacacgtaagtacgtttacggacgggcccgcgtaccacgagtacgggaccgaacgggtcggtaccgtaccgtaaacgtaactacgtaaggttacgttaagtagttacggtaacgtttacgacggtaccgaacggtaccgttagggtaacgggttcgtacgggtaaccgtaaccggaccgggaaccgttaacggtttacggtaagttttaacgttgggttacggtaccggggtacgggtacgggacggggggtaaaccgggggtaacggttaaaacggggtaacgtaaggtttaaaaccgggttcgggttaaccccgggtaacccccgggggg

SEQ ID NO: 225766 - DNA, 616 bp, Homo sapiens
  misc_feature: GYAE6OF01BRFSP.19.86.H09.1.454.CMB.1.raw
  modified_base (595)..(595): a, c, t, g, unknown or other
  misc_feature (595)..(595): n is a, c, g, or t
  modified_base (600)..(600): a, c, t, g, unknown or other
  misc_feature (600)..(600): n is a, c, g, or t
  modified_base (605)..(605): a, c, t, g, unknown or other
  misc_feature (605)..(605): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaagtcccaggaaccggcccccaaatcgtcatctataatgacgctgacgcggtccttaagggtcctgaccgattctcgtggcgagaggtctggccgcctcacgtccttccctggccatcgaggacgggcctccgagtctaggaagagtgaggctagtatttattactgtgactaagtcgtagggatggacgtaggtgtacggtaaccgggttccggttttacgggacgggtacgggaaccgtaacgtccgtacggtacccgtaccgtaagtccgacgacccgtaacggccgtcccgtacccccgtcggtcctaccgttccgttccgttccccgcccttccgtacccgacgtacgtacgttaccgtcggtacggcgggtacgtacggaccgaacgggccgacgacgtacgangtcgnatcgngcagcngnacg

SEQ ID NO: 225767 - DNA, 518 bp, Homo sapiens
  misc_feature: GYAE6OF01DEDNM.19.86.H09.1.454.CMB.1.raw
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (480)..(480): a, c, t, g, unknown or other
  misc_feature (480)..(480): n is a, c, g, or t
  modified_base (487)..(518): a, c, t, g, unknown or other
  misc_feature (487)..(518): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattatgtgcgaggcagggacggggactaaggcaataaaggtggttccgaccccgtggggccagggaaccctggtccaccgtctccncacgcctccaccaacgggccccatccggttccttcccccgnggcccnccctgcctccgaggacnccaccgtccgagaacgcacgacgccgtccgnggtctcgaccgtggtaccgaaggtaccctccgttacccaaacggtaagttcacgggtacggccgggtcgtccgggaacgtaacgggccctagtagaacggnactgacnnnnnnnnnnnnnnnnnnnnnnnnnnnnnnnn

SEQ ID NO: 225768 - DNA, 894 bp, Homo sapiens
  misc_feature: GYAE6OF01C19RK.19.86.H09.1.454.CMB.1.raw
  modified_base (118)..(118): a, c, t, g, unknown or other
  misc_feature (118)..(118): n is a, c, g, or t
  modified_base (293)..(293): a, c, t, g, unknown or other
  misc_feature (293)..(293): n is a, c, g, or t
  modified_base (871)..(871): a, c, t, g, unknown or other
  misc_feature (871)..(871): n is a, c, g, or t
  modified_base (888)..(889): a, c, t, g, unknown or other
  misc_feature (888)..(889): n is a, c, g, or t
  modified_base (891)..(891): a, c, t, g, unknown or other
  misc_feature (891)..(891): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttctgcaagcagctcgaacagtcgggagcagtggtgtgagtgtggtatcaaggaaacgtcccgagggaacccgacccccaaagtccgtacattactaataatcgaacgtcgtaggacggtccggttaccgtttaaacgggtcccctaggaaccgtnttttccgtcggttcggaccggaggtacgggttccgtgggtcccgcccttacgacgttccccgtttcccgttacgggccctagttaccgaacggacgggcccttaccgacgttccggttaaggaaacggtagttacggtaacggtccgttaggttaatttaacgtttaacgtttcggtacgtaaccgttaaacgttcggttaaggggtaacttacggtaaccggtaagggtttacgggtaaccgggtttaaacccggggttttcccgggggtttttaacccggggaccgggggtaaaccgggttaacccggtaaacggttaccggttacccgggtaaccccggtttaccggttaaaaccggttaccccggtaaccggtaaccccggtaaaccgggttccccgttaccccgggtaccccccgtttaccgggtaccctaccgttcccgttttacccgggtacccccccgttccccgtaccccgttaacccggtaaccggtaacggttaccggttacggtcggtaacccgggtccgggtacggtaccgggaaccggtacgggacccgagttaaaccggcgancgtgcgtgcgtcagagnngngcg

SEQ ID NO: 225769 - DNA, 533 bp, Homo sapiens
  misc_feature: GYAE6OF01D2RNV.19.86.H09.1.454.CMB.1.raw
  modified_base (286)..(286): a, c, t, g, unknown or other
  misc_feature (286)..(286): n is a, c, g, or t
  modified_base (355)..(355): a, c, t, g, unknown or other
  misc_feature (355)..(355): n is a, c, g, or t
  modified_base (502)..(533): a, c, t, g, unknown or other
  misc_feature (502)..(533): n is a, c, g, or t
tcagtactctcgtgcacgaccggtgctcgatttagtgctatagacttgggcttgagtggatagggcggatccacggtggtagtggtggcgcatacgtcgcacagaagtttcagggcccgcgtcaccatggccaaggtcgcgtccaacgaatacagtgtatatggacttgagcagcctgaggtctgacgacacggccatgtattatgtgcgaggcagggacggggataaaggcaataaagtggttccgaccccgtggggccagggaaccctggtcctaccgtttccncacgccctaccaccgaacgggccctagtcccggttccttccccctggccgccctgcccgtccgaggtcncctaccctccgagacgccacgacggcccggcccgtggggcctcggcccgttgggtaccaaacgggtccttaacccgttccccgaacgaggtaacgttacgtaggacgggccggggtactcgggaacgaaggggccacgtagacgacnnnnnnnnnnnnnnnnnnnnnnnnnnnnnnnn

SEQ ID NO: 225770 - DNA, 720 bp, Homo sapiens
  misc_feature: GYAE6OF01C2I34.19.86.H09.1.454.CMB.1.raw
  modified_base (165)..(165): a, c, t, g, unknown or other
  misc_feature (165)..(165): n is a, c, g, or t
  modified_base (426)..(426): a, c, t, g, unknown or other
  misc_feature (426)..(426): n is a, c, g, or t
  modified_base (635)..(635): a, c, t, g, unknown or other
  misc_feature (635)..(635): n is a, c, g, or t
  modified_base (644)..(644): a, c, t, g, unknown or other
  misc_feature (644)..(644): n is a, c, g, or t
  modified_base (694)..(694): a, c, t, g, unknown or other
  misc_feature (694)..(694): n is a, c, g, or t
  modified_base (714)..(714): a, c, t, g, unknown or other
  misc_feature (714)..(714): n is a, c, g, or t
  modified_base (717)..(717): a, c, t, g, unknown or other
  misc_feature (717)..(717): n is a, c, g, or t
  modified_base (719)..(720): a, c, t, g, unknown or other
  misc_feature (719)..(720): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcaggacgtcaccatcgcttgttctgcaagcagctcgaacagtcgggancgagtggtgtgattgtggtatcgaagaaacgtcccgaagggaacccgacccccaaagtccgtcaatcctaataaagcgtacgcgtaggcgccgggtaccgttaacgggcctacggacgctttccgcgtaggcgaggtacgtctcgggacctcccgtagtaccgtccttcccgtaggcccttaagccgaacggacggccttaccgagtttccgagaagtagtggagtcctaggtacttatcgtagtcgactagtcgtaggtntacgaccgaggttacgtcgggtaaccgggttttccggttacgggcgggtaacggaccgaaccgttacggtaccggtaaccgttaccgtaaccggttaccgaaccgggtaccccgaaacgggttcccgtcccccggtaaccccgttcgggtaccctaccggtttccctccccgttacccccgtacccttcccgtaacccgacggttaacnccggttacnggggtacccgtgggacccgtggaacgaaccggcgtaacagggttacccgntggcgtcgagccgtagcgtnacngnn

SEQ ID NO: 225771 - DNA, 813 bp, Homo sapiens
  misc_feature: GYAE6OF01CPFAL.19.86.H09.1.454.CMB.1.raw
  modified_base (97)..(97): a, c, t, g, unknown or other
  misc_feature (97)..(97): n is a, c, g, or t
  modified_base (116)..(116): a, c, t, g, unknown or other
  misc_feature (116)..(116): n is a, c, g, or t
  modified_base (136)..(136): a, c, t, g, unknown or other
  misc_feature (136)..(136): n is a, c, g, or t
  modified_base (160)..(160): a, c, t, g, unknown or other
  misc_feature (160)..(160): n is a, c, g, or t
  modified_base (796)..(796): a, c, t, g, unknown or other
  misc_feature (796)..(796): n is a, c, g, or t
  modified_base (808)..(808): a, c, t, g, unknown or other
  misc_feature (808)..(808): n is a, c, g, or t
  modified_base (810)..(810): a, c, t, g, unknown or other
  misc_feature (810)..(810): n is a, c, g, or t
  modified_base (812)..(812): a, c, t, g, unknown or other
  misc_feature (812)..(812): n is a, c, g, or t
tcagtactctcgtgcacgaccggtgctcgatttagtgctatagacttgggtttgggggccgttcctgggcccagtctgtgctgactcaggcaccctnagcgtctcgggaccccggnagacgtcacatcgcttgtcngcaagcagctcgaacagtcgggancaggtggtgtgatggtgtatcaaggtaaacgtcccgaagggaaacccgtcccccaaaacgttcgtacgattacctaataaagtcgacgcttggaacgtccggttaccgtttaacgggtccctacgaccgtatttccgtatcggacggtaggacgggttcgtcggtccgtaccctacgtacggtcctttcccgtcggtaccgaacttccggacggtaacggggtcctaccgtacggtaccgtaggtaaaacggtcgtacgggtaaggtaccgttacggttagtttaacgttacgttacggtacggactaaacggttcggtagggtacgtaggaaccgtaggttcggtacgggttaaccggggttccggggttttacggaacgggggtacgggtaacccggtacggtacccggttaccggtaacccggttaaccgtaacggtaacccggtaaccggtaacccggtaacgggttccccggttacccggacccccggttccgggttacccgtccgttacccgtttcccggttaaccccctaccgttaccccgaccgtaacggttaaccggtaccgggttaacgtcgggtacgggaccggtacgtacggtacggaacggtccgacacggtacgctagtcgnaaccgtcgcagncngnc

SEQ ID NO: 225772 - DNA, 630 bp, Homo sapiens
  misc_feature: GYAE6OF01AXKCB.19.86.H09.1.454.CMB.1.raw
  modified_base (274)..(274): a, c, t, g, unknown or other
  misc_feature (274)..(274): n is a, c, g, or t
  modified_base (612)..(612): a, c, t, g, unknown or other
  misc_feature (612)..(612): n is a, c, g, or t
tcagtactctcgtgcacgaccggtgctcgattagtgctatagacttgggtttggggggaaggagggaagactgacggtcccactcccaggtgcagctggtgcagtcgtggggctgaggtgaaggagccgtggggcctcagtgaaggtctcctgcgaggtcttttggatacaccttcagtcattatcatatactctggtgcgacgagcccctggacaaggcttgagtggagtgggcgatccgacggtggtaggtggtgcgtcaagttcgtcgcanaggtaagtttcgaacgggtccgccgtacaccagtcggacctaacgggtcgcccgttaccgacgaaatactacggtgtaattgtaggactttggagccaggccgtagcggttccagacgaactacgggccattggtaaattagttggtacgcggtaggccggtaacgggacgggtacgtaaggactaaagttacgtacggttcggacccgtcgggaccgtacgggaccgtcggtacacgtcgtctcgcgtacctccgaacgacgccgtactccgtccgtacccgtcgccgtcctccgctacgacggtacacgcccgtaccgagacccgtcaccggaccncccggcccggtggtccgg

SEQ ID NO: 225773 - DNA, 699 bp, Homo sapiens
  misc_feature: GYAE6OF01C4PX3.19.86.H09.1.454.CMB.1.raw
  modified_base (143)..(143): a, c, t, g, unknown or other
  misc_feature (143)..(143): n is a, c, g, or t
  modified_base (286)..(286): a, c, t, g, unknown or other
  misc_feature (286)..(286): n is a, c, g, or t
  modified_base (680)..(680): a, c, t, g, unknown or other
  misc_feature (680)..(680): n is a, c, g, or t
  modified_base (688)..(689): a, c, t, g, unknown or other
  misc_feature (688)..(689): n is a, c, g, or t
  modified_base (691)..(699): a, c, t, g, unknown or other
  misc_feature (691)..(699): n is a, c, g, or t
tcagtactctcgtgcacgaccggtgctcgatttagtgctatagacttgggtttgggggccgttcctgggcccagtctgtgctgactcaggcaccctcagcgtctcggggacccccgggcagaccggtcaccatcgcttgttcngcaagcagcctcgaacagtcgggagcaggtggtgtgatggtggtatcaagaaacgtcccgaaggaacccggcccccaaatcgtacatctaataatcgacgtcgtggacgtaccggttaccgttaacgggtcccctgaaccgtnttcgtcgtggcgaggtaggtcgtcggaccgtcctcacgtccctttcccgtgggaccctagtccgaacggaccggggtcctacccgaaggttcgtaaggaaagtacgttggaacggtcttagtaactttaacgttacgtgtacgtaacgtaagttcggttacgggattacggaacgtaggtcggttacgggtaaccggggttttccgggtttacgggacgggaacggtaccaaggtcgaccggtaaccgtactaacggccaacggacccgaacggtcccgttcccggacccccgttcgggtctaaccgttcccgtttccctacccccgtacccttccgacccgaacggtaacgtacgtacgcggacgtccgggtacgtcggaaccgtacggccanacgtgcgnngnnnnnnnnn

SEQ ID NO: 225774 - DNA, 673 bp, Homo sapiens
  misc_feature: GYAE6OF01AHGBJ.19.86.H09.1.454.CMB.1.raw
  modified_base (87)..(87): a, c, t, g, unknown or other
  misc_feature (87)..(87): n is a, c, g, or t
  modified_base (118)..(118): a, c, t, g, unknown or other
  misc_feature (118)..(118): n is a, c, g, or t
  modified_base (231)..(231): a, c, t, g, unknown or other
  misc_feature (231)..(231): n is a, c, g, or t
  modified_base (656)..(656): a, c, t, g, unknown or other
  misc_feature (656)..(656): n is a, c, g, or t
  modified_base (660)..(661): a, c, t, g, unknown or other
  misc_feature (660)..(661): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
  modified_base (672)..(673): a, c, t, g, unknown or other
  misc_feature (672)..(673): n is a, c, g, or t
tcagtactctcgtgcacgaccggtgctcgatttagtgctatagacttgggtttgggggccgttcctgggcccagtctgtgctgactnaggcaccctcagcgtctcgggacccccgggnagacggtcaccatcgcttgttctgcaagcagctcgaacagtcgggagcaggtggtgtgatgtggtatcagaaacgtcccgaggaaccgccccaaatcgtcatctatatgacgntgacgccggttaccgttaacgggtccctgaccgtattcctcgtggacgaggtacggtcgtcggccgacctcgacgtccgttcccgtcggacctagtacgacggacggtcctccgacggttctaggaacgagtacggacggtcgttagttactttacgttacgtgtacgtacgtaacgttcggtaggtagtacggacgttaggttacgggttacgggtaccggggttttccggggtttaccgggacgggtaaccggacgtaacgtcgtaccggtaccgtaccgtacgtaccgacggaccgaccggtccgtccccgtccccgttccgtccgtaccgttcccgttcccgttaccccacccgttcccgtaccgaaccgtacgtacgttcgtcggacggtcgggtacgtcggcggacgcgacgtacgtgnacgnncgncnancngnn

SEQ ID NO: 225775 - DNA, 721 bp, Homo sapiens
  misc_feature: GYAE6OF01B5EMJ.19.86.H09.1.454.CMB.1.raw
  modified_base (118)..(118): a, c, t, g, unknown or other
  misc_feature (118)..(118): n is a, c, g, or t
  modified_base (165)..(165): a, c, t, g, unknown or other
  misc_feature (165)..(165): n is a, c, g, or t
  modified_base (709)..(709): a, c, t, g, unknown or other
  misc_feature (709)..(709): n is a, c, g, or t
  modified_base (711)..(711): a, c, t, g, unknown or other
  misc_feature (711)..(711): n is a, c, g, or t
  modified_base (714)..(714): a, c, t, g, unknown or other
  misc_feature (714)..(714): n is a, c, g, or t
  modified_base (716)..(716): a, c, t, g, unknown or other
  misc_feature (716)..(716): n is a, c, g, or t
  modified_base (718)..(721): a, c, t, g, unknown or other
  misc_feature (718)..(721): n is a, c, g, or t
tcagtactctcgtgcacgaccggtgctcgatttagtgctatagactttgggtttgggggccgttcctgggcccagtctgtgctgactcaggcaccctcagcgtctcgggaccccgggnagacggtcaccatcgcttgttctgcaagcagctcgaacagtcgggancagtggtgtgatggtgtatcaagaaacgtcccgaacgggaacccggaccccctaaatcgtacattctaataagtcgacgtctgacggtccggttaccgttaacgggtccctacgaccgtatttccgtagttcggacggacgtaggtccgtcgggcctcctacgacgttccttcccggttcggacctagtcgacgggacgggccttaccgaggttcctaggaacgtaggttggacggtctaggttaactttaagttaccgtggtacgacgtaacgttcgggtaagggtacgtggtaacgtacggtttacggtacgggttaccggggtttccgggtttaccggggacgggtaaccgggtaccgtacggtccgtacggtaacccgtacgtaacggttcaccggccgtacggccgttcccgccccgttcgtacctaccgttccgttaccccggtccccgtacccgtcctaccggtaacggtcggtacgttaccggtacgggtcgccggtacggtacggaccgggtacgaccgtcgacgtagctggacngnacnanannnn

SEQ ID NO: 225776 - DNA, 634 bp, Homo sapiens
  misc_feature: GYAE6OF01AV5YZ.19.86.H09.1.454.CMB.1.raw
  modified_base (285)..(285): a, c, t, g, unknown or other
  misc_feature (285)..(285): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcgttggtggcagcacgcccaccggacgccccactccccgaggtgccagcctggtgcacgtcgtggggctggaggtagaaggcgccgtcgggctgagtgacggtctccgtgcgagtctttggatacgaccttcagtcattanctaatactacgtgtgggtgacgacgccggcccgtggacgagggtcttaggagtagggagtacggggacggtacgtccggacggggttggtaggtcgggtcggccgtactacgtacgtacgcgtaacgaggtacggtttccgacggggtcccgacgtaccgaccgtacggtccgaccggtaacgggtcccgccggttaaccaacggtaactacgtgttagctagtcggtatgacagagtccaggcgttgagacgaccgacgctagtgttacgtgtggcgaggtacggacggtacgggaacgggtacgtaacggacggtaattaaccgggtggttccccgggtaacccggg

SEQ ID NO: 225777 - DNA, 607 bp, Homo sapiens
  misc_feature: GYAE6OF01ESIIQ.19.86.H09.1.454.CMB.1.raw
  modified_base (333)..(333): a, c, t, g, unknown or other
  misc_feature (333)..(333): n is a, c, g, or t
tcagtactctcgtgcacgaccggtgctcgatttagtgctatagacttgggtttggggggaagaggaagactgacggtcctgccacaggtggtgctgggcacggtgggcactcgacacaacatttgcgctcaactgtcttgtccaccttggtgtagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcagtacgtcgcacngaagtttcgaggggccgcgtcacatggccaagggtcgcgtaccacgaatacgagtcgatagtggacttgagtacagaccgtgacggtctagaccgacacgaccctagtgttaacttagttggtcgacggtaggaccgtagggaccggggtactaaagggactaagtaaacggtcgggttaccgaccccggtggggacccaaggggtaccccgtgggtaccgtacccggttccgtacccgtccgaacgtccctacccgacccggtaaacccgggg

SEQ ID NO: 225778 - DNA, 720 bp, Homo sapiens
  misc_feature: GYAE6OF01CWSTD.19.86.H09.1.454.CMB.1.raw
  modified_base (320)..(320): a, c, t, g, unknown or other
  misc_feature (320)..(320): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggtcttttggatacaccttcagtcattatcatatactcgtgggtgcgacacggcccctggacagggtcttgagtggagtagggcggtatccgacgggtggtaggtgggtggcgcataccgtcgacacagtaagttcgagggccgcgtcaccagtcggaccaaggtccncgtccaacggaataccgagtagtatagtggtacttggacgtcagtcctggagtcgtagacgtacgaccggctagttacgtatttagttggtcgacggagggacgaaggggaccgggtataaacgggctaagtaaacggtcggttaccgaccccggtcggggacccaacggggtaacccctgggtaccctacccggttacctcccgtacgaccgccccgtacccaacccggaaccgggtccccttaacggttcccggttacccccctttccccggtaccgggcccgtcccccgtccggtccgttaaccccggacgggacccgtacccgtaacccccgtcccgggaaaggacccgaccaacccggtcccgggaccccgggtccccggttcggggtaccccgg

SEQ ID NO: 225779 - DNA, 800 bp, Homo sapiens
  misc_feature: GYAE6OF01B05R8.19.86.H09.1.454.CMB.1.raw
  modified_base (539)..(539): a, c, t, g, unknown or other
  misc_feature (539)..(539): n is a, c, g, or t
tcagtactctcgtgcacgaccggtgctcgattagtgctatagacttggggtttgggggaagaggaagactgacggtcccactcccaggtgcagctggtgcagtcgtggggctggagggtagaaggacgccgtggggcctcaggtgaaggtctcctgcgaggtcttttggatacctaccttcagtctattatcattataccgtcgtgggtcgaccgacgacggccccgtaggaacgacgggtcttggaggtcggtagtagggcgactccggtagggttgggtaggtgggtcggcgtactagtaccggtccgacaacgtaaggtacggttcggacgggtccgccgtaccaccgtagtccgggaccgtaacgggtccgcccgtaaccgaacggtaactaccggtaggttagtaacgtagtacggtacgttacgaacgtccacgggtctacgggtacgtcgtacggaaccgacgtaaccggacttaagttcgttaattcggttaggtcggacgggtaaggcgggaacggggtacggggtaaanaacgggtacgtaaacggttaaacgggtccggttaacccgggacccggtcggggtaacccgaccgggttaacccggtccggtaccctacccgttcccgaccgttccgccggtacccgtaccccggtaacccggacccgggtcccgtacccggttccccgttccccggttaccccgcgggtcccctccgtaccgccgtaacccggcgaccgtcccacccggtcgaaccgcgtacccgacgggcccgccgggcccgtgggtccg

SEQ ID NO: 225780 - DNA, 753 bp, Homo sapiens
  misc_feature: GYAE6OF01AL95K.19.86.H09.1.454.CMB.1.raw
  modified_base (118)..(118): a, c, t, g, unknown or other
  misc_feature (118)..(118): n is a, c, g, or t
  modified_base (165)..(165): a, c, t, g, unknown or other
  misc_feature (165)..(165): n is a, c, g, or t
  modified_base (740)..(740): a, c, t, g, unknown or other
  misc_feature (740)..(740): n is a, c, g, or t
  modified_base (742)..(742): a, c, t, g, unknown or other
  misc_feature (742)..(742): n is a, c, g, or t
  modified_base (746)..(750): a, c, t, g, unknown or other
  misc_feature (746)..(750): n is a, c, g, or t
  modified_base (752)..(752): a, c, t, g, unknown or other
  misc_feature (752)..(752): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttctgcaagcagctcgaacagtcgggancaggtggtgtgatggtggtatcgaagaaacgtcccgaacggaacccgcccccaaatcgtcattactataactggacgtcgtaggacggtccggttacccgttaacgggtcccctaggtacccgtatttccgtccgtggacggaggtacggtcgtcgggccgtccctacgacgttccgtttccccgtcggaccctaacgtcggaacgggccgggtacctaccgtaacggttccgtaaggtaaacggtagtacgggtacggtccgttaaggttaatttaactttacgttgtacgtacgtaaacgttcggtagggtagtacggtaacgtggttacgggttaccgggttaccgggtttccggggttttacgggacggggtaaccggaccgtacgtaccgtaccggtacccgttacgtaacgtaccgaaccgacccgtaacggtcccgtacccgtccccgttacgtaccgtacccgttccgttcccgttcccctcccgtccctaaccgacgaacggtcggtaacgtcggtacggtccggtacgtacgggacgacggaccgtacgtaagtcgagatcgcgngngtcnnnnngng

SEQ ID NO: 225781 - DNA, 838 bp, Homo sapiens
  misc_feature: GYAE6OF01BZN4O.19.86.H09.1.454.CMB.1.raw
  modified_base (158)..(158): a, c, t, g, unknown or other
  misc_feature (158)..(158): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
tcagtactctcgtgcacgaccggtgctcgatttagtgctatagacttgggtttgggggagcatcacccagcaaccacatctgtcctctagagaatcccctgagacgcttccgttcctcaccatggactggaccgtgggaggactcctcctcgttgggnggcaggcacgacccgacccggacgcccacctccccgaggtcgccngccgtgggtcgacnggtcggtggggcgtggaggtggaaggcgtccggtgggcctcgagtacgacggttcctcgtaggcggtagggttcgttttaggaacttaccgtaccttacgagttacctaatttagtactaacttacgtacgttacggtcgggtacggaccggtacgtaccggacccgtagggaacggtaacgggtccgttaggtggtacgggtaaggtacgggaccgggtacgtacggtaccggggtgggttaacgggtcgggtacggggcgaccgtacgttacggtacgaccgaacgtaacggtacggtttaccggacgggccgtacgtaccgaccgtggtaccggcgtacgggttcccggacgtaccgtaacggtaaactcgtaaggttacgttaacgtacggtttaggtaacgtttaggacgtcgtaacggtccgttaaggtacgggtcgttaaccggaccggtaaccgtaccggtacccgttagttaaggttttaccgttaacggttggtacgggtagggaacggggtccgggaaaacgggggttacccggggttaaagggtaaaccgtaagggttaaaccggttaacgggtttcccggggtaaaccccgggttaacccccgggggg

SEQ ID NO: 225782 - DNA, 698 bp, Homo sapiens
  misc_feature: GYAE6OF01CHK9V.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggacgcccactcccgaggtcgcagctggtgcgtagtcgtggggctggaggtggaaggacgccgtgggcctcgagtgaagtctccgtgcggtaggtctttggactactaccttcagtctattatactattatacgtcgtggtgccgacgacggccccgtaggacgaacgggtctggacggtagggaacgtaggggtcgacgtccggtacgggttggtaggtgggtcggcgacgtacgtaccgtcgtacacgtaaggtaacggttccggacgggtacccgtcgtaccaaccgtaggtcgggaaccgacgggttcccgaccgtaaccgaaacggtaaacgttacgaaggttgttaacgtacggttggtaacgttagaaccgggtctaaccggtcgttagggacggttacgtacggaaccaaccggtacgaccgtagttacgttaactttggttggtacggagggacggtagggaacggggtacggtaaaccgtaaaggtactaaagggtttaacggtcgggttacccgtacccggggg

SEQ ID NO: 225783 - DNA, 742 bp, Homo sapiens
  misc_feature: GYAE6OF01EZR9J.19.86.H09.1.454.CMB.1.raw
  modified_base (659)..(659): a, c, t, g, unknown or other
  misc_feature (659)..(659): n is a, c, g, or t
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcgagctggtgcagtcgtggggctggaggtgaagggacgccgtggggcctcgaggtggaacggtcctccgtggcggaggtcttttggatactaccttcagtctattatacaattactactcgtgggtcgacggacgacggccccgtaggacgaagggcgttaggacggtgggtagtacggggacggtacgtaccggtagggttaggtagggtcgggtagggtccgacgtacgttacggtccgacgtaacgtaaggtaacggttttacggaacggggtcccgtacggttacccgaacccgttaacggtccgggacccgtaaaccggggttacccggacccgggttaacccgtaacggtaaacgttaaccgtaggttacgttaagttacggtacggttacgttacggacgtacgacggtaccgtgggacggttcgtaggaaccgaacgaccggaccgtagttagttactttaggttcggnggtacggacggacgggaccggggtaacgggacgttaaacgggacgtaaaggttaacgggttccggtacccggtaaccccgggg

SEQ ID NO: 225784 - DNA, 716 bp, Homo sapiens
  misc_feature: GYAE6OF01DMVML.19.86.H09.1.454.CMB.1.raw
  modified_base (162)..(162): a, c, t, g, unknown or other
  misc_feature (162)..(162): n is a, c, g, or t
  modified_base (268)..(268): a, c, t, g, unknown or other
  misc_feature (268)..(268): n is a, c, g, or t
  modified_base (692)..(692): a, c, t, g, unknown or other
  misc_feature (692)..(692): n is a, c, g, or t
  modified_base (697)..(697): a, c, t, g, unknown or other
  misc_feature (697)..(697): n is a, c, g, or t
  modified_base (710)..(711): a, c, t, g, unknown or other
  misc_feature (710)..(711): n is a, c, g, or t
  modified_base (713)..(713): a, c, t, g, unknown or other
  misc_feature (713)..(713): n is a, c, g, or t
  modified_base (715)..(715): a, c, t, g, unknown or other
  misc_feature (715)..(715): n is a, c, g, or t
tcagtactctcgtgcacgaccggtgctcgatttagtgctatagactttgggtttggggccgttcctgggcccagtctgtgctgactcaggcaccctcagcgtctgggacccccggcagacggtcaccatcgcttgttctgcaagcagctcgaacatcgggancagtggtgtgatgtgtatcaagaacgtccgaggaaccgccccaaatcgtcatctataatgacgcgtgagtccggttaccgttaacgggtccctagaccgtattccngtggcgaagtcggtctcggccgtacctcacgtccctttcccgacggtccctaagttacggaacggacggggtcccttaccgtacgttaccgtaacgggtaaggtacggtaggtacgggtacgttaggttaacttttacgttaaccgttggtacgtacgtaacgttcggtagggtatacggacgtaggttaggtacgggtaaccgggtttcggttttacggggcgggtaacgggaccgtaagtaccgtccggtaaccgttaccgtaacgtacctacgaacccgtacggtccctcccgtacccccgttgtcctacccgttccgttaccctaccccgtacccttcccgacccgtaacggaaccgttaccggtacgacgggtaccggtccgggtcgtaccgggacgaccgggccgtacgtaggtaccnggacncgacgcagtacanncngnc

SEQ ID NO: 225785 - DNA, 720 bp, Homo sapiens
  misc_feature: GYAE6OF01CW7OC.19.86.H09.1.454.CMB.1.raw
  modified_base (164)..(164): a, c, t, g, unknown or other
  misc_feature (164)..(164): n is a, c, g, or t
  modified_base (699)..(699): a, c, t, g, unknown or other
  misc_feature (699)..(699): n is a, c, g, or t
  modified_base (711)..(711): a, c, t, g, unknown or other
  misc_feature (711)..(711): n is a, c, g, or t
  modified_base (715)..(715): a, c, t, g, unknown or other
  misc_feature (715)..(715): n is a, c, g, or t
tcagtactctcgtgcacgaccggtgctcgatttagtgctatagacttgggtttgggggccgttcctgggcccagtctgtgctgactcaggcaccctcagcgtctgggacctccgggcagacggtcaccatcgcttgttctgcaagcagctcgaacagtcgggancagtggtgtgagtgtggtatcagaaacgtccgaggaaccgccccaaatcgtcatctaataatgacgctgacgtcggttaccgttaacgggtccctgaccgtattcgtcgtggacgacgaggtccgtggccgtcctcgacgtcccgtttccgtcggcctagtaccgaggacggcctacccgagtccgtaggaagtagtggacggtctaggtaatttacttacgttgtacgtactaagttcgtgggaattacggaacgtaggttcgttaacggtaaccgggtttcgggtttacgggacgggtacggaaccgtaagcgtaacggtaccgtacgtaagtccgaccgtaccggaacgtccgtcccggtaccccgttcggttaccctacgttcccgttaccgttacccccgtccccgttacccgtaaccggttaacccggtacgtaccgggtaaccgtaacgggtcccgggtccggggtaccgttacggggaacccgaaacggggttcccgaccgggtaaacgtcgggtacctacggtaanacgcgtacgcgngcgngtgcg

SEQ ID NO: 225786 - DNA, 899 bp, Homo sapiens
  misc_feature: GYAE6OF01A76ZN.19.86.H09.1.454.CMB.1.raw
tcagtactctcgtgcacgaccggtgctcgatttagtgctatagacttgggtttgggggaagaggaagactgacggtcccactcccaggtgcagctggtgcagtctggggctgaggtgaaggagcctggggcctcagtgaaggtctcctgcgaggtcttttggataccaccttcagtcattatcatatactcgtgggtgcgacacggcccctggaaccgaagggtcttgaggtggtagtaggggcgtactccgacgggttggtaggtggtggcgcagtacggtcgacaacgaaggtaaagtttcggaacgggcccgtcggtaccaaccgtagtcgggacccgtaaagggttccggaccgttacccaaccggtaaacgtaaccgtaggtttacggttaattagtacgggtactttggaacgtcaacggtcccgttaggtacggttcgtacggaaccggtaccgaccggacctagttacgtttaagtttacgtttggtacggacgggtacgggacggaacggggtaacgggggtacgtaaaagggacgttaaaagggttaaacgggttaccgggtttaacccggacccccgggtttacgggggaccccggtaaacgggggtaacccccgtttgggtacccccgtaacccggttcccgttacccggtaacccgacccggttcccccgtaaccccggtaacccgggtaaacccggggtaccccttaaccgggtttccccgggttacccccttcccccgggttaccgggccccggttaccccgttacccggtacccgttacccggaaccgggtaccgtaccccgtacccccggttacccggaaccggaccgtaccccggaaccggacccggggtaccccgggtcccccggttaggggtacccccg

SEQ ID NO: 225787 - DNA, 895 bp, Homo sapiens
  misc_feature: GYAE6OF01CMBVU.19.86.H09.1.454.CMB.1.raw
  modified_base (114)..(114): a, c, t, g, unknown or other
  misc_feature (114)..(114): n is a, c, g, or t
  modified_base (160)..(160): a, c, t, g, unknown or other
  misc_feature (160)..(160): n is a, c, g, or t
  modified_base (278)..(278): a, c, t, g, unknown or other
  misc_feature (278)..(278): n is a, c, g, or t
  modified_base (871)..(871): a, c, t, g, unknown or other
  misc_feature (871)..(871): n is a, c, g, or t
  modified_base (873)..(873): a, c, t, g, unknown or other
  misc_feature (873)..(873): n is a, c, g, or t
  modified_base (885)..(885): a, c, t, g, unknown or other
  misc_feature (885)..(885): n is a, c, g, or t
  modified_base (891)..(891): a, c, t, g, unknown or other
  misc_feature (891)..(891): n is a, c, g, or t
  modified_base (893)..(893): a, c, t, g, unknown or other
  misc_feature (893)..(893): n is a, c, g, or t
  modified_base (895)..(895): a, c, t, g, unknown or other
  misc_feature (895)..(895): n is a, c, g, or t
tcagtactctcgtgcacgaccggtgctcgatttagtgctatagacttgggtttggggccgttcctggcccagtctgtgctgactcaggcaccctcagcgtctcgggaccccggnagacgtcaccatcgcttgttctgcaagcagctcgaacagtcgggancagtggtgtgatgtcggtatcgaagaaacgtcccagggaaccgtaccccctaaatcgtacattctaataatgaccgtctgacggtaccgttaccgttaacgggtccctaggaaccgtntttctcgtggcgaggtacggtcgtcggccgcctacgcgtccttccgtcggaccttactccggaacggtacggtccgtaccgtacggtttaccgtaggaaagtaggttacggaacggtccgttaagttaacttttaacgttttaccgttaggttacgtaacggttaacgtttaccgggttaggggtacgtttaaccggtaaaacggtttggtacggggttttaacccggggtttaacccggggtttttcccgggggtttttaccggggaaccggggtaaccgggttaaacccgtaagggttaccccggttacccggtaaacccccggtttaaccggttaaaccgggttaccccggaaacccgggaaccccgggtttaaacccggtcccggtttaccccccgggtcccccggtttaaaccccgggtttcccttaacccggtttcccccttttacccccggtaccccccttacccccggtttcccgtaaacccggttacggtaaccggttaaccgggtttaacccggcgggtacccgggtaacccgggtcggttaaccgggtacccggaaacgggtccgtacgtaaacggtcggtncncgcgtcacgtcncgagcngngn

SEQ ID NO: 225788 - DNA, 902 bp, Homo sapiens
  misc_feature: GYAE6OF01BMJGL.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagcccaccggagcccactcccaggtgcagctggtgcagtcgtggggctggaggtgaaggacgccgtggggcctcgaggtggaacggtcctccgtggcggaggttcgttttaggacttacctaccttcgagtctattatctattactactcgttgggcgaccgacgtaccgggccccgtaggaacgaacgggtcgttaggacggtgggaagtacggggacggtacgtacccggtacggggttagggtagggttcggggtacgggccggtacgtaacggtaccgggttccggacgtaaccgtaaacgggttaaacgttttccgggaaccggggggtcccggtacccgggttaaccccgaacccggttacggttaccggggtaaccccgggtaaacgggggttaccccggtaccccgggtaacccgtaaaccggtaaaacgttaccgggtaaagggtttaccgttaaaggtttaccggtaggggtttacccgttagggtaaccgacggaccgttaaccccggttagggtaccgggtttacccggaggtaaaccccggaccggtaaccccgggtaccgttaacggtttaggtttaaacgttttaacggtttcggggtacggggtaaccggggtacggggaaacggggtaacggggggtaaccggggggaaaccggttaaacgggaaccggtaaaaggttttaaaccggggttcccgggggtttaaaccccgggtaacccccccggggggg

SEQ ID NO: 225789 - DNA, 711 bp, Homo sapiens
  misc_feature: GYAE6OF01CZP9W.19.86.H09.1.454.CMB.1.raw
  modified_base (194)..(194): a, c, t, g, unknown or other
  misc_feature (194)..(194): n is a, c, g, or t
  modified_base (340)..(340): a, c, t, g, unknown or other
  misc_feature (340)..(340): n is a, c, g, or t
  modified_base (591)..(591): a, c, t, g, unknown or other
  misc_feature (591)..(591): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggactcctcctcttggtggcagcagcccaccggagcccacctcccgaggtgcagcgtggngcagtcgtgggctggaggtagaaggcgccgtggggcctcgagtaggaggtcctccgtggcggtaggtcgttttggaactacgtccttacagtctattatctatatacgtcgtggcgacggacgccggcccgtaggaacgtagggtntaggagtggaggtacgggcgtacgtccggtaggtggtaggtgggtcggacgcgtaaggtaccgtcgtaacgagtaaggttagttacgacggggtcctacgtaccacccgaggttaccggaaccgtacgggtccgtcgtaaccgaacggttaactacggagtttggtaaacgtagttacggtaacgtcggaacgtcgtaaccggtacttaggggtaccgtcggtaacggaccgtaaccggccgtaaccgttnttacggttagtttagggtacggtaccgggacggtaacgggcgggtaacggggtaaccgggtaacgtaaacgggtacttaaacggggttaacgggttccgggtaacccggtaccccggggg

SEQ ID NO: 225790 - DNA, 687 bp, Homo sapiens
  misc_feature: GYAE6OF01BLFNN.19.86.H09.1.454.CMB.1.raw
  modified_base (279)..(279): a, c, t, g, unknown or other
  misc_feature (279)..(279): n is a, c, g, or t
  modified_base (388)..(388): a, c, t, g, unknown or other
  misc_feature (388)..(388): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggactggaggatcctcctctggtggcagcagccaccggacgcccactcccaggtgcagctggtgcagtcgtggggctggaggtagaaggcgcgtggggcctcgagtgaacggtcctccgtggcggtacggtcttttaggacttacctacctttnagttactaattactctaagttataccgtcgtgggtacgcgacgtacgccccgtggacgtaagggtctaggagtggagtagggcgactccggtagggtggttaggtgggnggcgcgtaagtacggcacgacgtagtacgtttcgacggcgtacgtcaccgagtacggaccgaacgggtcgtaccgtacccgaagtaacgtacgagtagttaagtagtcgggtacttaggagtcgaacgttccgtagggtacgttacgaggaacccgtaaccgccgggaaccctaggttacgttacgtttaggttacgggttcggaccggttaacgggcggttaacgggggaccgggttaacgtaaaacgggacctaaagggttaaaccggttccgggtttaacccggggtaccccgggg

SEQ ID NO: 225791 - DNA, 822 bp, Homo sapiens
  misc_feature: GYAE6OF01AR895.19.86.H09.1.454.CMB.1.raw
  modified_base (142)..(142): a, c, t, g, unknown or other
  misc_feature (142)..(142): n is a, c, g, or t
  modified_base (173)..(173): a, c, t, g, unknown or other
  misc_feature (173)..(173): n is a, c, g, or t
  modified_base (220)..(220): a, c, t, g, unknown or other
  misc_feature (220)..(220): n is a, c, g, or t
  modified_base (278)..(278): a, c, t, g, unknown or other
  misc_feature (278)..(278): n is a, c, g, or t
tcagtactctcgtgcacgaccggtgctcgatttagtgctatagacttggggtttgggggagcatcacccagccaaccacatctgtcctctagagaatcccctgagagctccgttcctcaccatggactcggacctgggaggntcctcctcgttggtggcagcagccacggacncccactcccaggtgcagctggtgcagtcgtgggctgaggtgaaggcnccgtgggcctgaggtgacggtctccgtgtcgtaggttcttttggactactacctttanagtacattatctatactacgtcgtgggtcgacgacgacggccccgtaggacgagggtcttaggaggtagggtacgtggggacgtacgtacggtacgggtaggttaggtcgggttggccgtataacggttaccgttcgacgaacgtaacggttaacggtttacccggacggggtcccggtacgttacccaaccgtacggttccggggaaccgtaaacgggggtccccgtacggtaccccggtaaacggtaaacgtacgttaacgggttacgttaaacgttacggtacgggttacccgtttaaggaccggaacgtaacggtacccggttaacgggtacggggtttaacccgtacgggaaacccggtaaccggtaccggtacccgttaaggtttaagggtttaaacggttttccgttaaaggggtcggtacccggggtaagggttcccgggaaagggggggaaccgggttaacgggtaaaaccgggtacggttaaaaacgggtttaacggggttcccggggttaacccccgggtaacccccgggggg

SEQ ID NO: 225792 - DNA, 921 bp, Homo sapiens
  misc_feature: GYAE6OF01DQZK7.19.86.H09.1.454.CMB.1.raw
  modified_base (164)..(164): a, c, t, g, unknown or other
  misc_feature (164)..(164): n is a, c, g, or t
  modified_base (899)..(899): a, c, t, g, unknown or other
  misc_feature (899)..(899): n is a, c, g, or t
  modified_base (902)..(902): a, c, t, g, unknown or other
  misc_feature (902)..(902): n is a, c, g, or t
  modified_base (911)..(911): a, c, t, g, unknown or other
  misc_feature (911)..(911): n is a, c, g, or t
  modified_base (914)..(914): a, c, t, g, unknown or other
  misc_feature (914)..(914): n is a, c, g, or t
  modified_base (916)..(916): a, c, t, g, unknown or other
  misc_feature (916)..(916): n is a, c, g, or t
  modified_base (918)..(918): a, c, t, g, unknown or other
  misc_feature (918)..(918): n is a, c, g, or t
  modified_base (920)..(920): a, c, t, g, unknown or other
  misc_feature (920)..(920): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacagtcgggancaggtggtgtgatgtggtatcagaacgtccgaaggaccggacccccaaatcgcatctataatgacgctgacgtcggttaccgttaacgggtccctggaccgtattcgtcgtcgggacgacggtaggtcgtcggccgtccgtcgacggtcccgtttccccgtcggacccgtagttaccgacgggacggggtcccttacccgtaggttccgttaaggaacgtagttacgggaaggtccgttaaggtaacttttaacgtttacgttcgggtacgtaaccgttaaacggtttaccggtaggggtaactaacgggtaacggttaacgggttttacggggttaaccggggtttaaacccgggggttttcccccgggggtttttaacggggggacccggggttaaaccgggggtaacccgtaaacgggtcccggttaaaccgggttaaccccccgggttaaccgtttaaaccgggttaaccccggtaaaccggtaacccccggtaaacgggggttccccgttacccccggggtacccccccggtttaccgggtaaaccccgtttccccgtttaccccgggtttcccccggtttcccccccgttaccccccgttttaccccgtaaccccggtaacccgggttaacggttaaacccgggttacccggtaaaggggtccccgggtacccggggtcgggtacccgggtaaccggaccgggtaccgaaccgtaaggtacgctacggngcncgacgtganagngngngng

SEQ ID NO: 225793 - DNA, 665 bp, Homo sapiens
  misc_feature: GYAE6OF01DT1LR.19.86.H09.1.454.CMB.1.raw
  modified_base (124)..(124): a, c, t, g, unknown or other
  misc_feature (124)..(124): n is a, c, g, or t
  modified_base (136)..(136): a, c, t, g, unknown or other
  misc_feature (136)..(136): n is a, c, g, or t
  modified_base (271)..(271): a, c, t, g, unknown or other
  misc_feature (271)..(271): n is a, c, g, or t
  modified_base (351)..(351): a, c, t, g, unknown or other
  misc_feature (351)..(351): n is a, c, g, or t
  modified_base (415)..(415): a, c, t, g, unknown or other
  misc_feature (415)..(415): n is a, c, g, or t
tcagtactctcgtgcacgaccggtgctcgattagtgctatagacttgggtttggggggaagaggaagactgacggtcccactcccaggtgcagctggtgcagtcgtggggctggaggtgaaggngccgtgggcctnagtgaggtctcctgcgaggtctttggatacaccttcagtctattatcatatactcgtgggtgaccgacgacggcccctaggaaccgaaggcttagaggtggagagggcgactccgacgggtggtaggtggtcggngcagtacgtcgcacgaaggtagttcgacgggccacgtcaccagtcggaccaaggtcgccggtaccaacgtaatacgagtntaatagtggtactgagacgagtcctggagtctcgacgtacgacgtacagtcgttatacgttggngcggaggcgtagggacgggataacggataagttaaaggtcggttacccggccgggacggggtaccgaaccgggtacccgtcggtaccacccggtcctaccgtacgtaccgtcccgtacccacccggaaacgggtccctacgttcccggtacccttccccggcggtaccctcccgtacgccgttaccgacggccgtaccgtacccgtcccggaagaccgaccgacggaccgtccggcccggtggtacccgg

SEQ ID NO: 225794 - DNA, 515 bp, Homo sapiens
  misc_feature: GYAE6OF01CLH0A.19.86.H09.1.454.CMB.1.raw
  modified_base (493)..(515): a, c, t, g, unknown or other
  misc_feature (493)..(515): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcacatggccaaggtcgcgtccacgaatacagtgtatatggacttgagcagcctgaggtctgacgacacggccatgtattattgtgcgaggcagggacggggactaaaggcaataaaggtggttcgaccccgtggggccagggaaccctggtcaccgtctcctcacgcctacccgaccgaacgggccccagttccggttccctttcccccgtgggccgcccgtcgcctccgagggacgccacccgtccggacgacgccaacgacggccggccccgtcggggcctcggccgtggtacgaacggtaccctaccgtttacccgaacgtagtacgttactggacgggtcgggcgtcgggacgaacgggcgacatagnnnnnnnnnnnnnnnnnnnnnnn

SEQ ID NO: 225795 - DNA, 792 bp, Homo sapiens
  misc_feature: GYAE6OF01EVL1N.19.86.H09.1.454.CMB.1.raw
  modified_base (99)..(99): a, c, t, g, unknown or other
  misc_feature (99)..(99): n is a, c, g, or t
  modified_base (121)..(121): a, c, t, g, unknown or other
  misc_feature (121)..(121): n is a, c, g, or t
  modified_base (143)..(143): a, c, t, g, unknown or other
  misc_feature (143)..(143): n is a, c, g, or t
  modified_base (167)..(167): a, c, t, g, unknown or other
  misc_feature (167)..(167): n is a, c, g, or t
  modified_base (253)..(253): a, c, t, g, unknown or other
  misc_feature (253)..(253): n is a, c, g, or t
  modified_base (770)..(770): a, c, t, g, unknown or other
  misc_feature (770)..(770): n is a, c, g, or t
  modified_base (779)..(779): a, c, t, g, unknown or other
  misc_feature (779)..(779): n is a, c, g, or t
tcagtactctcgtgcacgaccggtgctcgatttagtgctatagacttgggtttgggggcccgttcctgggcccagtctgtgctgactcaggccaccctnagcgtcgtcgggacccccgggnagacgtcaccatcgcttgttcngcaagcagctcgaacagtcgggancaggtggtgtagagttgtaggtactacgaaggaaacgtcccgaaagggacccgaccccctaaatcgtacaatctaagtaatcgacncgtgaacgtccggtacttaacgggcctagaccgtatcgtacgtcggacgaggtacggtcgtacggtcctacctacgaccgttcccttccggtaccggccgtaactcggaacgggcggtacctacccgtaagtccgtaaggtaagagtacggtaagtaccgttaagttaaacgtttacgttaacgtcggtacgtaacgtaaacgttgggtaacggtaggtacgtaacgtaggtttacggtaccgggtaccgggtttcgggttaccgggacgggtaaccggaacgtacggtcctaacggtaccgtaacgttaacgtaccgtaaccgaaccggtaccgtaccgtcccgttaccccggtcgttacccttaacccgtccgttacccttaaccccccggacccttaacccgacccggaaaccgttaacgggtcgttaaaccggtccggtaccgggggtaccgtccggtacgggaaacccggtacggtaaccggacgttaaggtaaccagggactccgttaagngtacggacncagcgcgacgacg

SEQ ID NO: 225796 - DNA, 825 bp, Homo sapiens
  misc_feature: GYAE6OF01C5TPF.19.86.H09.1.454.CMB.1.raw
  modified_base (181)..(181): a, c, t, g, unknown or other
  misc_feature (181)..(181): n is a, c, g, or t
  modified_base (190)..(190): a, c, t, g, unknown or other
  misc_feature (190)..(190): n is a, c, g, or t
tcagtactctcgtgcacgaccggtgctcgatttagtgctatagacttgggtttggggagcatcacccagcaaccacatctgtcctctagagaatcccctgagagctccgttccctcaccatggactggacctggaggatcctctcttggtgcagcagccaccggacgcccactcccaggtncagctggtnctagtcgtgggctggaggtgaaggagccggtcgggcctacgtaggtggaaacgggttcctccgtggaccggtaggttcgttttagggaactaacctaccttacgaagttcttaacttatactaagttataacttccggtgggtcgaccgacggtaccggtccccgtaggaacggaacgggtcgttaggaagtagggacgtaggggaccggacgtaccgtaggggttcggtaggtgggttacggacgacgtaagtaccgtcgtaaccgaacgtaacggttaaacgtttcggaaccggggtaccgtaccggtaccgaaccgtacgttaaccgaaccgtaaaccggggtacggtaccgttaacccgaaacggtaaacgttaccgaaaggttacttaacgtagttaacgggttacttacgggacgtacgtaacgggtaccgttacggtacgggttacccgtaaaggtaacccggtaccgtaacccgggaccgttaagtttaccggttaaaattttggttaccggtaacggggtacgaacggggttaccgggaaacgggggtaacgggtaaacggttaaaacgggaacttaaacggggtttaaaaccggtaccggggtttacccggtaaaccccgggggg

SEQ ID NO: 225797 - DNA, 537 bp, Homo sapiens
  misc_feature: GYAE6OF01BM8CG.19.86.H09.1.454.CMB.1.raw
  modified_base (213)..(213): a, c, t, g, unknown or other
  misc_feature (213)..(213): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggngcctggggcctcagtgaaggtctcctgcgaggtcttttggatacaccttcagtcattatcatatactctgggtgcgacaggcccctggacaagggcttgagtggagtagggcggtatccgacgggtcggtagtgggtgggcggcgagtacgtcgcacgagaagtttcagggccgcgtacgaccagtggaccaggtcgcgtccacgtaatacagtgtatatggtacttagagcagtcctggaggtctagacgacgacgccatgtattagttgtgtgacggcaggggacgggactaaagggcaagtaacggtggtcggtaccccgg

SEQ ID NO: 225798 - DNA, 711 bp, Homo sapiens
  misc_feature: GYAE6OF01BUAEW.19.86.H09.1.454.CMB.1.raw
  modified_base (97)..(97): a, c, t, g, unknown or other
  misc_feature (97)..(97): n is a, c, g, or t
  modified_base (116)..(116): a, c, t, g, unknown or other
  misc_feature (116)..(116): n is a, c, g, or t
  modified_base (163)..(163): a, c, t, g, unknown or other
  misc_feature (163)..(163): n is a, c, g, or t
  modified_base (235)..(235): a, c, t, g, unknown or other
  misc_feature (235)..(235): n is a, c, g, or t
  modified_base (689)..(689): a, c, t, g, unknown or other
  misc_feature (689)..(689): n is a, c, g, or t
  modified_base (700)..(700): a, c, t, g, unknown or other
  misc_feature (700)..(700): n is a, c, g, or t
  modified_base (705)..(705): a, c, t, g, unknown or other
  misc_feature (705)..(705): n is a, c, g, or t
  modified_base (707)..(707): a, c, t, g, unknown or other
  misc_feature (707)..(707): n is a, c, g, or t
  modified_base (709)..(711): a, c, t, g, unknown or other
  misc_feature (709)..(711): n is a, c, g, or t
tcagtactctcgtgcacgaccggtgctcgatttagtgctatagacttgggtttgggggccgttcctgggcccagtctgtgctgactcaggcaccctnagcgtctgggaccccgggnagacggtcaccatcgcttgttctggcaagcagctcgaacatcgggancaggtggtgtgatgtggtatacagaaacgtcccaggaaccggcccccaaatcgtcatactataactgaccgntgacgcggttaccgttaacggtccctggacctattcgttcgtggcgaggtacggtctcggcgtcctacacggtcctttcccgaggaccctagtccgaagggtacgggtaccctccgtaaggtttccgtaagaacggagttacgggagggtacttaggttaactttacgtttaacgtcggttaagacgtaaacgttcggtacgggtatacgggaaccttaggtacgggttacgggtaaaccggggttttcggtttaccgggacgggtacggtaaccgacgtccggttaccggacctttacggaagttacccgaacgtcccggaacgtcctacccgggtcccccgttcggtactaccgtccgtttaccgtaccccctacccttaccgacgtaaccgtacgtcgggttacctggtaccgggtcggtacgaccggaagtaccgggtcaagtacggtancctgcgcgacngtacnancnnn

SEQ ID NO: 225799 - DNA, 799 bp, Homo sapiens
  misc_feature: GYAE6OF01BAX14.19.86.H09.1.454.CMB.1.raw
  modified_base (118)..(118): a, c, t, g, unknown or other
  misc_feature (118)..(118): n is a, c, g, or t
  modified_base (774)..(774): a, c, t, g, unknown or other
  misc_feature (774)..(774): n is a, c, g, or t
  modified_base (781)..(781): a, c, t, g, unknown or other
  misc_feature (781)..(781): n is a, c, g, or t
  modified_base (786)..(786): a, c, t, g, unknown or other
  misc_feature (786)..(786): n is a, c, g, or t
  modified_base (788)..(788): a, c, t, g, unknown or other
  misc_feature (788)..(788): n is a, c, g, or t
  modified_base (791)..(792): a, c, t, g, unknown or other
  misc_feature (791)..(792): n is a, c, g, or t
  modified_base (795)..(795): a, c, t, g, unknown or other
  misc_feature (795)..(795): n is a, c, g, or t
  modified_base (797)..(797): a, c, t, g, unknown or other
  misc_feature (797)..(797): n is a, c, g, or t
  modified_base (799)..(799): a, c, t, g, unknown or other
  misc_feature (799)..(799): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttctgcaagcagctcgaacatcgggagcagtggtgtgatgtggtatcaagaaacgtcccgaagggaaccggcccccaaatcgtcacttctataatcgacgtctggacgtccggttaccttaacgggtccctaggaccgtattcgtcgtggccgtaggtacggttccgtcgggaccggtcccttcgtacgtcccgtttccccgtagggacccctaagttccggaagggtaaccggggtcccttacccgtaaggtttccgtaagggaaaagtacgttacgggacgggttacttaaggtaactttttaacgttaacgttggtacgtaacctaacgtttccgggtagggtaagtcggtaacgtagggttcgggttacgggtaaaccggggttttcccggggttttacggggaccggggtaacgggtaacccgaacggtccgttaaccgggtacccgtttaccgtaaacgttaccgaaccggtacccgaacggtccccgtcccggtcccccgttcgggtaccctaccgtttccgttaccccggttaccccctaccccgttccacccgtacgacggtaccgtacgtcgggacggtcccgggtacgacgggtaccggaacggtcccggtaacgtagtacgggtnacggtcncgacncncanncgngngn

SEQ ID NO: 225800 - DNA, 735 bp, Homo sapiens
  misc_feature: GYAE6OF01BOF2N.19.86.H09.1.454.CMB.1.raw
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
  modified_base (607)..(607): a, c, t, g, unknown or other
  misc_feature (607)..(607): n is a, c, g, or t
tcagtactctcgtgcacgaccggtgctcgatttagtgctatagactttgggtttgggggagagcatcacccagcaaccacatctgtcctctagagaactcccctgagagcttcccgtttcctcacctagtcggactcggaccgtggagactccctccttcgttggtcgcgacgccgacgaccgaccggacncccaccgtccgaggtcgcgacgcgtggtcgcgtacgttcggngggcgtaggaggtaggaacggtcgtccggtcgggccttgacggttaggtaacgtccgtccgtaggtcgtaggtttcgtttacggaacttaccgttcgtacgtagttctaatttactatacggttaacgttcgtccggttggccgaccgtaccgtaccggccgtacggaacgtaggttcgtaggaggtcggaggtacggacgacgtccggtaggtagtacggttggacgccagtaccgtaggcgaactacggttaaaggttacgtcggggaccggtaccgtaccgtacgaacccgttagggtaccggaaacccgttcggtaccgtaccgtaaccgtacgaacgttacgaagttcgtaatcggtaggtacgtacgngaccgtcgtacgtagacgtaccgtacgacgaacgacgtacgttagtcgttagttaggtcggtaagccggagtaccgggaacgggacgttaaggaacgaacgttacggttaacggtccggtaacccggg

SEQ ID NO: 225801 - DNA, 593 bp, Homo sapiens
  misc_feature: GYAE6OF01B3VVS.19.86.H09.1.454.CMB.1.raw
  modified_base (190)..(190): a, c, t, g, unknown or other
  misc_feature (190)..(190): n is a, c, g, or t
  modified_base (346)..(346): a, c, t, g, unknown or other
  misc_feature (346)..(346): n is a, c, g, or t
  modified_base (554)..(554): a, c, t, g, unknown or other
  misc_feature (554)..(554): n is a, c, g, or t
  modified_base (556)..(557): a, c, t, g, unknown or other
  misc_feature (556)..(557): n is a, c, g, or t
  modified_base (559)..(593): a, c, t, g, unknown or other
  misc_feature (559)..(593): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctggaggtctgacgacncggccatgtattatgtgcgagcgagggacgggactaaaaggcaataaaggtggttaccggaccccgtggggaccgaacggggaaacccctgggtacctaccggtctccgtacacgccctaccaaccgaacgggccccagtccggtccttcccccgnggccgccctgccgtacgaggactaccgaacccttccggaagacgaccgaaccgacggcccggccgttcgggggaccttcggacccgtttaggtaaccggtaaacggtaaccctttaaacccgtcccccggaaaaggtacgtaaacggttccgagggaacgggccggggggtacctacggggaacgaaacgggtcgtaccaagtaaggnannannnnnnnnnnnnnnnnnnnnnnnnnnnnnnnnnnn

SEQ ID NO: 225802 - DNA, 821 bp, Homo sapiens
  misc_feature: GYAE6OF01CFKVQ.19.86.H09.1.454.CMB.1.raw
  modified_base (157)..(157): a, c, t, g, unknown or other
  misc_feature (157)..(157): n is a, c, g, or t
  modified_base (165)..(165): a, c, t, g, unknown or other
  misc_feature (165)..(165): n is a, c, g, or t
  modified_base (785)..(785): a, c, t, g, unknown or other
  misc_feature (785)..(785): n is a, c, g, or t
  modified_base (801)..(801): a, c, t, g, unknown or other
  misc_feature (801)..(801): n is a, c, g, or t
  modified_base (812)..(812): a, c, t, g, unknown or other
  misc_feature (812)..(812): n is a, c, g, or t
  modified_base (816)..(816): a, c, t, g, unknown or other
  misc_feature (816)..(816): n is a, c, g, or t
tcagtactctcgtgcacgaccggtgctcgatttagtgctatagacttggggtttgggggcccgttcctgggcccagtctgtgctgactcaggcaccctcagcgtcgtcgggacccccgggagacgtcaccatcgcttgtctgcaagcagctcgaacngtcgggancaggttggtgtagtatcggtagtatcaagtaaacgtcccagggaaccgaccccaaagtcgtacattactaataagtcgacgtctagacgtaccggttaccgtttaacgggtccctggaacccgttattccgtcgttcgggacggtaacggtacgggttcccgtagggccgttccctacgtaccggtcccgtttccccgttacgggacccctaaagttccggaaacggtaccggggttcccttaacccggtaacggtttaccgaaggtaaaccggtagtcgggtaaaggtccgttaaggttaactttacgttaaccgtggtactaacgtacgtacggtagggtaacttgaacggtggttaggaacgggtttacccggggtttccgggtttacggggcggttaacgggaccctacggccgttacggacccgttaacgtaaggtaccaccggtaccgtaaaccggtccgtaccccggtccccgttaggtaccctacccgtttacccggttaccccgttacccccgaaccccgttttccaacccggtacgtaacgggtaaccgttcggtaacggccgggtaacggtcggtaacgggaccgtacgggtaaccctgtaaacggtcncgtagaccgaggttcncgtagacgtanacgngcgcg

SEQ ID NO: 225803 - DNA, 321 bp, Homo sapiens
  misc_feature: GYAE6OF01EOZO3.19.86.H09.1.454.CMB.1.raw
  modified_base (310)..(321): a, c, t, g, unknown or other
  misc_feature (310)..(321): n is a, c, g, or t
tcagtactctcgtgcacgaccggtgctcgatttagtgctatagacttgagcagcctgaggtctgacgacacggccatgtattattgtgcgaggcaggacggggctaaaggcataagtggttcgacccctggggccagggaaccctggtcaccgtctcctcagcctccaccaaggcccatcggtcttcccctggcgccctgctccaggacgccacctccgagacgcacgacgccggcccgtgggcctcggccctggtcaaggtactaccttcccgacgagagtactgagcgggctgggcaaggcgcatagnnnnnnnnnnnn

SEQ ID NO: 225804 - DNA, 843 bp, Homo sapiens
  misc_feature: GYAE6OF01C7MHV.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcgttggtggcagcagccaccggacgcccactcccgaggtgcagcgtggtgcagtcgtggggctggaggtaggaaggacgtccggtcggggccctacgaggtaggtaacggtccttccgtggaccggtaggttcgttttagggacttacccgtacctttacgtagttactaatttatacctaatacttaccgtcggtgggtacgaccgacgaccggtccccgtaggaaccggtaagggtccgttaggtaggtagggtaaggtacgggggtaccggtacgttaccggtacggggttagggtacgggttggggtcgggaccgtacgtaacggttaccggtaccggacgtaaacggtaacggttaacggtttaccgggacgggtcccgtacgttaccgacgtacggtacgggaccgtaacgggtcgaccgtaccgaacgtaacgtacgtaggtagtagttacgtacgggtacgttaggacgccgtacggtccgtaggggttaaccgttcgtaacgggaaccgtaccgggtaccggttaccttaaggttacggttttaactttacgggtttacgggtaccgggtaccggggtaacgggggtaacccggggaacgggggggtaaacccggggttaaacgtaaaacggggtaccgttaaaaacggggttaccgggtttccggggtttaaacccccccgggggg

SEQ ID NO: 225805 - DNA, 771 bp, Homo sapiens
  misc_feature: GYAE6OF01BVPLF.19.86.H09.1.454.CMB.1.raw
  modified_base (120)..(120): a, c, t, g, unknown or other
  misc_feature (120)..(120): n is a, c, g, or t
  modified_base (754)..(754): a, c, t, g, unknown or other
  misc_feature (754)..(754): n is a, c, g, or t
  modified_base (760)..(760): a, c, t, g, unknown or other
  misc_feature (760)..(760): n is a, c, g, or t
  modified_base (762)..(762): a, c, t, g, unknown or other
  misc_feature (762)..(762): n is a, c, g, or t
  modified_base (764)..(766): a, c, t, g, unknown or other
  misc_feature (764)..(766): n is a, c, g, or t
  modified_base (768)..(771): a, c, t, g, unknown or other
  misc_feature (768)..(771): n is a, c, g, or t
tcagtactctcgtgcacgaccggtgctcgatttagtgctatagacttggggtttgggggccgttcctgggcccagtctgtgctgactcaggcaccctcagcgtcgtcgggacccccgggnagacggtcaccatcgcttgttctgcaagcagctacgaacagtcgggagcgagtggtagtgattggtggtatcgaagtaaaacgtcccaagggaacccggaccccccaaaagtcctacaactactaaagtaatcggacgctaggaacggtcggttaccgttaaacgggtcccctaggaaccgtattccgtacgtggaccggaaggtacggtcgtcgggtccgtcctaccgtacgtccgtttccccggtacggtacccacgtacgaaacgggcgggtacctccgtaagtacgtaagaacgattacggaggtagttagttaagtttaacgttaagttggtaacgacgtaacgttcgtaaggggtatacggtaaacgtaggttacgggttacggttaaacccggggttttccgggttttaacggggacgggtaacgggaaccgaaggtccggttaacggtaacccggttacgtaacggtcccggaaccggtacccgtaacgtcccggtccccgtacccccgtacgggtaccctaacccgttccgtaccccggtttaccccaccccgtacccaaccgaccggtacgacgtaccgtacggacggtcgggaccgtacggaccgaggtaccagaacgtagancggacngnannnannnn

SEQ ID NO: 225806 - DNA, 790 bp, Homo sapiens
  misc_feature: GYAE6OF01BKJNO.19.86.H09.1.454.CMB.1.raw
  modified_base (336)..(336): a, c, t, g, unknown or other
  misc_feature (336)..(336): n is a, c, g, or t
  modified_base (722)..(722): a, c, t, g, unknown or other
  misc_feature (722)..(722): n is a, c, g, or t
tcagtactctcgtgcacgaccggtgctcgatttagtgctatagacttgggtttggggagcatcacccagcaaccacatctgtcctctagagaatcccctgagagctccgttcctcaccatgactggacctggaggatcctcctcttggtggcaggcacgccaccgggacgccccactcccgaggtgacgagcgtggtgctaggtccgtgggctggaggtcggaaggcggccggtcggggcctcgaggtaggaacggttctccgtggccgtaggttcgtttaggacttacctacttctagtcttaattactactaagtacttcgttcggtcggggtntaccggacggtaccgggtccccgtaaggggaccggtaagggttcgtttacgggagggttagggaacgggttacggggaccggttaacggtccggtacgggggttaggtacgggtcgggtgggtaccgacttaacggttacgtacggcgtaaaggtaaaccgttaacggttaccgaccgggggtcctaccggtaaccaaccggtgttaccggggaccgtaacggggtccccgtacgtaaccggtaacgtaaacgtaccgggtagttagtaaacgtttacgggagggttaaccgtgaacgggactacggggtctaacggggttcgtaccgaaggaacccgtccgcgtaagttgttaacgtttatcggttagggtcgtacgggaacggngggaaacggggtgggtaaacggtaagacgttaaaacggttcgggttaccgggtcccgtaacccggggg

SEQ ID NO: 225807 - DNA, 743 bp, Homo sapiens
  misc_feature: GYAE6OF01DPUSG.19.86.H09.1.454.CMB.1.raw
  modified_base (120)..(120): a, c, t, g, unknown or other
  misc_feature (120)..(120): n is a, c, g, or t
  modified_base (168)..(168): a, c, t, g, unknown or other
  misc_feature (168)..(168): n is a, c, g, or t
  modified_base (293)..(293): a, c, t, g, unknown or other
  misc_feature (293)..(293): n is a, c, g, or t
  modified_base (730)..(731): a, c, t, g, unknown or other
  misc_feature (730)..(731): n is a, c, g, or t
  modified_base (734)..(735): a, c, t, g, unknown or other
  misc_feature (734)..(735): n is a, c, g, or t
  modified_base (737)..(743): a, c, t, g, unknown or other
  misc_feature (737)..(743): n is a, c, g, or t
tcagtactctcgtgcacgaccggtgctcgatttagtgctatagactttgggtttgggggccgttcctgggcccagtctgtgctgactcaggcaccctcagcgtctcggggacccccgggnagacgtcaccatcgcttgttctgcaagcagctacgaacagtcggggancaggtggtgtgatgtgatcgaagaacgtcccgaaggacccgaccccaaacgtcgtcaattctaataacgtcggaccgtctaggtacggtccggttaccgttaaacggggtccctgaacccggttntttccgtgtgggacgtagggacggttcgtcgggcctaccgtccgacgttcccgttccgtcggtacctatcggaacggcggtccctaccgagttacgtaggaacgtagtacggacggtacttaggtaatttaacgttacgtaggttacgaacgtaaggttccgggtaggtactacggtaacggttaggttacgggtaccgggtttaccgggttttccggggttacggggaccgggtaacggtaaccgacgtcccgtacggttaaccccgtaccgtaacgtacccgtaacggtaccccggtaacgttccccgtaccccggtcccgttccgtacctttcccgttccccgttccccgtacccccaccccgtaccgacgtaaccgtagttacccggtggaccgggtccggaccggtaggaccgacgtcgtaggactacgagnngcnncnnnnnnn

SEQ ID NO: 225808 - DNA, 622 bp, Homo sapiens
  misc_feature: GYAE6OF01AZC1R.19.86.H09.1.454.CMB.1.raw
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (606)..(607): a, c, t, g, unknown or other
  misc_feature (606)..(607): n is a, c, g, or t
  modified_base (612)..(612): a, c, t, g, unknown or other
  misc_feature (612)..(612): n is a, c, g, or t
  modified_base (614)..(616): a, c, t, g, unknown or other
  misc_feature (614)..(616): n is a, c, g, or t
  modified_base (619)..(622): a, c, t, g, unknown or other
  misc_feature (619)..(622): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacagtcgggagcaggtggtgtgatgtggtatcagaacgtcccaggaaccggcccccaaatcgtcatctatatgacgntgagcggtccttaagggtccctagaccgattctcgtggcgaggtaggtcgtcggccgccttcgacgtccttcccgnggccatcgaggcggtctcgagtctagagngtggngtcgtagtaatttacttacgtggtacgactaagttcggtaggtacgtaggacgttagggttggtttaccgggtaacgggttttccggggtttaccgggacggggtaacgggtaccgtaagtccgtacgtacccgttacgtacgtcgtacgaccgaggtcctacccgtccccgtacggtaccctacgtccgttacccgtccccctacccgttcctaccgacgtacggacgtacggtacgcggtcggacgtcggagacgcgactagtnnagcancnnncannnn

SEQ ID NO: 225809 - DNA, 578 bp, Homo sapiens
  misc_feature: GYAE6OF01BEG4K.19.86.H09.1.454.CMB.1.raw
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (540)..(547): a, c, t, g, unknown or other
  misc_feature (540)..(547): n is a, c, g, or t
  modified_base (549)..(553): a, c, t, g, unknown or other
  misc_feature (549)..(553): n is a, c, g, or t
  modified_base (555)..(567): a, c, t, g, unknown or other
  misc_feature (555)..(567): n is a, c, g, or t
  modified_base (569)..(578): a, c, t, g, unknown or other
  misc_feature (569)..(578): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggactaaaggcaataaagtggttccgacccgtggggccaggaaccctggtcaccgtctcctcacgtcctccaccgaacgggccccagttcccggttcccgtttccccccgtgggccccgtcccctacggccgttcccgaagggaccgtacccacccgttacccgaacggacgacctaaccgacggcccggccccgtggggtccctcggtccgttacgggtaccgaacgggtaccttacccgttaccccgacggtaacgtacgttacgtcggaacggtccggggactcgggacgtaacgggccgacgagtacggncgngnnnnnnnngnnnnncnnnnnnnnnnnnncnnnnnnnnnn

SEQ ID NO: 225810 - DNA, 1017 bp, Homo sapiens
  misc_feature: GYAE6OF01CVE7C.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctgggaggatcctcctcgttggtggcagcacgccaccggacgcccactcccgaggtcgcaggcgtggtgacgacggtcggtcgggggtcctagggtaagggtagggaaacggggtcggtacccgggtcgggggtccccttacggacgggttacgggtaaaccgggttcccgtcccgtgggtaccgggtacgggttaccggtttttagggtacttaacccgttacccttaccgtacgttaccttaattttaacttacctaattacgttaccgttacggttacgggggttcggaccggaacccggtaccggtaccccggtagggaaccggtaagggtacgttacgggtagggtacgggtaaggtaacgggggaccggtaacgtaccgggtacgggttacggggttagggtcggggttacgggccgtaccgtacggttaacccgggtaccggaccgtaaacgggtaaacggttaaccgggttttaccggggaccggggtacccggtaccgggtaccccgtaaccggtaccgggtaccgggtaacccggggtaacccgggttacccggtaacccggttaaccccggtaaccgttaaccgtaacgggttaaggtttaacggtacgtttaacgggtaccggttacgtttaccggggaacgtaccggtaaccggtacccggttaacgggttaaccggggttccggttaaccgggaaccggtaccccgggtaaaccgggtacccgttaaacggtttacgtttaaggttttaacggttacggggtagggacggggtaccggggtaacggggtaaccgggggtaccggggttaaacggaaacggggtaacgttaaaaccgggtaacggggttaacccgggtttaacccccggggg

SEQ ID NO: 225811 - DNA, 841 bp, Homo sapiens
  misc_feature: GYAE6OF01C8ZKG.19.86.H09.1.454.CMB.1.raw
  modified_base (779)..(779): a, c, t, g, unknown or other
  misc_feature (779)..(779): n is a, c, g, or t
  modified_base (822)..(822): a, c, t, g, unknown or other
  misc_feature (822)..(822): n is a, c, g, or t
  modified_base (827)..(827): a, c, t, g, unknown or other
  misc_feature (827)..(827): n is a, c, g, or t
  modified_base (830)..(832): a, c, t, g, unknown or other
  misc_feature (830)..(832): n is a, c, g, or t
  modified_base (834)..(839): a, c, t, g, unknown or other
  misc_feature (834)..(839): n is a, c, g, or t
  modified_base (841)..(841): a, c, t, g, unknown or other
  misc_feature (841)..(841): n is a, c, g, or t
tcagtactctcgtgcacgaccggtgctcgatttagtgctatagacttgggtttgggggccgttcctgggcccagtctgtgctgactcaggcaccctcagcgtcgtcgggacccccggcagacggtcaccatcgcttgtctgcaagcagctcgaacagtcgggagcaggtggtgtgagtgtggtatcaagaaacgtcccgaggaaccgccccaaatcgtcatctataagtcgacgctgacgtccggttaccgttaacgggtccctagacccgtattttccgtacgtcgggacggtaacggtcgggttccgtcgggtcccggtaccctcgtaacgtccccgtttccccgtcggaccctaagttaccgaacgggtacggggtcccttaccggaacggttccgtaagggaaacgtaggtacgggtaacgggtaccgtttaggttaaaactttttaacgttttaccggttaggtacgtaaccgttaaacgtttacgggtaggggttaacttacgggtaaaccgttaaggggtttacgggtttaaccggggtttaaacccggggttttccgggggttttaaccggggaacgggggtaaccggtaaccgtaacgggttccgttaaccgggtaacccgtttaacccggtaaacggttacccgaaccggtaacccggtaacgggttacccgttccccggtacccccggttcggttaacccctaccgtttcccgttaccccgtcccccttaccccgttcccgtaccgaacggtaccgtaacgttaccgnggacgggttccgggcgtacgggaccgtaacggcgtacacgtancgtcncgnnngnnnnnngn

SEQ ID NO: 225812 - DNA, 536 bp, Homo sapiens
  misc_feature: GYAE6OF01AOP7C.19.86.H09.1.454.CMB.1.raw
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
  modified_base (501)..(505): a, c, t, g, unknown or other
  misc_feature (501)..(505): n is a, c, g, or t
  modified_base (507)..(536): a, c, t, g, unknown or other
  misc_feature (507)..(536): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcgaggggacggggactaaaggcaagtaaaggtcggttaccgaccccgtggggaccgacgggaaccctggtaccaccgtctccctcgacgccctaccgaccgaacgggccccaagtcccggtcccttcccccgtggcccgccctgcctaccgaggctaccgaccctccgaacgagcacgcggccggccgtgggctccggccgtggacgaacgtcctaccctcccgaaggacgacgtacgtacgggcgggccgggtacgcggacggtaacggcgtaacgngtaacggnagnnnnngnnnnnnnnnnnnnnnnnnnnnnnnnnnnnn

SEQ ID NO: 225813 - DNA, 712 bp, Homo sapiens
  misc_feature: GYAE6OF01ELNWU.19.86.H09.1.454.CMB.1.raw
  modified_base (195)..(195): a, c, t, g, unknown or other
  misc_feature (195)..(195): n is a, c, g, or t
  modified_base (563)..(563): a, c, t, g, unknown or other
  misc_feature (563)..(563): n is a, c, g, or t
  modified_base (626)..(626): a, c, t, g, unknown or other
  misc_feature (626)..(626): n is a, c, g, or t
  modified_base (650)..(650): a, c, t, g, unknown or other
  misc_feature (650)..(650): n is a, c, g, or t
tcagtactctcgtgcacgaccggtgctcgatttagtgctatagacttgggtttggggagcatcacccagcaaccacatctgtcctctagagaatccctgagagctccgttcctcaccagtggactggacctgggaggatcctctcttggtggcagcagccgaccggagcccacgtccgaggtgcaggccgttggngccaggttcgtgggcgtggaggtagaacgggcggtcccgtggggtacccttagacgggtacggtaacgggttcctcccgttgggaccgtagggttcgttttacggaacttaccgtaccttgacgtacttattacgcgtattcgtacgtcggtggtacgcgtaaccgcggtcccgtaggacgaggtcgtgggtaacgtgacggtagggccgtagtccggtagggtggtacggttgggcggtcgacgtacgttacgggcagtaacgacgttaagttccgggaaggtccctcgttaccgaaccgtacgtacgggccgtaacgggtcgtaccgtaaccgaacgttaacgtaccgtagttaacgagtttaagnggtaccgtagacgtacgcgtaccggagtacggtcgaacgacgtaccgagtccgattacggttnttaggtacggtccgtagggacggngggtacgggaacgggtacgtaaggtaacgtaagttaacggttcggggtaaccgtacccgggg

SEQ ID NO: 225814 - DNA, 889 bp, Homo sapiens
  misc_feature: GYAE6OF01EOHWI.19.86.H09.1.454.CMB.1.raw
  modified_base (117)..(117): a, c, t, g, unknown or other
  misc_feature (117)..(117): n is a, c, g, or t
  modified_base (155)..(155): a, c, t, g, unknown or other
  misc_feature (155)..(155): n is a, c, g, or t
  modified_base (164)..(164): a, c, t, g, unknown or other
  misc_feature (164)..(164): n is a, c, g, or t
  modified_base (859)..(859): a, c, t, g, unknown or other
  misc_feature (859)..(859): n is a, c, g, or t
  modified_base (879)..(879): a, c, t, g, unknown or other
  misc_feature (879)..(879): n is a, c, g, or t
tcagtactctcgtgcacgaccggtgctcgatttagtgctatagacttgggtttgggggccgttcctgggcccagtctgtgctgactcaggcaccctcagcgtctgggacccccgggnagacggtcaccatcgcttgttctgcaagcagctcgaanagtcgggancgaggtggtgtgatggttaggtatcgaaggaaacgtcccaagggaaccggcccccaaaagtcgtacatctaataatcggactcgtgacggtacggttaccttaacgggccctaggacctactcgtcgtggacgagtaggtcgtaggccgtacctcgtacgtccgttccgtacgtactacgtacgaacgggtacgggtaccttaccgtaacggttacctaaagggtaaaggtacggttacggtaagggtaccgtttaaggttaaacgttttaaacgtttaacggttaccggttaagaacgttaacggttaccgtagggtaacgtaacggtacgtaacgggttacggttaacggggttaacccgggtttaccgggggttttaaccgggacggggtttaaccgggggaacccttaaagggtaccgttaacccggggtaacccggtttaaccggttaaacggttcccgaaacccggggtaacgtaacccgggttacccgtaccccggtacccccggtttcgggttaacccgtttacccgtaccccgttttccccgggttaacccccgtccccccgtttaaccgggttaaccccgtaacgggttaaacccggtaaccggttttaccgacggggtaacccggggttccgggtaccgggaccggtaacgggaccgtaaccggtaacaaccggttagggaccncgtgacgacgcgtacgacanacgcgtgtag

SEQ ID NO: 225815 - DNA, 697 bp, Homo sapiens
  misc_feature: GYAE6OF01BOG7B.19.86.H09.1.454.CMB.1.raw
  modified_base (117)..(117): a, c, t, g, unknown or other
  misc_feature (117)..(117): n is a, c, g, or t
  modified_base (163)..(163): a, c, t, g, unknown or other
  misc_feature (163)..(163): n is a, c, g, or t
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
  modified_base (578)..(578): a, c, t, g, unknown or other
  misc_feature (578)..(578): n is a, c, g, or t
  modified_base (682)..(682): a, c, t, g, unknown or other
  misc_feature (682)..(682): n is a, c, g, or t
  modified_base (687)..(687): a, c, t, g, unknown or other
  misc_feature (687)..(687): n is a, c, g, or t
  modified_base (690)..(690): a, c, t, g, unknown or other
  misc_feature (690)..(690): n is a, c, g, or t
  modified_base (693)..(693): a, c, t, g, unknown or other
  misc_feature (693)..(693): n is a, c, g, or t
tcagtactctcgtgcacgaccggtgctcgatttagtgctatagacttgggtttgggggccgttcctgggcccagtctgtgctgactcaggcaccctcagcatctgggacccccgggnagacggtcaccatcgcttgttctgcaagcagctcgaacatcgggancagtggtgtgatgtggtatcaagaaacgtcccaggaaccggcccccaaatcgtacatctataatgacntgagccggttccttaagggtccctagaccgtnttcctcgtggcgagaggtctcgggcctcctcagtccttccgnggccatcgaggacgggctccgagtcgtagaagnttggacggtcttaggtattttagtaccgttggtacgactaagttcggtaggggtatacggacgtagggttcggtacgggttaaccggggttttccgggtttacggggacggggtaacggggtaacctacggttccgtacggtaacccggttacctaacgggtaccgtaccggacccggtaacggtcccgtcccggtaccccccgttcggtccctaccgttccgttccccgtttacccccnccccgttacccgtacccgtaaccggtacggtaccgttaccggtacgggacggtccggggtacgttccggacggtaaccggccgtacgtacgtagcgccaggtcncgacncantgngtac

SEQ ID NO: 225816 - DNA, 654 bp, Homo sapiens
  misc_feature: GYAE6OF01CU39I.19.86.H09.1.454.CMB.1.raw
  modified_base (186)..(186): a, c, t, g, unknown or other
  misc_feature (186)..(186): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
  modified_base (610)..(610): a, c, t, g, unknown or other
  misc_feature (610)..(610): n is a, c, g, or t
  modified_base (612)..(613): a, c, t, g, unknown or other
  misc_feature (612)..(613): n is a, c, g, or t
  modified_base (617)..(618): a, c, t, g, unknown or other
  misc_feature (617)..(618): n is a, c, g, or t
  modified_base (624)..(625): a, c, t, g, unknown or other
  misc_feature (624)..(625): n is a, c, g, or t
  modified_base (629)..(636): a, c, t, g, unknown or other
  misc_feature (629)..(636): n is a, c, g, or t
  modified_base (638)..(651): a, c, t, g, unknown or other
  misc_feature (638)..(651): n is a, c, g, or t
  modified_base (653)..(654): a, c, t, g, unknown or other
  misc_feature (653)..(654): n is a, c, g, or t
tcagtactctcgtgcacgaccggtgctcgatttagtgctatagacaagggcttgagtggatagggcggatccgacggtggtaggtggtggcgcatacgtcgcacagaagtttcgagggccgcgtcaccatggccaaggtcgcgtccagaatacagtgtatagtggacttgagcagcctgaggttcngacgacncggcagtgtattntgtgcgaggcgagggacgggactaaaggcaagttaaggtcggttacccgacccggtgggggaccgaacgggtacccgttcggtacctaccggtcttcccncgacctccctaccgaaccgaacgggtcccctagttcccgggttcccctttcccccgtggccccgtcccgtacgcccgtacccggagggaccctacccgtacccgtaccgggagaccgcccgtaacggtccggccgggtaccccggtgggcccttaccggcccggtttacgggtaaccgaaaccgggtaccctttacccccgtaaccggtaaacggtaacgttaccgtacggtacgggacccggggtccgggggtccgtaaccggggaacggaaaccggggtcctaaccgtagacggccagagcngnncgcnncgcgcnntcgnnnnnnnngnnnnnnnnnnnnnngnn

SEQ ID NO: 225817 - DNA, 688 bp, Homo sapiens
  misc_feature: GYAE6OF01E14U9.19.86.H09.1.454.CMB.1.raw
  modified_base (163)..(163): a, c, t, g, unknown or other
  misc_feature (163)..(163): n is a, c, g, or t
  modified_base (231)..(231): a, c, t, g, unknown or other
  misc_feature (231)..(231): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (676)..(676): a, c, t, g, unknown or other
  misc_feature (676)..(676): n is a, c, g, or t
  modified_base (683)..(683): a, c, t, g, unknown or other
  misc_feature (683)..(683): n is a, c, g, or t
  modified_base (687)..(687): a, c, t, g, unknown or other
  misc_feature (687)..(687): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaacgtcccaggaaccgcccccaaatcgtcatctataagtgacgtntgacgtccggtaccttaacgggtccctgaccgtattcngtggcgagaggtcnggcgcctcagtccttcccgtggccagtccaggacgggtcctccgagttctagaagtatggaggtcttagtatttagttaccgtggttacgactaagttcggtagggattcgacgtaggtaggttacgggtaacccgggttttccgggttttcgggacgggtaacggtaacccgaagtccgtaccggacccgttaccgttaacggtcgaaccgtacccggaaggtccctcccgtccccccgttcggttaccctaccggttcctttacccgttaccccctaccccttaccctaccgaaccggtacgtaacgttccgtacgggacgggtccgggtccggtacggtaccggaacgggtcccgacgtaacggtaggtccagtcgacgtagcgtaacgntaggacngtcng

SEQ ID NO: 225818 - DNA, 697 bp, Homo sapiens
  misc_feature: GYAE6OF01AMUBA.19.86.H09.1.454.CMB.1.raw
  modified_base (407)..(407): a, c, t, g, unknown or other
  misc_feature (407)..(407): n is a, c, g, or t
tcagtactctcgtgcacgaccggtgctcgattagtgctatagacttgggtttgggggggaagaggaagactgacggtcccactcccaggtgcagctggtgcagtctggggctggaggtgaaggagcctggggcctcagtgaaggtctcctgcgaggcttttggatacacttcagtcattatcatatactctgggtgcgacaggcccctggacaagggctgagtggagtaggggcgatccgacgggtggtagtggtggcgcatacgtcgcacgaggtaagtttcgacggggccgtcggtacaccagtcgggaccgaaagggtccgccggtccaacggaactacgaggtcgtatagtggacttgagcagcctggacgtctcggacgacacggtccatgtacttagttgngtacgagggcgaggggtacgggactaagggcaagttaaacggtcggtaccggaccccgtggggacccgacgggtaacccctgggtacctaccggtcctacctaccgacggtcccctacccgaaccggaaccggggtacccaacggttcccggtttaccccgtcccccggtcgggtaccccgtcccgttacggtcccgtacccgtaacgggtccgtacccgtaccccgggtaccgaacggtacccgtacgtacccgggaacgccccgggttccccggtagggggtccccgg

SEQ ID NO: 225819 - DNA, 813 bp, Homo sapiens
  misc_feature: GYAE6OF01CYG4X.19.86.H09.1.454.CMB.1.raw
  modified_base (98)..(98): a, c, t, g, unknown or other
  misc_feature (98)..(98): n is a, c, g, or t
  modified_base (120)..(120): a, c, t, g, unknown or other
  misc_feature (120)..(120): n is a, c, g, or t
  modified_base (172)..(172): a, c, t, g, unknown or other
  misc_feature (172)..(172): n is a, c, g, or t
  modified_base (788)..(788): a, c, t, g, unknown or other
  misc_feature (788)..(788): n is a, c, g, or t
  modified_base (798)..(798): a, c, t, g, unknown or other
  misc_feature (798)..(798): n is a, c, g, or t
  modified_base (802)..(802): a, c, t, g, unknown or other
  misc_feature (802)..(802): n is a, c, g, or t
  modified_base (806)..(813): a, c, t, g, unknown or other
  misc_feature (806)..(813): n is a, c, g, or t
tcagtactctcgtgcacgaccggtgctcgatttagtgctatagacttggggtttgggggccgttcctgggcccagtctgtgctgactcaggcaccctnagcgtcgtcgggacccccgggnaggacgtccaccatcgctttgttctgcaagcagtctacgaacagtcggggancgaggtggtgtgagttggttggtaatacgaaaggtaaacggtccccgaaacgggaaccccgtacccccaaaacgttcgaccaattcttaaagtaagtcgaccgtcgtaggaccggtccgggttaacccgtttaacgggtccctagtaccggtctttaccgtcggttacgggacggtacggtaggttcgtcgggcccgttaccgtacgtccgtccctttcccgaggtaccagttaccggaggacgggttcctcccgtagtaccgaggtaaaggtactacgggtacggttaccgttagttaaagttttaacgtttacgtcggtagaaccgtttaaacgtgggttacggtaagttacgtaacggtaggtttaacggtacgggggtttaaaccgggtttcccggggttttacggggaccgggaacggtacgtaacgtccggttaaccggtaaccgtaacgtactaaccggacccgggtaacctcgggtaccctcccgtaccccgtcggtcccacgtttccccgtaccggttcccccctaacccgttccgtaacccgggaatacccgggttactcgggttaccggcggttacccggggagtcggacgttaacggccgttanaccgagccancganacgnnnnnnnn

SEQ ID NO: 225820 - DNA, 759 bp, Homo sapiens
  misc_feature: GYAE6OF01C6WBY.19.86.H09.1.454.CMB.1.raw
  modified_base (165)..(165): a, c, t, g, unknown or other
  misc_feature (165)..(165): n is a, c, g, or t
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (744)..(744): a, c, t, g, unknown or other
  misc_feature (744)..(744): n is a, c, g, or t
  modified_base (746)..(747): a, c, t, g, unknown or other
  misc_feature (746)..(747): n is a, c, g, or t
  modified_base (750)..(759): a, c, t, g, unknown or other
  misc_feature (750)..(759): n is a, c, g, or t
tcagtactctcgtgcacgaccggtgctcgatttagtgctatagacttggggtttgggggccgttcctgggcccagtctgtgctgactcaggcaccctcagcgtctcgggaccccgggcagacggtcaccatcgcttgttctgcaagcagctacgaacatcgggancaggtggtgtgatgtggtatcaagaaacgtcccgaggaaccgcccccaaatcgtacatctanatgacgctgacgtccgtaccgttaacggtcctgacgtattccagtggccgaaggcggtcgtcggcgtcctacncgtcccttccncggacctactacgacggacgggtcctaccgacgtccgtaggaaagtgtacggaggtacctaggttaactttacttaaccgttgtacgtaaccgtaattcggggtagggtaacgtacgtaacggtaaggttcggggtacgggtttaaaccgggggtttccgggttttacggggaaccggggtaacgggtaccgtaaccgggtaccgtacccgggttaacccggttaaccgttaaacgggtccggtaacccggtaacccgggtaaacggtccccggttacccccgtaccccgggttacccgttaccgtaacccgttttccccgttaacccggtcccccctaccccgttaccccgaacccgttacgggtaaacgtacccgtaggtaccgggaccggtacgggtcctacgggaccgtaacggggaccctagtaccgngnntcnnnnnnnnnn

SEQ ID NO: 225821 - DNA, 722 bp, Homo sapiens
  misc_feature: GYAE6OF01A3RLA.19.86.H09.1.454.CMB.1.raw
  modified_base (183)..(183): a, c, t, g, unknown or other
  misc_feature (183)..(183): n is a, c, g, or t
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggacgcccactcccgaggtncagctggtgcagtcgtggggctggaggtggaaggcgcggtgggcctgaggtaggagtcctccgtggcgtaggttcgtttggactactaccgttcagtctaattactactaattacttacgtcggttcgggtcgccgtaacgaccggtcccgtaggaacgtagggtcgttaggaggtaggtaacggtacggggacgtacgtaccgggtacgggttgggtaacggtggggtcggaccgtacgtaacgttccggtacggtaccgaacggtaacggtttaacggttccgggaccgggtcccgtacggtacccaccgtaaggttccgggaaccgtaacgggtcccgacgtaccgaaagtaactacgggtagttagtaacgttacggtacgtacgttcggaacgcgtaacgtacccgtaggtacgttcgaccggtaacgcggtacgtctagggtttacttaggttcgngggtacgngggagggaccggtaggggaccgttaacggtaagtacgtaaaggttcggttccgggtacccgaccggggg

SEQ ID NO: 225822 - DNA, 729 bp, Homo sapiens
  misc_feature: GYAE6OF01EI7CJ.19.86.H09.1.454.CMB.1.raw
  modified_base (168)..(168): a, c, t, g, unknown or other
  misc_feature (168)..(168): n is a, c, g, or t
  modified_base (717)..(717): a, c, t, g, unknown or other
  misc_feature (717)..(717): n is a, c, g, or t
  modified_base (719)..(721): a, c, t, g, unknown or other
  misc_feature (719)..(721): n is a, c, g, or t
  modified_base (723)..(726): a, c, t, g, unknown or other
  misc_feature (723)..(726): n is a, c, g, or t
  modified_base (728)..(729): a, c, t, g, unknown or other
  misc_feature (728)..(729): n is a, c, g, or t
tcagtactctcgtgcacgaccggtgctcgatttagtgctatagacttgggtttgggggccgtttcctgggcccagtctgtgctgactcaggccacccctcagcgtcgtcgggacccccgggcagacgtcaccatcgcttgttctgcaagcagctcgaacagtcgggancagttggtgtagatggtaggtatcgaagaaacgtcccgaaggaacccgaccccctaaaatccgtcaattctaataatcgaaccgctggacgtccggttaccgttaacgggtccctcggaaccgtctttccgtcgttgggccggaagggtacggttccgtcgggccgttcccgtacgtacgtttcccgttccccgtacggtacctagtccgagggacggggtcctaccgaggttactaacggtaaggtagtacgggaacggtacgttagttaacttttacgtacgttcgtagaccttaattcggtagggtactacggtaacgtggttaggtacccgggttaaccgggttttcccggggttacggaccgggtaacggaaccgtacggtacgtaccgtaccgtacgtaacgtccgacgaccgtaacggcccgtaccgtcccccggtatcccgtacttcccgttcccgtccccctaccgtccccgtaacccgacgtaaccggtacgtacggtacgacggtccggacggttcggacgtaggccacgtagacgtngnnntnnnngnn

SEQ ID NO: 225823 - DNA, 827 bp, Homo sapiens
  misc_feature: GYAE6OF01CC6HQ.19.86.H09.1.454.CMB.1.raw
  modified_base (120)..(120): a, c, t, g, unknown or other
  misc_feature (120)..(120): n is a, c, g, or t
  modified_base (142)..(142): a, c, t, g, unknown or other
  misc_feature (142)..(142): n is a, c, g, or t
  modified_base (189)..(189): a, c, t, g, unknown or other
  misc_feature (189)..(189): n is a, c, g, or t
  modified_base (306)..(306): a, c, t, g, unknown or other
  misc_feature (306)..(306): n is a, c, g, or t
  modified_base (812)..(813): a, c, t, g, unknown or other
  misc_feature (812)..(813): n is a, c, g, or t
  modified_base (821)..(821): a, c, t, g, unknown or other
  misc_feature (821)..(821): n is a, c, g, or t
  modified_base (823)..(823): a, c, t, g, unknown or other
  misc_feature (823)..(823): n is a, c, g, or t
  modified_base (825)..(825): a, c, t, g, unknown or other
  misc_feature (825)..(825): n is a, c, g, or t
  modified_base (827)..(827): a, c, t, g, unknown or other
  misc_feature (827)..(827): n is a, c, g, or t
tcagtactctcgtgcacgaccggtgctcgatttagtgctatagactttgggtttgggggccgttcctgggcccagtctgtgctgactcaggccaccctcagcgtcgtcgggaccccgggnagacgtcaccatcgcttgttcngcaagcagctcgaacagtcgggagcaggtggtgtgagtggtaggtancgaaggaaacgtcccgaacggaacccggacccccaaacgtcgtacacttactaataagtcggaccgtcgtaggacggtaccggtttacccgttaaacgggtcccctaggtaaccgtnttttccgcggtcggacggaaggtcggtcgtcggccgtacccgtacgtccgtccgtttcccgtcgggtaccaacgttccggaacggtaccgggtcctaccgtacgttaccgaaggaagtacgtacgggacggtacgttagttaacgttttaacgttacgttagttacgaaccgtaaacgttcgggtgggtaacgtaggtaacgtaggtttacgggttaaccggggttaaccgggggttttacccggggtttaccggggaccggggtaaccggggtaaccgtaacggtccggttaacccggtaccgttaaccgtaacggtaccgaaccggtacccgggtaaccgtcgtacccccggtaccccggttcggtacctacccgttccgtacccccttacccggtacccctacccgttaaccgaacggtaccgtacggtaaccggtacggtaccgggtacccggtacgggaccggaaccgacggggccttaaacggacgaggccggagcgcgnngacgacancngngn

SEQ ID NO: 225824 - DNA, 875 bp, Homo sapiens
  misc_feature: GYAE6OF01D5B3M.19.86.H09.1.454.CMB.1.raw
tcagtactctcgtgcacgaccggtgctcgatttagtgctatagacttgggtttggggagcatcacccagcaaaccacatctgtcctctagagaatcccctgagagctccgttcctcaccagtggactggaccgtggaggactcctcctcgttggtgcagcacgccgaccggacgcccactcccgaggtcgcagtcgtggtgcgacgttcggtcggggctggaggtacggaaggacgtccgggtcgggcctacgagtacggtacggttccgtaccgtcggacggttacggttcgttttacggaaccttacctaccgttacgtacgttacgttaaatttacgtaactaagttaacgttccgtttaccgggttggggtaccgaaccggaccggtacccgggtcccggtaaggaaccgggtaaccgggttggttacggtagggtacgggtaaagggtacgggtaccggtacgtacccggggttaaggggttggtacgggttggggtacccggcgtacgttaacggtttaccggacccgacgtaaacggttaaacggttacggttacccgggaccgggtaccctcgggtaaccctaacggtacggtaccggaccggtaaccgggttccccgaccgtaacctaaacggtaactaaccggtaggtttaacgtaacggtttacggtacggttacgttacggacgttccgaccggttagttacgggtacggtaccgtaaccggaccggtaccgaccggttcgttaagttagttactttacgtcgggtacggtaaccgggaagggtccgggaaaggggttccggaaaacgttaacggtacgttaaacgggttaaccgggttccggtaccccggggtaaacccggg

SEQ ID NO: 225825 - DNA, 758 bp, Homo sapiens
  misc_feature: GYAE6OF01B8Y2E.19.86.H09.1.454.CMB.1.raw
  modified_base (88)..(88): a, c, t, g, unknown or other
  misc_feature (88)..(88): n is a, c, g, or t
  modified_base (189)..(189): a, c, t, g, unknown or other
  misc_feature (189)..(189): n is a, c, g, or t
tcagtactctcgtgcacgaccggtgctcgatttagtgctatagacgttggggtttggggagcatcacccagcaaccacatctgtcctntagagaactcccctgagacgctccgttcctcaccatcggacgtcggaccgtgggaggtactccctccttcgttgggcggcaggcacgacccgaccgggacncccacctcccgaggtcgactggccgtggtgcgtacgtcgggtgggacgttagggaaggtagggaacggacgtccgggtacggggccttacgaggtaggaacggtctccggtagtacgtacggttcgtttagaactaacctactttactaatacttaattaatcctaaatttacgtccgttaggtggtaccgacgacgaaaccggtccgtaaggaaccggtaggtcgttagacgtggggaaggccggagtacgtcgtagggtggtagtagcgagactacgtacgtgtaacgaggtaagttaggtcggacgggccgtacgacctacggacggccggtaactaacggggtcccgtaacgttaacccgaaaacgtaacgtacgtaggttacgtaacggttaacgacgggtacgttaaccggaggacgttaacggtacccgttacgggaaacgtttcgacggaacccgtacggacggttactagttaacgtttagtcggtacggtaggtaggagggtacgacgggtacgtaagtaacgaagttaggaaacccggttcggcccgggtaacccggg

SEQ ID NO: 225826 - DNA, 731 bp, Homo sapiens
  misc_feature: GYAE6OF01CGWXW.19.86.H09.1.454.CMB.1.raw
tcagtactctcgtgcacgaccggtgctcgatttagtgctatagactttggggtttgggggagcatcacccagcaaccacatctgtcctctagagaatcccctgagagctccgttcctcaccatggactggacctggaggactcctcctcgttggtggcagcacgccaccggacgcccactcccgaggtgcgagtcgtggtcgcgagtcggtggggctggaggtggaaggcggccgtggggcctgaggtggtaacggtctcgtggcgtaggtcgtttggactactaccttacgagttctattactactattacgtacgtggtgggtcgacggtacgaccggtccgtaggaacggtaacgggtcgttaggaggtacgggaacggtcggggtacgtacgtccggtaacgggggttggttaggtcgggtcggcgtacgtacgtaccggtacgacgtacgtaggttaacggttcggacgggtccgtcgtaccacggtagtccgggacgtaacgggtccgtaccgtacgaaagtaacgttacgaggttagtacgtacggttaggtacgttacggacgacgtacggtaccgtgggtaacggttcgacggtaaccgacgtacgtacgtagttggttaacttggttcgggcggtaaccgggtagggtcgggaaacggggttaccggaaacgtaagggaccttaaagggttaacccggtcgggttaacccggtacccgggg

SEQ ID NO: 225827 - DNA, 860 bp, Homo sapiens
  misc_feature: GYAE6OF01BSRJR.19.86.H09.1.454.CMB.1.raw
tcagtactctcgtgcacgaccggtgctcgatttagtgctatagacttggggtttggggagcatcacccagcaaccacatctgtcctctagagaatcccctgagagctccgttcctcaccatggactggacctggaggactcctcctcgttggtggcagcacgccgaccggacgcccactcccgaggtcgcagcgtggtcgcgaggttcggtggggcgtggagggtaggaaggacggccggtggggtcctcgaggtacggtaacggtccgtcgtcggacggtacggttcgttttaggacttacctaccttacgtacgttactaatttactacgtaatacgttaccgtcggttcggggtcgaccggaccgtaccgggtccccgtagggaaccgtaagggtcgttaggaggtagggtaggtacggggcggtacgtccggtaaggggtggttaggtcggggtcgggacgtacgtacgtaccggtcgacgtaacgtacggttaacggttccgggaacggggtcccgtaccggtaccaacccgtacggtaccgggtaacccgtaaacggggtcccgtaaccggtaaccgtaaacggtaaaccgttaccggtaaggtttaacgtaagtttacgggtaccggttacgtttacggaaccggtcgtaacgggtccggtagggtaccgggttacgaacggtaacccggaccggtaaccggtcttaaaggtttacgttttaaacgttaggttttcgggaacgggtacgggaacgggtacgggggtaaccggggtaacggggtaacgtaaaacggggtacgttaaaagggtttaccggggtttacccgggtaccccggggtaacccccggggg

SEQ ID NO: 225828 - DNA, 715 bp, Homo sapiens
  misc_feature: GYAE6OF01AQ3T0.19.86.H09.1.454.CMB.1.raw
  modified_base (118)..(118): a, c, t, g, unknown or other
  misc_feature (118)..(118): n is a, c, g, or t
  modified_base (164)..(164): a, c, t, g, unknown or other
  misc_feature (164)..(164): n is a, c, g, or t
  modified_base (238)..(238): a, c, t, g, unknown or other
  misc_feature (238)..(238): n is a, c, g, or t
  modified_base (704)..(705): a, c, t, g, unknown or other
  misc_feature (704)..(705): n is a, c, g, or t
  modified_base (707)..(708): a, c, t, g, unknown or other
  misc_feature (707)..(708): n is a, c, g, or t
  modified_base (710)..(715): a, c, t, g, unknown or other
  misc_feature (710)..(715): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgtctgcaagcagctcgaacagtcgggancaggtggtgtgagtggtgtatcaagaaacgtccaggaaccgccccaaaactgtacatacgtataaactggaccnctggacggtccggttaccgttaacgggtcccttagaccgtactttcgtacgtcggcgaacggaggtcgtgggaccgtcctacacggttccttcccgtaggccctagtacgaaggcggtccacgtagtactgaacgatcggagtactaagtattttaacgtgtacgtaggaactaacgtgggtaggtactacggtaactaggtttcgggtaacggttacggggttaccggggtttccggggaacggggtaaccgggtaaccgtaaggccggttaaccggttaacccgtaaccgtaaacgggtacaacccggtaacccggtaagttacccggtacccgttacccccggtttaggttacccaccgtttacctcccgtttaccccgaccccttaccgtacccggaaggtaactacgggttacgcggtacggacggcgtacgggacacgggttaccacggatcggactggnnanncnnnnnn

SEQ ID NO: 225829 - DNA, 843 bp, Homo sapiens
  misc_feature: GYAE6OF01AYDJS.19.86.H09.1.454.CMB.1.raw
  modified_base (103)..(103): a, c, t, g, unknown or other
  misc_feature (103)..(103): n is a, c, g, or t
  modified_base (125)..(125): a, c, t, g, unknown or other
  misc_feature (125)..(125): n is a, c, g, or t
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
  modified_base (153)..(153): a, c, t, g, unknown or other
  misc_feature (153)..(153): n is a, c, g, or t
  modified_base (823)..(823): a, c, t, g, unknown or other
  misc_feature (823)..(823): n is a, c, g, or t
  modified_base (827)..(827): a, c, t, g, unknown or other
  misc_feature (827)..(827): n is a, c, g, or t
  modified_base (829)..(829): a, c, t, g, unknown or other
  misc_feature (829)..(829): n is a, c, g, or t
  modified_base (831)..(831): a, c, t, g, unknown or other
  misc_feature (831)..(831): n is a, c, g, or t
  modified_base (837)..(839): a, c, t, g, unknown or other
  misc_feature (837)..(839): n is a, c, g, or t
  modified_base (841)..(841): a, c, t, g, unknown or other
  misc_feature (841)..(841): n is a, c, g, or t
  modified_base (843)..(843): a, c, t, g, unknown or other
  misc_feature (843)..(843): n is a, c, g, or t
tcagtactctcgtgcacgaccggtgctcgatttagtgctatagacgttggggttttgggggcccgttcctgggcccagtctgtgctgactcgaggccaccctnagcgtcgtacgggacccccggnaggacgtcaccatccgtnttgttcnganaagcagctacgaacgtagtcgggagcgtaggtggtacgtggagttggtaggtaactaccggaaaaggtaaaccgtccccggaaacgggaaaccccgggaaccccccctaaagttccgtacaaacgttataaacgtaaacggtcgaccggtacgttacggaacggggtttacccggttaacccggtttaaccggggtcccctacggtaaacccgttttaagttacccgttacggtagggtaccggtaacgggttaaccgggttccgttaccggggacccggtacccgttactaacggttccccgttacccggttcgggaaccctaagttaacccggacgggacccgggttaccgttacccgtaacggtacggtaaccggtaaaattacgtagggacgtacgtttaagttaacgtttaagttttacgtagtacgtaacggtaacgttaggtaacggtagtacgaacggtttaggtacggtttaagggttaccggggtttacggtttcgggaacggggtacgtaaacggacggtaccgtaaccggtaccgtaaccggtagacgtaacgaccgacgtcccgcctaccggttcacctccgtaccgtacctccctaacccgtcctaacgacgtacgagtcgacggcgcgtagtaccggagtacgacaggtacgacngagngncnactagnnngngn

SEQ ID NO: 225830 - DNA, 844 bp, Homo sapiens
  misc_feature: GYAE6OF01DNQI3.19.86.H09.1.454.CMB.1.raw
  modified_base (455)..(455): a, c, t, g, unknown or other
  misc_feature (455)..(455): n is a, c, g, or t
tcagtactctcgtgcacgaccggtgctcgatttagtgctatagacttgggtttggggagcatcacccagcaaccacatctgtcctctagagaactcccctgagagcctccgttcctcaccgagtcggacgtcgggaccgtgggacggtactccttccgttcgttgggtggcacgcacggcccaaccggaccacccacctacccgaggtcgccagtccgtggtacgcgtacgttcgggtcggggcgtaggtagggtaaggaacgggccgttccgggtcgggtcccttacggagggttacgtaccggttcctcggtcggtacggtacggtttcgttttaacggtaacctacctaccgttaacgtacgttactattactactagttacgttacgtcggtaggtccgacgacgaccggtcccgaaggtacgacggtcgtagaggtacgaggtccggganacgtcggtagggtcgtagggtcggaggtccgaacgtcggtaccgcgaactacgtaacggtacggttccggaccgggttcgtaccctaccggacgtacggtaccggtacggtaccgggtacgtacccgaacgttaaacgaaagtccggttataacggttaccgttaacgttggtaacccgtaggaccgtaaccgacggtaccggtttacggaaccggttccggaaacgaccccgggtaaccgtaccgggttaccttaaggtttaacgtaacgtttttaggtccggtaacggtaacgggtaaccgggacggggtaaaccggggtaacgggttaaactaaacgggtataaaacccggggtttggttaccccgggtacccggtaacccggggg

SEQ ID NO: 225831 - DNA, 680 bp, Homo sapiens
  misc_feature: GYAE6OF01CUQLK.19.86.H09.1.454.CMB.1.raw
  modified_base (212)..(212): a, c, t, g, unknown or other
  misc_feature (212)..(212): n is a, c, g, or t
  modified_base (371)..(371): a, c, t, g, unknown or other
  misc_feature (371)..(371): n is a, c, g, or t
tcagtactctcgtgcacgaccggtgctcgatttagtgctatagacttgggtttggggagcatcacccagcaaccacatctgtcctctagagaatcccctgagagctcgttcctcacattgactggactggaggatcctcctcgttggtggcagcagccaccggagcccactcccaggtgcagctggtgcagtcgtggggctgaggtgaaggngccgtggggcctgagtgaaggtctccgtggcggtaggtcttttaggatacctcttcagtctattatcgatatactgtagggtgacgtacgcggccccttaggaccgaagggtcttaggagtagggagtaaggggcggagtccgtacggtggttaacggngggttcggacgtaccgtaaagtccgggttacggaccaaagagggtaaacggttttccgacggggacccggtcggtaccaaccgaagttcggaacccgtaagggtcccgtacggtaccgaaacgaacgtaacgtaggttagtaacggtagtgggtaaaccgttgacgacgagccgtaggaacgtcgtagacgacgacgggcctagtgtaacgttattaggtcggacgggttaggacccggaaggggtaaccggggtaacgttaaacgggacaaggtttaaagggtaccggttcccggtaaacccccgggg

SEQ ID NO: 225832 - DNA, 711 bp, Homo sapiens
  misc_feature: GYAE6OF01EFFLD.19.86.H09.1.454.CMB.1.raw
  modified_base (98)..(98): a, c, t, g, unknown or other
  misc_feature (98)..(98): n is a, c, g, or t
  modified_base (105)..(105): a, c, t, g, unknown or other
  misc_feature (105)..(105): n is a, c, g, or t
  modified_base (118)..(118): a, c, t, g, unknown or other
  misc_feature (118)..(118): n is a, c, g, or t
  modified_base (158)..(158): a, c, t, g, unknown or other
  misc_feature (158)..(158): n is a, c, g, or t
  modified_base (275)..(275): a, c, t, g, unknown or other
  misc_feature (275)..(275): n is a, c, g, or t
  modified_base (678)..(678): a, c, t, g, unknown or other
  misc_feature (678)..(678): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
  modified_base (694)..(694): a, c, t, g, unknown or other
  misc_feature (694)..(694): n is a, c, g, or t
  modified_base (697)..(697): a, c, t, g, unknown or other
  misc_feature (697)..(697): n is a, c, g, or t
  modified_base (702)..(702): a, c, t, g, unknown or other
  misc_feature (702)..(702): n is a, c, g, or t
  modified_base (708)..(708): a, c, t, g, unknown or other
  misc_feature (708)..(708): n is a, c, g, or t
  modified_base (711)..(711): a, c, t, g, unknown or other
  misc_feature (711)..(711): n is a, c, g, or t
tcagtactctcgtgcacgaccggtgctcgattttagtgctatagacttgggtttgggggccgttcctgggcccagtctgtgctgactcaggcaccctnagcgtcncgggacccccggnagacggtcaccatcgcttgttctgcaagcagctacgaacngtcgggatcgagtggtatgattgtggtatcaagaacgtcccgaggaacccgaccccctaaagtcgtacactactaataatgacctctgacgtcgttaccgttacggcctagaccgtnttcgcgtggacgaggtacggtcctcggccgtcctacgacgtcccgttccccgtaggacccctagttaccggaacgggtaaccgggttccttacccggtacggttaccgtaggtaaaggtacggtagggaacgggtcttaagttaacgttttaacgttacggtgtacgaacccttaaggttccggttaggacttacgtaacggtaggttacgggttacggggttaacccgggtttcccggggtttacgggacgggtacggtaccgtaagtaccgtaccgtaaccgtacgtaacgtacgaccggacctaggtccctacccgtcccgttacgtccttaccgtccttacccgtcccctaccgtcgtaaccgaggtaccgtcggtcgcggtacgtcgacggacgacgnaccgatacggntnctnacngtacnagctgntgn

SEQ ID NO: 225833 - DNA, 756 bp, Homo sapiens
  misc_feature: GYAE6OF01BHHL5.19.86.H09.1.454.CMB.1.raw
  modified_base (164)..(164): a, c, t, g, unknown or other
  misc_feature (164)..(164): n is a, c, g, or t
  modified_base (737)..(737): a, c, t, g, unknown or other
  misc_feature (737)..(737): n is a, c, g, or t
  modified_base (741)..(741): a, c, t, g, unknown or other
  misc_feature (741)..(741): n is a, c, g, or t
  modified_base (745)..(745): a, c, t, g, unknown or other
  misc_feature (745)..(745): n is a, c, g, or t
  modified_base (749)..(750): a, c, t, g, unknown or other
  misc_feature (749)..(750): n is a, c, g, or t
  modified_base (752)..(753): a, c, t, g, unknown or other
  misc_feature (752)..(753): n is a, c, g, or t
  modified_base (755)..(756): a, c, t, g, unknown or other
  misc_feature (755)..(756): n is a, c, g, or t
tcagtactctcgtgcacgaccggtgctcgatttagtgctatagacttgggtttgggggccgttcctgggcccagtctgtgctgactcaggcaccctcagcgtctcgggaccccggcagacggtcaccatcgcttgttctgcaagcagctacgaacagtcgggancaggtggtgtgatgtggtatacgaagtaaacgtcccgaaggaacccgccccaaatcgtacatctaataatcgacgctaggagtccggttccttaacgggtccctgaccgtacttctcgtaggacgagtacggtcgtggccgacccttcgacgtcctttcccgagggtacctagttccgaacgggcggtaccctcccgtaaggtttccgaggtaaaggtacgtagggaacggttccttaggttaacttttaacgtttacgtacggtttacgaacggtaacttggtaagggtaccgtagtaaaccggtaggtttacgttaacccggggttaaccggggttttcccggttttaacgggggaccgggaaaccgggttaccgtaacggtccgtaccggtacccgttaaccgtacgtacccgtaccggaccgtaacggtcccgtaccgttacccccgttgggaccccttacgttcccgttcccgttaccccacccgttccctaacccgacggtacggtaccgtaccgtagggccgggtaccggacggttcggaacgaccggaccgtacgtaacggtgancggnacgngctnnanngnn

SEQ ID NO: 225834 - DNA, 540 bp, Homo sapiens
  misc_feature: GYAE6OF01C20ZE.19.86.H09.1.454.CMB.1.raw
  modified_base (185)..(185): a, c, t, g, unknown or other
  misc_feature (185)..(185): n is a, c, g, or t
  modified_base (291)..(291): a, c, t, g, unknown or other
  misc_feature (291)..(291): n is a, c, g, or t
  modified_base (501)..(501): a, c, t, g, unknown or other
  misc_feature (501)..(501): n is a, c, g, or t
  modified_base (509)..(540): a, c, t, g, unknown or other
  misc_feature (509)..(540): n is a, c, g, or t
tcagtactctcgtgcacgaccggtgctcgatttagtgctatagacttgggcttgagtggatagggcggatccacggtggtagtggtggcgcatacgtcgcacagaagtttcgagggccgcgtcaccatggccaaggtcgccgtccaacgaatacagtgtatatggacttgagcagcctgaggtcnggacgacgacgcctatgtattatgtgcgaggcgagggacggggataaagctaagtaagtcggtccgacccgtggggccagggaaccctggccaccgtctcctcacnccctaccaccgaacgggtccccaggttcccggtcccgttttccccccgggacccgtcccctacgcccgtccgaggacgcccaccctaccggagaccgccaacgccggccgggcccgtgggacctcggcctcggtacgaaacggtacccttaccgttacccaacgggagtaaccgtagttcggacggcgggtcgtacggacgtaggccganaagtacgnnnnnnnnnnnnnnnnnnnnnnnnnnnnnnnn

SEQ ID NO: 225835 - DNA, 767 bp, Homo sapiens
  misc_feature: GYAE6OF01EKW9O.19.86.H09.1.454.CMB.1.raw
tcagtactctcgtgcacgaccggtgctcgatttagtgctatagacttggggtttggggagcatcacccagcaaccacatctgtcctctagagaactcccctgagagctcccgttcctcaccatggactggaccgtggaggactcctcctcttgggtgcagcagccaccggacgcccactcccgaggtgcagctggtcgcgaggtcggtggggctggagggtaggaagggacggtccggtcgggggccttcgaggttacggaacggttcctccgtggccggtagggttcgttttacggacttacctacctttacgacgttctatttactctaattacttacgttcggtggggtcgacggacgaccggtcccgtagggacgtaaggtcgttaggagtggagtacggggacgtacgtaccggtacgggtgggtaggtcgggtcgggacgtacgtagttaccggtcgactaacggaggttaacggttcggacgggccgtacgttaccaacgtcggtacgggacccgtaacggggtcccgtaccgtacccgaaacggtaaactaccgtaagggtttacgtaacgttaggttacgggtaacttacggacgtacgacggtccggtagggacgggttacacgggaccgaaccggacggtaccaaggttagtttacttaggttcggtaggacgggacgggtcgggaagggtaccggggaacgttaaacgggacggttaaaggtttaacggggtcgggtaccccgggtaacccgggg

SEQ ID NO: 225836 - DNA, 524 bp, Homo sapiens
  misc_feature: GYAE6OF01D5OHO.19.86.H09.1.454.CMB.1.raw
  modified_base (453)..(453): a, c, t, g, unknown or other
  misc_feature (453)..(453): n is a, c, g, or t
  modified_base (511)..(511): a, c, t, g, unknown or other
  misc_feature (511)..(511): n is a, c, g, or t
  modified_base (514)..(524): a, c, t, g, unknown or other
  misc_feature (514)..(524): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcaagaaagtcccaggaaccggcccccaaatcgtcatctataatgacgctgagcggtccttaagggtccctgaccgattctctggcgagaggtctggcgcctcagccttcctggccatcagagggctccagtctgaagatgaggctgtattattactgtgcaatcgtggatgaacagtgtagtacgggttccggttttcggcggagggaccaagctcgaaccgtctaagtcagacccaaggcctcgcccctcggtaccactctcgttccccnccctcctccacgagtacgtacgtgaggccgggctcggacgaaaggcgtacaagtagancgnnnnnnnnnnn

SEQ ID NO: 225837 - DNA, 718 bp, Homo sapiens
  misc_feature: GYAE6OF01DEC97.19.86.H09.1.454.CMB.1.raw
  modified_base (270)..(270): a, c, t, g, unknown or other
  misc_feature (270)..(270): n is a, c, g, or t
  modified_base (374)..(374): a, c, t, g, unknown or other
  misc_feature (374)..(374): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctggagggtgaaggagccgtggggcctcgaggtgaaggtctccgtgcgaggtcttttggatacaccttnagtctattatcatatactcgtgggtgcgacgtacggccctggacgaaggggtctaggaggtggaagtagggacggtagtccgacgggtggtaaggtgggtcggngcgtacgtacgtcgcacgtagtaacggtttcgagggccgtcggtcaccagtcggtaccgaacgggtccgacgtacccgaacgaactactaggtacttaagtagttggtaacctttaggacgacgtaagtcccggtaggtaacgggtcgtacggaaccggtaaccgacggtacccgtaagtttgggtaaacttttacggttagggttaacggtaccggggtacgggtaacccgggtaaacggggggtaaacccggggggtaacggtttaaaaccgggggtaacgttaaaacgggtttaaaacgggggtttcccgggttaaccccggggtaaacccccccgggggg

SEQ ID NO: 225838 - DNA, 770 bp, Homo sapiens
  misc_feature: GYAE6OF01DB85D.19.86.H09.1.454.CMB.1.raw
tcagtactctcgtgcacgaccggtgctcgatttagtgctatagacttgggtttggggagcatcacccagcaaccacatctgtcctctagagaactcccctgagacgccttcccgttcctcaccatggactcggaccgtggagactccctccttcgttggtgcagcacgccgaccggacgccccacctcccgaggtcgcagcgtggtcgcgtagtcggtggggctgggaggtaggaacgggcggtccggtcgggcctacgaggtagtacggtcctcgtggacggtaggttcgttttacgactaacctacctactagttacctaattatctaactattacgtcggtgggtacgccgaacgacccggtcccgtaggaaccggtagggtcgttaggacggttagggaggtacgggacggacgtcggtaggggttggtaggtcgggtacggctactacggtacgcgacgagtaggttacggttcggccgggactcgtaccaacgtcggtaccggaccggtaacggtcccgtacgtaaccgaaacgttaactagttagttaagttacgtcggtaacggttcgttaggccgtacggtagacccggttaggtaaccggtacgtacggaaccggtaccgaccggtagttaaagttttacgtacggtttagtcggaacgggaccgggttaagggaccggggaacgggggtaaaccggtacgtaaacgggttaataaaccggggtttacgggttccggtacccccggggtaaccccggggg

SEQ ID NO: 225839 - DNA, 906 bp, Homo sapiens
  misc_feature: GYAE6OF01EV0FF.19.86.H09.1.454.CMB.1.raw
  modified_base (162)..(162): a, c, t, g, unknown or other
  misc_feature (162)..(162): n is a, c, g, or t
tcagtactctcgtgcacgaccggtgctcgatttagtgctatagacttgggtttgggggagcatcacccagcaaccacatctgtcctctagagaatcccctgagagctccgttccctcaccatggactacggaccgtggaggactcctcctcgttggtggacncgtcacgccgtaccggacgcccgactcccgagtcgcgtgcgtggtgacagtctggggcctaggcggtgaacggacgtccgtagggccctacgtacggtcgaacgtccgtccgtggacggaaggttcgttttcggtaacttaaccgtacccgtttacgaacggttaactacgtttaaccgtaccgtaaattaaccgttaccgttaaccggtttcggggttaacgaccggtaacccggtaaccgggtaccccggttaacgggtaaccgtaaagggttcgtttaacgggtaaggttaccgggaggttaaacggggtccgggtagtaacccggtaggggttacggttaggtgggttccgggacgtcgtaaacgttcggtccgtacgtaaaccggtaaggttaaccggtttaccgaccgggggtacccgtaccgggtacccgtaacccgttacggtaccgggtacccgtaacggggttacccggaccgttaacccggaacggtaaaaccgttaacgggtacgttaggttaacgttaaacgttcgggtaccgtttgtaaccgcggtaaccgtacccgttaggtcggtccgtaaccggtccgaaccggtacggtaccagttacgttaaacgttacggtttaggaccggttagggtaccgggacggttaacccgggaacggggtaaacccctaaaggggttacccgaaagggttaaaccgggttttcggaaccccggggttaaaccccgggg

SEQ ID NO: 225840 - DNA, 898 bp, Homo sapiens
  misc_feature: GYAE6OF01ADUJ9.19.86.H09.1.454.CMB.1.raw
  modified_base (759)..(759): a, c, t, g, unknown or other
  misc_feature (759)..(759): n is a, c, g, or t
tcagtactctcgtgcacgaccggtgctcgatttagtgctatagacttgggtttggggagcatcacccagcaaccacatctgtcctctagagaatcccctgagagcctccgttcctcaccagtggacgtgaccgtggaggtactccctccttacgttgggtcggcagacacgcccgaccgggaccgccctaccttacccgaggttcgcgagccgttgggtcgcgtacggttcggttacggggcgttacgggacgggtacggaaacgggtccggtccgggttccgggggaccttccggtagggttacgggtaaccggttcccgttccggtacggtacgggttacgggtttccgttttaacggtaccttaacccgttaccgtttacgtacggttacttaagtttactaccgttaagttaccgttacggttccgggttggggtaccgaccggtaaaccgtcccgggtaccccggttaggtaacccggggtaacgggtttccgttaacgggtagggttaggggtaaaccgggttacggggggtaacccggtcggtaacccgggtagggggttacggggtttacgggttgggggtaccgacggttaccgtaaccggtaccggcgtaccgtaaacggttccggttaaacggtttccggaccgggggtaccccgtacgttacccgaccgttaacgggtccgggtaacgtacgggttcccgaccgtaccgtaacggtaactacggtagtaacgttcgtagtagttacngtaccgacgcgtgcggtcgtcggaacgtcgaacgtcgtacgtagtgttacgttgcggttacggacggtacggcggtacgggggtaacgaaaccgtaggaaacgttaaggttaccggtccgggtaacccggtacccgggg

SEQ ID NO: 225841 - DNA, 678 bp, Homo sapiens
  misc_feature: GYAE6OF01DTAE8.19.86.H09.1.454.CMB.1.raw
  modified_base (186)..(186): a, c, t, g, unknown or other
  misc_feature (186)..(186): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggacgccccactcccaggtncagctggtcgcagtcgtggggctggaggtagaaggagccgtgggcctcgagtgaagtctcgtgcgaggtctttggaataccgaccttcacgtctattatctaatatacgtcgtgggtcgacgacgacggtccccgtaggacggaaggtcttaggaggtaggacgtagggcgactccggacgggtggtaggtgggtggcgtacgtaacgtacggtccgacgacgtaacggtaacgtttcggacgggtcccggtaccgtccgtaaacccgtacgtaccggtaaccggtaacgggtccggtacccggtaccgtaaccgtaacgtaacgtaggtaacgttataacggtttacggacgtttacgaggtaccacggtccggtagtggtacgtacgaaccggccgaacgcgtagttacgttattaacgttggtagacgggaggtaccgagggaacggggtacctaaaagggactaaaggtaacggtaggttaccccggg

SEQ ID NO: 225842 - DNA, 867 bp, Homo sapiens
  misc_feature: GYAE6OF01D1WVW.19.86.H09.1.454.CMB.1.raw
  modified_base (60)..(60): a, c, t, g, unknown or other
  misc_feature (60)..(60): n is a, c, g, or t
  modified_base (221)..(221): a, c, t, g, unknown or other
  misc_feature (221)..(221): n is a, c, g, or t
tcagtactctcgtgcacgaccggtgctcgatttagtgctatagacttgggtttgggggancatcacccagcaaccacatctgtcctctagagaactcccctgagagcttccgttcctccaccatggactggacctgggaggactcccgtcctcgttgggtcggcagcaggccccaccgggacgacccccacctaccccagggttcgcgacgtcgtggtacncgtaggttcggtggggtcgagggtagggtaggaacgggccggtcccgggtcggggtacccttcgtaggtaacggtaccggtcctccggtaggccggtaggtttcgttttacggacttacctaccgtttcgacgttacttaatttctactaagtttacgttacgttcggttacggggtaccgacgtaccggcccgggtaacccgtgggtaaacgacgggttcggttaggtaggagggtaacgggtacgggacggtacgtccggaggttaggtcggttaggcggtacggtcagtaccgaccgtcaacggtagtaacgtttcggacgggtacccgtacggtaccacgtaccggtaccggacgtaccggccggtacccgtaaccgtaaacgacttaacgtacggttagtaacgttaggttacggtagtacggacgttcgaccggtccgttaagggtaccggtaccgtacggaacccggtacggttacccggtacgttaggtttaacggttacgttttaccggtagggaccgggtaaccggggtcggggaaaccgggttaacggggggtagggtaaaacccgggtttaaacggaaaggttaaacccgggtttaaaggggtcccccggtttaaccccggggtaccccggggg

SEQ ID NO: 225843 - DNA, 880 bp, Homo sapiens
  misc_feature: GYAE6OF01BTW5H.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggactcctcctcttgggtggcagcacgcccaccggacgcccactcccgaggtgcaggctggtgctgtcgtggggctaggaggtagaaggcgtccggtggggcctcgaggtaggtacggtcctcgtggcggtaggttcgttttaggacttacctccttcgagttacctattactactaattacttaccgttcggttaggggtacgaccggtaccgtacccgggtccccgtagggaacggtaacgggttcgttagggtacgggtgggtacggtacgggggaccgtacgtaccgggtacggggtagggttgggtcgggtacgggtccgtacgtaacggtaccgggtccacgtaacggtacggttaacggtttccggacggggtacccgtcgtaccgacctagggtccgggaaccgtaacggggttcccggaccgttaacccgaaacgtaacgtacgtacggtttaaggtacttacggtggttaccgttaggacgtaccgtaccggtaccgtaggttaccgggtccttacgggaaccccgtaccggtacccggtaccttaaggtttcgtttaacggttttaggttaccggggaacgggttacggggtaaacccggggtgggggtaaaacccggggggggtaaccccgggtttaaaccggttaaaaacggggtaccgggtttaaaaaccggggtttaccgggggttttacccccggggggtaaaccccccggggtaaccccccgggggggg

SEQ ID NO: 225844 - DNA, 492 bp, Homo sapiens
  misc_feature: GYAE6OF02IO8JT.19.86.H09.1.454.CMB.1.raw
  modified_base (481)..(492): a, c, t, g, unknown or other
  misc_feature (481)..(492): n is a, c, g, or t
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtcccctgaccgattctctggcgagaggtctgtcgcctcagcttccctggccatcagagggctccagtctgaagatgaggctgattattactgtgcaatctgggatgacagtgtgaacggtcggtttcggcggagggacaagctgaccgtcctaagtcagcccaaggctgcccctcggtcactctcgttcccaccctcctccacgagagtactgagcgggctggcaaggcgcagtagnnnnnnnnnnnn

SEQ ID NO: 225845 - DNA, 500 bp, Homo sapiens
  misc_feature: GYAE6OF02H39OH.19.86.H09.1.454.CMB.1.raw
  modified_base (340)..(340): a, c, t, g, unknown or other
  misc_feature (340)..(340): n is a, c, g, or t
  modified_base (486)..(490): a, c, t, g, unknown or other
  misc_feature (486)..(490): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (497)..(499): a, c, t, g, unknown or other
  misc_feature (497)..(499): n is a, c, g, or t
tcagtactctcgtgcacgaccggtgctcgatttagtgctatagacttggggtttggggccgttccgtgggcccagtctgtgctgactcgaggcaccctcagcgtctgggacccccgggcagacggtcacccatcgcttgttctgcaagcagctcgaacatcgggagcagtggtgtgatgtggtatcagaaagtcccaggaacggccccaaactcgtcatctataatgacgctgagcggtccttaagggtccctagaccgattctctggccgagaggtctggcgcctcagcttccctggccatcagagggctccagtctgaagatgaggctgattattacngtgcaatctgggatgacagtgtgaacggtccggttttcggcggagggaccaagctggaccgtctaagtcagccaaggctgcccctggtcactctgttcccacctctccacgagagtactgagtcgggcgtggcaaggcgcagtagnnnnnctncngnnnc

SEQ ID NO: 225846 - DNA, 492 bp, Homo sapiens
  misc_feature: GYAE6OF02F5Z0Z.19.86.H09.1.454.CMB.1.raw
  modified_base (453)..(453): a, c, t, g, unknown or other
  misc_feature (453)..(453): n is a, c, g, or t
  modified_base (484)..(492): a, c, t, g, unknown or other
  misc_feature (484)..(492): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctcgcccctcggtcactctcgttcccgccctcctccacgngacgtactgagcggctggcaggcgcagtagnnnnnnnnn

SEQ ID NO: 225847 - DNA, 491 bp, Homo sapiens
  misc_feature: GYAE6OF02FSGHD.19.86.H09.1.454.CMB.1.raw
  modified_base (436)..(436): a, c, t, g, unknown or other
  misc_feature (436)..(436): n is a, c, g, or t
  modified_base (478)..(479): a, c, t, g, unknown or other
  misc_feature (478)..(479): n is a, c, g, or t
  modified_base (481)..(491): a, c, t, g, unknown or other
  misc_feature (481)..(491): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccagctgaccgtcctaagtcagcccaaggctgcccctgtcactctcgttcccncctcctccacgagacgtactgagcggctggcaggcgcagtgnngnnnnnnnnnnn

SEQ ID NO: 225848 - DNA, 305 bp, Homo sapiens
  misc_feature: GYAE6OF02ITKOI.19.86.H09.1.454.CMB.1.raw
  modified_base (298)..(305): a, c, t, g, unknown or other
  misc_feature (298)..(305): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgactggtcaaggactacttcccacgagagtactgagcgggctggcaaggcgcatagnnnnnnnn

SEQ ID NO: 225849 - DNA, 529 bp, Homo sapiens
  misc_feature: GYAE6OF02I9U1T.19.86.H09.1.454.CMB.1.raw
  modified_base (166)..(166): a, c, t, g, unknown or other
  misc_feature (166)..(166): n is a, c, g, or t
  modified_base (371)..(371): a, c, t, g, unknown or other
  misc_feature (371)..(371): n is a, c, g, or t
  modified_base (480)..(480): a, c, t, g, unknown or other
  misc_feature (480)..(480): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (525)..(526): a, c, t, g, unknown or other
  misc_feature (525)..(526): n is a, c, g, or t
  modified_base (529)..(529): a, c, t, g, unknown or other
  misc_feature (529)..(529): n is a, c, g, or t
tcagtactctcgtgcacgaccggtgctcgatttagtgctatagacttggggtttgggggccgttcctgggcccagtctgtcgctgactcaggcacccctcagcgtctgggacccccgggcagacggtcaccatcgcttgttctgcaagcagctcgaacatcgggancagtggtgtgatgtggtatcagaaagtcccaggacgccccgaaatcgtcatcctataatgacgctgagcggtccttaagggtccctgaccgattctctggcgagaggtctaggcgcctcgacggccttcccgtggcccatcgacggagggctccgaggtctgaaacgatgaggctgacttatactgtgcaagtctgggatgacgngtgtcgtaacggttccgtttcggcggaggaccaagctagaccgtcgtagcagcccaaggcctcgcccctggtcactctcgttccccaccttcctccacgtagacgtacngacgcggctggcaagggcgcgagtacgcgtgntnagtanctgngnngan

SEQ ID NO: 225850 - DNA, 491 bp, Homo sapiens
  misc_feature: GYAE6OF02IJ8PL.19.86.H09.1.454.CMB.1.raw
  modified_base (263)..(263): a, c, t, g, unknown or other
  misc_feature (263)..(263): n is a, c, g, or t
  modified_base (474)..(474): a, c, t, g, unknown or other
  misc_feature (474)..(474): n is a, c, g, or t
  modified_base (480)..(491): a, c, t, g, unknown or other
  misc_feature (480)..(491): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgaccgcggtccttaagggtcccctgaccgattcnctggcgagaggtctggcgcctcagcttccctggccatcagagggctccagtctgaagatgaggctgattattactgtgcaatctgggatgacagtgtgaacggttcggtttcggcggagggacaagctgaccgtctaagtcagccaaggctcgcccctggtcactctcgttcccgccctcctccacgagagtactgagcggctggcaggcncagtgnnnnnnnnnnnn

SEQ ID NO: 225851 - DNA, 495 bp, Homo sapiens
  misc_feature: GYAE6OF02H1NFS.19.86.H09.1.454.CMB.1.raw
  modified_base (484)..(495): a, c, t, g, unknown or other
  misc_feature (484)..(495): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaactcgtcatctataatgacgctgagcggtccttaagggtccctgaccgattctctggcgagaggtctggcgcctcagcttccctggccatcagaggctccagtctgagatgaggctgattattactgtgcaatctgggatgacagtgtgaacggtccggttttcggcggagggaccaagctgaccgtctaagtcagcccaaggctgcccctcggtcactctgttcccgccctcctcccacgagacgtactgacgcgggctgggcaggcgcagtagnnnnnnnnnnnn

SEQ ID NO: 225852 - DNA, 554 bp, Homo sapiens
  misc_feature: GYAE6OF02GUZX9.19.86.H09.1.454.CMB.1.raw
  modified_base (468)..(468): a, c, t, g, unknown or other
  misc_feature (468)..(468): n is a, c, g, or t
  modified_base (528)..(528): a, c, t, g, unknown or other
  misc_feature (528)..(528): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
tcagtactctcgtgcacgaccggtgctcgatttagtgctatagacgttgggtttgggggaccgttcctgggcccagtcgtgtgctaggaactcagggcacccctcacgcgtctgggacccccgggtcagacggttcacccatcggcttgttcctggcaagcgagctcgaacatcgggagcagtcggtgtgactgtggtatcagtaaagtcccgaggaacggcccccaaactccgtcatctataatgacgctgagcggtccttaagggccctgaccgattctctggcgagaggtctgggtcgaccgtcagacttccctggccatccagaggctccagtcctgagatgaggctggattagtactgtgctaatcgtgggatgacagtgtagaacggttcggtttacggcgtagggtaccaagctgaccgtctagtcagtccaaggctcgccctggtcactctacgttcccnccttccgtccacgtagacgtactagacgtcgggctaggaccgaagggtcgacgagtaggntacacgtacagtntagcncncncntn

SEQ ID NO: 225853 - DNA, 469 bp, Homo sapiens
  misc_feature: GYAE6OF02H5CQB.19.86.H09.1.454.CMB.1.raw
  modified_base (342)..(342): a, c, t, g, unknown or other
  misc_feature (342)..(342): n is a, c, g, or t
  modified_base (432)..(469): a, c, t, g, unknown or other
  misc_feature (432)..(469): n is a, c, g, or t
tcagtactctcgtgcacgaccggtgctcgatttagtgctatagacttggggtcgttgagtggataggggcggatccacggtggtagtggtggcgcatacggtcgccacagaagtttcagggcccgcggtcaccatggccaaggtcgcgtcccacgaatacagtgtatatggacttgagcagcctgaggtctgacgacacggccatgtattatgtgcgaggcaggacggggctaaaagggcaataaagtggttccgaccctggggccaggggaccctggtcaaccgtctcctcagcctcaccaagggcccatcggccttccccctggcgccctgctccaggancactccgagagcacgagcggccctgggctgcctggtcaaggctactcccacgagagtactgagcgggctaggcaagggcgacgagtaggnnnnnnnnnnnnnnnnnnnnnnnnnnnnnnnnnnnnnn

SEQ ID NO: 225854 - DNA, 696 bp, Homo sapiens
  misc_feature: GYAE6OF02JFADI.19.86.H09.1.454.CMB.1.raw
  modified_base (163)..(163): a, c, t, g, unknown or other
  misc_feature (163)..(163): n is a, c, g, or t
  modified_base (316)..(316): a, c, t, g, unknown or other
  misc_feature (316)..(316): n is a, c, g, or t
  modified_base (592)..(592): a, c, t, g, unknown or other
  misc_feature (592)..(592): n is a, c, g, or t
  modified_base (686)..(696): a, c, t, g, unknown or other
  misc_feature (686)..(696): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtattcgaagtaaccgtccgaaggaccccgaaccctaacgtcgtacactactaatagtcgacgtcgtaggacggtccggttaacggttaaccgggtccctacggaccgttattccgtcgtcggacgaggtacgttcgngggcccctcctacgacgttccctttccggcggaccctatcggaaggcgggtccctacgtacggttcaaggaacgtgtagggacggtctaggttatttaacttcgtggtcaactacgttcgggaggtatcgaacgtggttagtaacgggtaacccgggttttccgggttacggggacgggtacgaaccgtagtcggtaccgtaccggttacgttacgacgaccgacccggagtccgccccgtcccgtaggtacctaccgttcgtacccgtacccccnccccttcccgtaccgaacggtacggttaaccgtacggtacgggaccgggttcgggtaccgtacggggaacgaccgggccaagtacgtaagcagnnnnnnnnnnn

SEQ ID NO: 225855 - DNA, 498 bp, Homo sapiens
  misc_feature: GYAE6OF02IQ1SZ.19.86.H09.1.454.CMB.1.raw
  modified_base (486)..(498): a, c, t, g, unknown or other
  misc_feature (486)..(498): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgagatgaggctgattattactgtgcaatctggatgacagtgtgaacggtccggttttcggcggagggaccaagctgaccgtctaagtcagcccaaggctcgcccctcgtcactctcgttcccaccctcctccacgacgacgtactgacgcgggctggcaaggcgcacgtagnnnnnnnnnnnnn

SEQ ID NO: 225856 - DNA, 498 bp, Homo sapiens
  misc_feature: GYAE6OF02F6SCQ.19.86.H09.1.454.CMB.1.raw
  modified_base (486)..(498): a, c, t, g, unknown or other
  misc_feature (486)..(498): n is a, c, g, or t
tcagtactctcgtgcacgaccggtgctcgatttagtgctatagacttggggtttggggggccgttcctgggcccagtctgtgctgactctaggcaccctcagcgtctgggacccccgggcagacggtcaccatcgcttgttctgtcaagcagctcggtaacatcgggagctagtggtgtgatgtggtatcagaaagtcccagggaacggccccaaagtcgtcatctataatgacgctgagcggtcttaagggtcctgaccgattctctggcgagaggtctggcgcctcagcttccctggccatcagagggctccagtctggaagatgaggctgattattactgtgcaatctgggatgacagtgtgaacggtcggtttcggcggagggacagctgacgtctaagtcagccaagctcgcccctcggtcactctcgttcccaccctcctaccacgacgagtactgacgcggctcggcaggcgcagtagnnnnnnnnnnnnn

SEQ ID NO: 225857 - DNA, 482 bp, Homo sapiens
  misc_feature: GYAE6OF02FQ4AX.19.86.H09.1.454.CMB.1.raw
  modified_base (474)..(482): a, c, t, g, unknown or other
  misc_feature (474)..(482): n is a, c, g, or t
tcagtactctcgtgcacgaccggtgctcgatttagtgctatagacttgggtttggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggccaagctgaccgtctaagtcagcccaaggctgcccctggtcactctgttcccgcctctccacgagagtactgagcgggctggcaggcgcatagnnnnnnnnn

SEQ ID NO: 225858 - DNA, 505 bp, Homo sapiens
  misc_feature: GYAE6OF02IQ9VL.19.86.H09.1.454.CMB.1.raw
  modified_base (494)..(505): a, c, t, g, unknown or other
  misc_feature (494)..(505): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaaagtcccaggaaccggcccccaaaatcgtcatctataatgacgctgagcgggtccttaagggtccctgaccgattctctggcgagaggtctggcgcctcagcttccctggccatcagagggctccagtctgaagatgaggctgattattactgtgcaatctgggatgacagtgtgaacggtcggtttcggcggtagggaccaagctgaccgtctaagtcagcccaagactcgcccctcggtccactctcgttccgccctctccacgagacgtactgagcgggctcggcgaaggcgacacgtaggacnnnnnnnnnnnn

SEQ ID NO: 225859 - DNA, 487 bp, Homo sapiens
  misc_feature: GYAE6OF02JC21X.19.86.H09.1.454.CMB.1.raw
  modified_base (477)..(487): a, c, t, g, unknown or other
  misc_feature (477)..(487): n is a, c, g, or t
tcagtactctcgtgcacgaccggtgctcgatttagtgctatagacttgggtttgggggccgttcctgggcccagtctgtgctgactcaggcaccctcagcgtctgggatccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtcggttttcggcggagggaccaagctgaccgtctaagtcagccaaggctgcccctcgtcactctcgtcccgccctcctccacgagacgtactgagcggctgcaggcgcagtagnnnnnnnnnnn

SEQ ID NO: 225860 - DNA, 435 bp, Homo sapiens
  misc_feature: GYAE6OF02FOC43.19.86.H09.1.454.CMB.1.raw
  modified_base (426)..(435): a, c, t, g, unknown or other
  misc_feature (426)..(435): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaacccctggtcaccgtctcctcagcctccaccaaggggccccatcggtcttccccctggcgcccctgctccaggacgcacctccgagagcacagcggccctggggctgcctggtcaaggactacttcccacgagagtactgagcgggctgggcaagggcgcataggnnnnnnnnnn

SEQ ID NO: 225861 - DNA, 423 bp, Homo sapiens
  misc_feature: GYAE6OF02FMFFV.19.86.H09.1.454.CMB.1.raw
  modified_base (417)..(423): a, c, t, g, unknown or other
  misc_feature (417)..(423): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgcccctgctccaggagcacctccgagagcacagcggccctgggctgcctggtcaaggctacttcccacgagagtactgagcgggctggcaaggcgcatagnnnnnnn

SEQ ID NO: 225862 - DNA, 572 bp, Homo sapiens
  misc_feature: GYAE6OF02HITZU.19.86.H09.1.454.CMB.1.raw
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
tcagtactctcgtgcacgaccggtgctcgatttagtgctatagacttgggtttgggggccgttcctcgggcccagtctgtgctgacttcaggcaccctcagcgtctgggacccccgggcagacggtcaccatcgcttgttctggcaagcagcttcgaactatcgggagcagtggtgtgatgtggtatcagaaagtccgaggaacggccccgaaatcgtcatcgtataatgacgctgagcggtccttaagggccctggaccgattactcttggccgagaggttctcggcgcctgacggcttcccgtggcccagtcgagtagggctccagtctcgaagatgagctgattatactgtgcgaatctggagtgacagtgtggaacggttcggttttcggcggacgggacctaagcgtagaccgtacctaacgtacacgcccaaggcctacgccccttcggtacacgtacctcgttacccgccctccctaccgaccggagaaccgttactggacgcgggtactcggcgtaacgggccgacgaacgtacgtatacgntagngcgcggtgngcgcgngcg

SEQ ID NO: 225863 - DNA, 502 bp, Homo sapiens
  misc_feature: GYAE6OF02IXY53.19.86.H09.1.454.CMB.1.raw
  modified_base (490)..(502): a, c, t, g, unknown or other
  misc_feature (490)..(502): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtcccctgaccgattctctggcgagaggtctggcgcctcagcttccctggccatcagagggctccagtctgaagatgaggctgattattactgtgcaatctgggatgacagtgtgaacggtccggttttcggcgggagggacaagctgaccgtctaagtcagcccaaggctcgcccctcggtcactcctcgttcccaccctccctccacgacgagtactgacgcgggctggcaaggcgcagtagnnnnnnnnnnnnn

SEQ ID NO: 225864 - DNA, 422 bp, Homo sapiens; identical to SEQ ID NO: 225622
  misc_feature: GYAE6OF02F6AHW.19.86.H09.1.454.CMB.1.raw
  modified_base (417)..(422): a, c, t, g, unknown or other
  misc_feature (417)..(422): n is a, c, g, or t

SEQ ID NO: 225865 - DNA, 499 bp, Homo sapiens
  misc_feature: GYAE6OF02IJ3RN.19.86.H09.1.454.CMB.1.raw
  modified_base (374)..(374): a, c, t, g, unknown or other
  misc_feature (374)..(374): n is a, c, g, or t
  modified_base (487)..(499): a, c, t, g, unknown or other
  misc_feature (487)..(499): n is a, c, g, or t
tcagtactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcagagggctccagtctgagatgagctgattattactgtgcaatctggatgacagtgtgaacggtccggtttcggnggagggacaagctgaccgtctaagtcagccaggctcgcccctggtcactctcgtcccaccctcctaccacgacgtacgtacgcgacgcgggctcgggcaaggcgacacgtagnnnnnnnnnnnnn

SEQ ID NO: 225866 - DNA, 498 bp, Homo sapiens
  misc_feature: GYAE6OF02HYOC0.19.86.H09.1.454.CMB.1.raw
  modified_base (486)..(498): a, c, t, g, unknown or other
  misc_feature (486)..(498): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcgggagggaccaagctgaccgtctaagtcagccaaggctgcccctcggtcactctcgttcccaccctcctccacgagacgtactgacgcgggctcggcaggcgcagtagnnnnnnnnnnnnn

SEQ ID NO: 225867 - DNA, 426 bp, Homo sapiens
  misc_feature: GYAE6OF02IEMCT.19.86.H09.1.454.CMB.1.raw
  modified_base (328)..(328): a, c, t, g, unknown or other
  misc_feature (328)..(328): n is a, c, g, or t
  modified_base (414)..(426): a, c, t, g, unknown or other
  misc_feature (414)..(426): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacgggctaaaggcataagtgttcgacccctggggccagggaaccctggtcaccgtctcctcagcctccaccaagggcccatcggtcttccccctggcgccctgcctccaggncacctccgagagcacagcggccctgggctgcctggtcaaggactacttcccacgagagtactgagcgggctgggcaggcgcatagnnnnnnnnnnnnn

SEQ ID NO: 225868 - DNA, 541 bp, Homo sapiens
  misc_feature: GYAE6OF02JEE3P.19.86.H09.1.454.CMB.1.raw
tcagtactctcgtgcacgaccggtgctcgattagtgctatagacttgggtttgggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacgggctaaaggcataaagtggttcgaccctggggccagggaccctggtcaccgtctcctcacgcctccaccaagggcccatccggtcttcccccgtggccgccctgcctccgacggacgccaccctccgacgacgccaccacggcggcccgtgggtccg

SEQ ID NO: 225869 - DNA, 490 bp, Homo sapiens
  misc_feature: GYAE6OF02IAO6B.19.86.H09.1.454.CMB.1.raw
  modified_base (479)..(490): a, c, t, g, unknown or other
  misc_feature (479)..(490): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttcctggccatcagagggctccagtctgaagatgaggctgattattactgtgcaatctgggatgacagtgtgaacggtcggtttcggcggagggaccaagctgaccgtctaagtcagcccaaggctgcccctggtcactcctgtcccaccctctccacgagacgtactgacgcgggctggacaggcgcatacgnnnnnnnnnnnn

SEQ ID NO: 225870 - DNA, 420 bp, Homo sapiens
  misc_feature: GYAE6OF02H64DN.19.86.H09.1.454.CMB.1.raw
  modified_base (418)..(420): a, c, t, g, unknown or other
  misc_feature (418)..(420): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtccttccccctggcgcccctgctccaggagcacctccgagagcacagcggccctgggctgcctggtcaaggctacttcccacgagagtactgagcgggctggcaaggcgcatagnnn

SEQ ID NO: 225871 - DNA, 500 bp, Homo sapiens
  misc_feature: GYAE6OF02HA77C.19.86.H09.1.454.CMB.1.raw
  modified_base (489)..(500): a, c, t, g, unknown or other
  misc_feature (489)..(500): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttcggcggagggaccaagctgaccgtctaagtcagcccaaggctacgcccctcggtcactctcgttcctctaccctcctcccacgagacgttactgacgcggctgggcaggcgcgatgnnnnnnnnnnnn

SEQ ID NO: 225872 - DNA, 301 bp, Homo sapiens
  misc_feature: GYAE6OF02GCFMY.19.86.H09.1.454.CMB.1.raw
  modified_base (298)..(301): a, c, t, g, unknown or other
  misc_feature (298)..(301): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggactacttcccacgagagtactgagcgggctggcaaggcgcatagnnnn

SEQ ID NO: 225873 - DNA, 487 bp, Homo sapiens
  misc_feature: GYAE6OF02GY4JZ.19.86.H09.1.454.CMB.1.raw
  modified_base (318)..(318): a, c, t, g, unknown or other
  misc_feature (318)..(318): n is a, c, g, or t
  modified_base (468)..(468): a, c, t, g, unknown or other
  misc_feature (468)..(468): n is a, c, g, or t
  modified_base (474)..(475): a, c, t, g, unknown or other
  misc_feature (474)..(475): n is a, c, g, or t
  modified_base (477)..(487): a, c, t, g, unknown or other
  misc_feature (477)..(487): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagntgaggctgattattactgtgcaatctggatgacagtgtgaacggtcggtttcggcggagggaccagctgacgtctaagtcagccaaggctcgcccctcgtcactctcgttcccgccctcctccacgcgagtctgagcgggctggcaggcncatcgnngnnnnnnnnnnn

SEQ ID NO: 225874 - DNA, 507 bp, Homo sapiens
  misc_feature: GYAE6OF02I2JYS.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtgggtggcgcgatacgtcgcacagaagtttcagggccgcgtcaccatggccaaggtcgcgtccacgaatacagtgtatatggacttgagcagcctgagtctgacgacacggccatgtattatgtgcgaggcgaggacgggctaaggcagtaagtggttcgtacccgg

SEQ ID NO: 225875 - DNA, 505 bp, Homo sapiens
  misc_feature: GYAE6OF02IYEYD.19.86.H09.1.454.CMB.1.raw
  modified_base (260)..(260): a, c, t, g, unknown or other
  misc_feature (260)..(260): n is a, c, g, or t
  modified_base (494)..(505): a, c, t, g, unknown or other
  misc_feature (494)..(505): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattcnctggcgagaggtctggcgcctcagcttccctggccatcagagggctccagtctgaagatgaggctgattattactgtgcaatcgtgggatgacagtgtgaacggttccggtttcggcgggagggaccaagctgaccgtctaagtcagcccaaggctcgcccctggtcactctcgttcccgccctcctccacgagtacgtacgtcgagccgggctcgggcgaggcgacagtagcnnnnnnnnnnnn

SEQ ID NO: 225876 - DNA, 497 bp, Homo sapiens
  misc_feature: GYAE6OF02HANGM.19.86.H09.1.454.CMB.1.raw
  modified_base (488)..(497): a, c, t, g, unknown or other
  misc_feature (488)..(497): n is a, c, g, or t
tcagtactctcgtgcacgaccggtgctcgatttagtgctatagacttgggtttgggggccgttcctgggcccagtttgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcgggcggagggaccaagctgaccgtctaagtcagcccaaggcctcgccccctcggtccactctcgttcccaccctcctccacgagacgtactgacgcgggctggcaggcgcatagnnnnnnnnnn

SEQ ID NO: 225877 - DNA, 487 bp, Homo sapiens
  misc_feature: GYAE6OF02G91WO.19.86.H09.1.454.CMB.1.raw
  modified_base (478)..(487): a, c, t, g, unknown or other
  misc_feature (478)..(487): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctggatgacagtgtgaacggtcggttttcggcggaggaccaagctgaccgtctaagtcagcccaaggctgcccctggtcactctcgttcccaccctcctccacgacgagtactgagcggctggcaggcgcagtagnnnnnnnnnn

SEQ ID NO: 225878 - DNA, 542 bp, Homo sapiens
  misc_feature: GYAE6OF02HZ8G6.19.86.H09.1.454.CMB.1.raw
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
  modified_base (531)..(542): a, c, t, g, unknown or other
  misc_feature (531)..(542): n is a, c, g, or t
tcagtactctcgtgcacgaccggtgctcgatttagtgctatagacttgggtttgggggccggttccgtgggcccgagtctgtgctgactcaggcaccctcagcgtctgggaccccgggcagacggtcaccatcgcttgttctgcaagcagctcgaaacatcgggagcagtggtgtgatgtggtatcagaaaagtcccaggaaccggcccccaaaactcgtcatctaataaatgacgctgagcggtccttaaagggtcccctgacgacttctctggcgagaggtctggcgcctcagcttcctggccatcagaggctccgagtctgaagatgaggctgattatactgtgcaaatctgggaatggacaggtgtagaacggttccgggttttacggcgggtaggggaaccaagcgtggaaccgtcctaaagtcagacccgaaaggcgtcgcccccgttcggtccacttcctcgtccgcccgtcctccaaccgngacgttacngacgcgggctgggacgaggcgacgaagtcgagnnnnnnnnnnnn

SEQ ID NO: 225879 - DNA, 500 bp, Homo sapiens
  misc_feature: GYAE6OF02IXTU2.19.86.H09.1.454.CMB.1.raw
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
  modified_base (487)..(487): a, c, t, g, unknown or other
  misc_feature (487)..(487): n is a, c, g, or t
  modified_base (490)..(500): a, c, t, g, unknown or other
  misc_feature (490)..(500): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagntgaggctgattattactgtgcaatctgggatganagtgtgaacggtcggtttcggcgggaggccaagctgaccgtctaagtcagcccaaggctcgcccctggtcacttctcgttccccaccctccctccacgagacgtactgacgcgggctggcgaggcgactagtagnagnnnnnnnnnnn

SEQ ID NO: 225880 - DNA, 506 bp, Homo sapiens
  misc_feature: GYAE6OF02JD957.19.86.H09.1.454.CMB.1.raw
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
  modified_base (491)..(491): a, c, t, g, unknown or other
  misc_feature (491)..(491): n is a, c, g, or t
  modified_base (497)..(506): a, c, t, g, unknown or other
  misc_feature (497)..(506): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctggaccgattctctggcgagaggtctggcgcctcagcttcctggccatcagagggctccagtctgaagatgaggctgattattactgtgcaatctgggatgacagtgtgacggtcggtttcggcggaggaccagctgaccgtctagtcagccaagcncgcccctcggtcactcncgttcccaccctcctccacgagtacgtacgtcgacgcgggtctggccgtaacgggcgcacgtaacggnacgcgnnnnnnnnnn

SEQ ID NO: 225881 - DNA, 504 bp, Homo sapiens
  misc_feature: GYAE6OF02JFP08.19.86.H09.1.454.CMB.1.raw
  modified_base (379)..(379): a, c, t, g, unknown or other
  misc_feature (379)..(379): n is a, c, g, or t
  modified_base (465)..(465): a, c, t, g, unknown or other
  misc_feature (465)..(465): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagaagtttcagggccncgtcaccatggccaaggtcgcgtccacgaatacagtgtatatggacttgagcagcctgagtctgacgacacggcatgtattattgngcgaggcgaggacgggctaagggctagtaagtggtaccg

SEQ ID NO: 225882 - DNA, 497 bp, Homo sapiens
  misc_feature: GYAE6OF02GUJ0Q.19.86.H09.1.454.CMB.1.raw
  modified_base (488)..(497): a, c, t, g, unknown or other
  misc_feature (488)..(497): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtcggttttcggcggagggaccaagctgaccgtctaagtcagcccaaggctcgcccctcggtccactctcgttccccaccctcctcccacgagacgtactgacgcgggctggcaggcgcatagnnnnnnnnnn

SEQ ID NO: 225883 - DNA, 536 bp, Homo sapiens
  misc_feature: GYAE6OF02GC1LF.19.86.H09.1.454.CMB.1.raw
  modified_base (521)..(523): a, c, t, g, unknown or other
  misc_feature (521)..(523): n is a, c, g, or t
  modified_base (525)..(526): a, c, t, g, unknown or other
  misc_feature (525)..(526): n is a, c, g, or t
  modified_base (528)..(529): a, c, t, g, unknown or other
  misc_feature (528)..(529): n is a, c, g, or t
  modified_base (531)..(536): a, c, t, g, unknown or other
  misc_feature (531)..(536): n is a, c, g, or t
tcagtactctcgtgcacgaccggtgctcgatttagtgctatagactttgggtttggggccggttcctgggcccacgtcctggttgctgactcaggtcaccctcagcgtctgggacccccgggcagacggtcaccatcgcttgttctgtcaagcagctcggtaacatcgggagctagtggtgtgatgtggtatcagaaagtcccaggaacggcccccaaagtcgtcatctataatggacgctgagcggtccttaagggtccctgaccgattctctggcgagaggtctggcgcctcagcttccctggccatcagagggctccgagtctgaagatgaggctgattattactgtgcaatctgggatgacagtgtagaacggttcggttttcggcggagggaccaagctgaccgtcctaagtcgacgcccgaaggcctcgcccccgttggtccaccttccttcgttcccctacccgtccctcccaccgagacgtacctggacgcgggctgggcaaggcgcagtggnnngnngnngnnnnnn

SEQ ID NO: 225884 - DNA, 525 bp, Homo sapiens
  misc_feature: GYAE6OF02I3NYK.19.86.H09.1.454.CMB.1.raw
  modified_base (477)..(477): a, c, t, g, unknown or other
  misc_feature (477)..(477): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacacttcagtcattatcatatactctgggtgcgacaggcccctggacaagggcttgagtggagtagggcgatccgacggtggtagtggtggcgcagtacggtcgcacgagaagtttcgaggggccgcgtcaccgtatcggaccaagggtcgcgtcaacgaatacgagtgtatagtggacttgagtcagcctgagtctgacgacacggccatgtattatgtcgngaggcaggacgggactaagggcaagtaaggtcggttaccgtacccggg

SEQ ID NO: 225885 - DNA, 842 bp, Homo sapiens
  misc_feature: GYAE6OF02FTWXK.19.86.H09.1.454.CMB.1.raw
  modified_base (303)..(303): a, c, t, g, unknown or other
  misc_feature (303)..(303): n is a, c, g, or t
  modified_base (804)..(804): a, c, t, g, unknown or other
  misc_feature (804)..(804): n is a, c, g, or t
  modified_base (837)..(837): a, c, t, g, unknown or other
  misc_feature (837)..(837): n is a, c, g, or t
tcagtactctcgtgcacgaccggtgctcgatttagtgctatagacttgggttgggggccggttacctgggcccagtcttggtcgctggaacctcagggacaccccctcagccgtctgggtaccccccgggctacgaccggtcacccatcgcgttcgttcctggcaagccaacggctacgtaacattcgggagcagttggtcgtgatcgtggtattcagaaacgtccgaaggaacggcccccaaactcgtcatctagtactgacgctgatacggtccttaagggtcccttggacccgagttccncgtggacgaacgagggtcctgggccgtccctcgagtccttccccctaggtccctaattcgagagggcctcccgaacgtcgtcgaaacgtagtcgaacgggtccctaggaactttaaggtttaaccgtggtttcgggaccctaaaaggtttccggttgggggtaagttacggaacgtaagttcggttacgtaaaccgggtttcccgggtttttacccgggacgggttaacggggaacccgaaacgggtcctaccgggtaacccggttacccgttaaacgggttccgaaacggtaccccgttaaaggggtccctaccggtttacccccccgtttaacggtttcccgttaacccgttaccgttccggtttaccccgtaaccccccgttaacccgttaccccgaaccgggtaccgttaaccggttaaccgttacgggtaaccggggtacccgggtaccggtaaccgggacggttaaaccggggaccgtaccgaaacgttaacggngttacggacgtgacgactacgtctgtcttacgnttacc

SEQ ID NO: 225886 - DNA, 496 bp, Homo sapiens
  misc_feature: GYAE6OF02F7T48.19.86.H09.1.454.CMB.1.raw
  modified_base (485)..(496): a, c, t, g, unknown or other
  misc_feature (485)..(496): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtcggtttcggcggagggacaagctgaccgtctaagtcagcccaaggctcgcccctcggtcacctctcgttcccaccctcctccacgagacgtactgacgcggctggcaaggcgacagtagnnnnnnnnnnnn

SEQ ID NO: 225887 - DNA, 502 bp, Homo sapiens
  misc_feature: GYAE6OF02HYK94.19.86.H09.1.454.CMB.1.raw
  modified_base (492)..(502): a, c, t, g, unknown or other
  misc_feature (492)..(502): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctcgcccctcggtcactcctcgttcccaccctcctccacgacgacgtacctgagccgggctggcgaaggcgcagtagnnnnnnnnnnn

SEQ ID NO: 225888 - DNA, 502 bp, Homo sapiens
  misc_feature: GYAE6OF02GCAUO.19.86.H09.1.454.CMB.1.raw
  modified_base (489)..(490): a, c, t, g, unknown or other
  misc_feature (489)..(490): n is a, c, g, or t
  modified_base (492)..(502): a, c, t, g, unknown or other
  misc_feature (492)..(502): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggttccggtttcggcggagggaccaagctgaccgtctagtcagccaaggctcgcccctcgtcactctcgtcccaccctcctccacgacgacgtactgacgccgggctgggcgaagggccgcagtcgnngnnnnnnnnnnn

SEQ ID NO: 225889 - DNA, 492 bp, Homo sapiens
  misc_feature: GYAE6OF02G4N2N.19.86.H09.1.454.CMB.1.raw
  modified_base (480)..(492): a, c, t, g, unknown or other
  misc_feature (480)..(492): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtcggtttcggcggagggacagctgaccgtctagtcagcccaaggctcgcccctcggtcactctcgttcccaccctcctccacgacgacgtactgacgcgggctgggcaggcgcagtgnnnnnnnnnnnnn

SEQ ID NO: 225890 - DNA, 504 bp, Homo sapiens
  misc_feature: GYAE6OF02GEEM3.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacgggctaaggcagtaagtggtcgacccgg

SEQ ID NO: 225891 - DNA, 491 bp, Homo sapiens
  misc_feature: GYAE6OF02HE6BM.19.86.H09.1.454.CMB.1.raw
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
  modified_base (480)..(491): a, c, t, g, unknown or other
  misc_feature (480)..(491): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgagatgaggctgattattactgtgcaatctgggatgacagtgtgaacggtcggtttcggcggagggaccaagctgaccgtctaagtcagcccagctgcccctggtccactctcgttcccaccctcctccaccgagacgtactcgagcgggcnggcaggcgcngtagnnnnnnnnnnnn

SEQ ID NO: 225892 - DNA, 498 bp, Homo sapiens
  misc_feature: GYAE6OF02HL6K8.19.86.H09.1.454.CMB.1.raw
  modified_base (428)..(428): a, c, t, g, unknown or other
  misc_feature (428)..(428): n is a, c, g, or t
  modified_base (487)..(491): a, c, t, g, unknown or other
  misc_feature (487)..(491): n is a, c, g, or t
  modified_base (493)..(498): a, c, t, g, unknown or other
  misc_feature (493)..(498): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtcggttttcggcgggagggaccaagctgaccgtctaagtcagcccaaggctcgcccctcggtcnctctcgttcccgccctcctccacgacgagtactgacgcgggctggcaaggcgcagtagnnnnngnnnnnn

SEQ ID NO: 225893 - DNA, 452 bp, Homo sapiens
  misc_feature: GYAE6OF02FWDAV.19.86.H09.1.454.CMB.1.raw
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (415)..(452): a, c, t, g, unknown or other
  misc_feature (415)..(452): n is a, c, g, or t
tcagtactctcgtgcacgaccggtgctcgatttagtgctatagacttgggcttgagtggatagggcggatccacgggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctcaccaagggcccatcggtctccccctggcnccngctccagngcactccgagagcacagcggccctgggctgcctggtcaaggactacttcccgacgagacgtactgagcgggctggcaaggcgcatagnnnnnnnnnnnnnnnnnnnnnnnnnnnnnnnnnnnnnn

SEQ ID NO: 225894 - DNA, 500 bp, Homo sapiens
  misc_feature: GYAE6OF02JET0S.19.86.H09.1.454.CMB.1.raw
  modified_base (488)..(488): a, c, t, g, unknown or other
  misc_feature (488)..(488): n is a, c, g, or t
  modified_base (490)..(500): a, c, t, g, unknown or other
  misc_feature (490)..(500): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatacgcttgttctgcaagcagctcgaacatcgggagcagtggtgtgatgtggtatcagaaagtcccaggaacggcccccaaatcgtcatctataatgacgctgagcggtccttaagggtccctgaccgattcctctggcgagaggtctggcgcctcagcttccctggccatcagaggctccagtctgaagatgaggctgattatactgtgcaatctgggatgaacagtgtgaaacggttccggtttcggcgggtagggaccaagctgaccgtctaagtcagcccaaggcctcgcccctggtcactctgttcccgccctcctccacgagagtactgagcggctggcaaggcgacagtaagnannnnnnnnnnn

SEQ ID NO: 225895 - DNA, 565 bp, Homo sapiens
  misc_feature: GYAE6OF02IJAT0.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctctgcgaggcttttggatacaccttcagtcattatcatatactctggtgcgacaggcccctggacaagggcttgagtggagtagggcggatcgacggtggtagtggtggcgcatacgtcgcacgagtaagtttcgagggccgcgtcaccgagtcggccgaaggtcgcgtaccacgaatacgagttgtatagtggacttggagcgagccgtagaggttctgacgacgaccgggtccaagttgttaagtttagttggtagcggtaagggccgaaggggtacgggggacttaaaagggcctaaaggttaaacggtgggttaaccccggg

SEQ ID NO: 225896 - DNA, 506 bp, Homo sapiens
  misc_feature: GYAE6OF02GYF7F.19.86.H09.1.454.CMB.1.raw
  modified_base (442)..(442): a, c, t, g, unknown or other
  misc_feature (442)..(442): n is a, c, g, or t
  modified_base (494)..(506): a, c, t, g, unknown or other
  misc_feature (494)..(506): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctcgcccctcggtcactctcgttccccncccttcctccacgacgacgtactcgagcgggctggaccagggccgcagtagnnnnnnnnnnnnn

SEQ ID NO: 225897 - DNA, 491 bp, Homo sapiens
  misc_feature: GYAE6OF02IHG67.19.86.H09.1.454.CMB.1.raw
  modified_base (482)..(491): a, c, t, g, unknown or other
  misc_feature (482)..(491): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgagatgaggctgattattactgtgcaatctggatgacagtgtgaacggtccggttttcggcggagggaccaagctgaccgtctaagtcagcccaaggctgcccctcggtcactctcgttcccacctcctccacgacgacgtactgacgcgggctggcaggcgcatagnnnnnnnnnn

SEQ ID NO: 225898 - DNA, 571 bp, Homo sapiens
  misc_feature: GYAE6OF02ISGUT.19.86.H09.1.454.CMB.1.raw
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (569)..(570): a, c, t, g, unknown or other
  misc_feature (569)..(570): n is a, c, g, or t
tcagtactctcgtgcacgaccggtgctcgatttagtgctatagacttggggtttggggggccgttcctgggcccagtctgtgctcgactcaggcaccccttcagcgtctgggacccccgggcagacggtcaccatcgcttgttctgcaagcagcgtcgaacatcgggagtcagtggtgtgtatggtggtatcagaaagtcccaggaacggccccaaactcgtcatctagtaatgacgctgacgggtccggtccttaagggtccctgacccgtattctctggccgagagggtctggccgtcctcgagcttccctggccatcaggacgggctccgagtcctggaaggactggaggctggattattactgtgacaaatcgtgggaataagactaggtgtgaacggttccgggttttcgggcgggagggacctaagctagacccgtcctaaggtcacgaccgaaggcctcgtcccctcggttctacctcttacgttccccaacctcctccaacgacgacgtacgtcgacgcgggtcttggcacggcgacagtcgcncgngcngcngcngntcnnc

SEQ ID NO: 225899 - DNA, 493 bp, Homo sapiens
  misc_feature: GYAE6OF02IV4DY.19.86.H09.1.454.CMB.1.raw
  modified_base (260)..(260): a, c, t, g, unknown or other
  misc_feature (260)..(260): n is a, c, g, or t
  modified_base (480)..(485): a, c, t, g, unknown or other
  misc_feature (480)..(485): n is a, c, g, or t
  modified_base (488)..(493): a, c, t, g, unknown or other
  misc_feature (488)..(493): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattcnctggcgagaggtctggcgcctcagcttccctggccatcagagggctccagtctgaagatgaggctgattattactgtgcaatctgggatgacagtgtgaacggtcggtttcggcggaggacaagctgaccgtctaagtcagccaaggctcgcccctggtcactctcgttcccaccctcctccacgagacgtactgacgcgggctggcacggcgcagtagnnnnnngcnnnnnn

SEQ ID NO: 225900 - DNA, 572 bp, Homo sapiens
  misc_feature: GYAE6OF02IPY0W.19.86.H09.1.454.CMB.1.raw
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (523)..(523): a, c, t, g, unknown or other
  misc_feature (523)..(523): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (566)..(566): a, c, t, g, unknown or other
  misc_feature (566)..(566): n is a, c, g, or t
tcagtactctcgtgcacgaccggtgctcgatttagtgctatagacttgggtttgggggccgttccgtgggcccagtcctgtcgctgactccaggctaccctcagcgtctgggacccccgggcagacggtcaccatcgcttgttctgcaagcagctcgaacatcgggagctagttggtgtgtatgtggtatcagaaagtcccaggaacggcccccaaagtcgtcatcgtataatgacgctgagcggtccttaacgggtccctagaccgattcctcgtggccgagacggtctggcgtcctcagtcttcccgtggtccatcagaggcctcagtcngaagntgaggctgattagtactgtgacaattcgtgggatgacagtgtagaacggttccggtttcggcggagggtaccaagtcgtagacccggtactaagtcacgtcccgtaaggcctcgcccctcggtaccaccgttcgtccgttccccgccttccctccgacgtacgaacgttacctagacgtcggtacncgggacaacggcgtacgagtacgctntatcgntgtcngtgtancgtcag

SEQ ID NO: 225901 - DNA, 496 bp, Homo sapiens
  misc_feature: GYAE6OF02HNF8N.19.86.H09.1.454.CMB.1.raw
  modified_base (440)..(440): a, c, t, g, unknown or other
  misc_feature (440)..(440): n is a, c, g, or t
  modified_base (485)..(496): a, c, t, g, unknown or other
  misc_feature (485)..(496): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctggatgacagtgtgaacggtccggttttcggcggagggaccaagcgtgaccgtctaagtcagcccaaggctcgcccctcggtcactctcgttcccnccctcctccacgagacgtactgagcgggctggcgaggcgcatagnnnnnnnnnnnn

SEQ ID NO: 225902 - DNA, 671 bp, Homo sapiens
  misc_feature: GYAE6OF02JFKPE.19.86.H09.1.454.CMB.1.raw
  modified_base (162)..(162): a, c, t, g, unknown or other
  misc_feature (162)..(162): n is a, c, g, or t
  modified_base (314)..(314): a, c, t, g, unknown or other
  misc_feature (314)..(314): n is a, c, g, or t
  modified_base (667)..(667): a, c, t, g, unknown or other
  misc_feature (667)..(667): n is a, c, g, or t
tcagtactctcgtgcacgaccggtgctcgatttagtgctatagacgttgggtttggggccgttcctggcccagtctgtgctgactcaggcaccctcagcgtctgggaccccgggcagacggtcaccatcgcttgttctgcaagcagctacgaacatcgggancagtggtgtgatgtgtatcagaaagtcccaggaaccgccccaaatcgtcatctataatgacgctgacgcggtccgtaaggtccctgaccgattctctggcgagagtctggcgcctcagcttacccgtggccatcagaggtctcagtctgagntgaggctgattagttactgtgcaagttcgtgggattcgacgtaggttcggtcggtaaaccgggtttcccgggttttcgggacgggtaacgggtacccaaggtcctacggtacccgttacccgttaaggttaccgacgaccccgtaagggcccgttcccggtcccccgttcgggtaccttaccgttccgtacccgtttacccccaccccgtttcccgtacccgaaccgtaaggtaaccgttttaaccggtccgggaacgggttcccggggtacccgttcggggaaccgtaaaccggggtcccgtaaccggtaaggttacggagaccgtacgcgtacggcctagcggctcgacgngtcc

SEQ ID NO: 225903 - DNA, 579 bp, Homo sapiens
  misc_feature: GYAE6OF02JQA6X.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggatagggcgatccgacggtggtagtggtggcgcagtacgtcgcacgagtaacgtttcgagggccgcgtccacagtcggccaaggtcgcgtccacgaatacagtgtactagtcggacttgacgcagtcctaggacgttcgtacgacgtacgaccggcgtaagttgttacttagtttcggtcggtacggtagggccgtaaggggtacgggtacgttaaacgggaccgtaaggttaaacggtcgggttacccggtaacccccgggg

SEQ ID NO: 225904 - DNA, 518 bp, Homo sapiens
  misc_feature: GYAE6OF02IAKAC.19.86.H09.1.454.CMB.1.raw
  modified_base (482)..(482): a, c, t, g, unknown or other
  misc_feature (482)..(482): n is a, c, g, or t
  modified_base (504)..(504): a, c, t, g, unknown or other
  misc_feature (504)..(504): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggcatgtattattgtgcgaggcaggacgggctaaaggcataaagtgtcgaccctggggccagggaacctggtcaccgtctcctcagcctccaccaggcccatcgtctcccctgccgcctgcctcgnggacgcacctccgagacgcacngcggcccgtggccg

SEQ ID NO: 225905 - DNA, 499 bp, Homo sapiens
  misc_feature: GYAE6OF02GH99S.19.86.H09.1.454.CMB.1.raw
  modified_base (487)..(499): a, c, t, g, unknown or other
  misc_feature (487)..(499): n is a, c, g, or t
tcagtactctcgtgcacgaccggtgctcgatttagtgctatagacttgggtttgggggccgttcctgggcccagtctgtgctgactcaggcaccctcagcgtctggggcccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttcggcggagggaccaagctgaccgtctaagtcagcccaaggctcgcccctcggtcactctcgttccccaccctcctccacgacgagtactgacgcgggctggcaaggcgcagtcgnnnnnnnnnnnnn

SEQ ID NO: 225906 - DNA, 505 bp, Homo sapiens
  misc_feature: GYAE6OF02IR09A.19.86.H09.1.454.CMB.1.raw
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (440)..(440): a, c, t, g, unknown or other
  misc_feature (440)..(440): n is a, c, g, or t
  modified_base (492)..(493): a, c, t, g, unknown or other
  misc_feature (492)..(493): n is a, c, g, or t
  modified_base (496)..(505): a, c, t, g, unknown or other
  misc_feature (496)..(505): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaactcgtcatctataatgacgctgagcggtccttaagggccctgaccgattctcgtggcgagaggtctggcgcctcagcttcctggccatcagagggctccagtctgaagatgaggctgattattacngtgacaatcgtgggatgacngtgtgaacggttcggtttcgcggaggaccagctgaccgtctaagtcagcccaaggcctcgcccctcggtcaccgtctcgttccccncctctccgacgagacgtactgacggcgggctaggcgaaggcgtacagtcggnngcnnnnnnnnnn

SEQ ID NO: 225907 - DNA, 599 bp, Homo sapiens
  misc_feature: GYAE6OF02JYXF8.19.86.H09.1.454.CMB.1.raw
tcagtactctcgtgcacgaccggtgctcgattagtgctatagacttgggtttgggggaaggaggaagactgacggtcccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatccaggtgtagtggtggcgcatacgtcgcacagaagtttcaggggtccgcgtcaccatggccaaggtcgcgtccacgaatccagtgtatatggacttgagcagcctgaggtctgacgacacggccatgtattattgtgcgaggcgagggacggggcgtaaagggcagtaaagtgggttacgaccccgttggggaccgagggacccctggtccgaccgtctcctcacgcctaccgaccaacgggcccagtccggttccttcccccgtcgggacccgtcccgtcgccgttcccgacgggtaccgccgaacccgttcccggaacggtacgaccgaacccgacggtccgggccccgtcggggtacccg

SEQ ID NO: 225908 - DNA, 488 bp, Homo sapiens
  misc_feature: GYAE6OF02F2XKM.19.86.H09.1.454.CMB.1.raw
  modified_base (478)..(488): a, c, t, g, unknown or other
  misc_feature (478)..(488): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattatactgtgcaatctgggatgacagtgtgaacggtccggtttggcggagggccaagctgacgtcctaagtcagcccaaggctgcccctcggtcactctcgttcccaccctcctccacgacgagtactgagcgggctgggcaggcgcatagnnnnnnnnnnn

SEQ ID NO: 225909 - DNA, 522 bp, Homo sapiens
  misc_feature: GYAE6OF02GSH5J.19.86.H09.1.454.CMB.1.raw
  modified_base (349)..(349): a, c, t, g, unknown or other
  misc_feature (349)..(349): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgnatacgtcgcacagaagtttcgagggccgcgtcaccatggaccaagggtcgcgtccacgaatacagtgtatatggacttgagcagcctgaggtctgacgacacggcatgtattatggtgcgagggcgagggacggggactaaaggctaagtaaaggttggttaccgaccccggg

SEQ ID NO: 225910 - DNA, 493 bp, Homo sapiens
  misc_feature: GYAE6OF02HAMCV.19.86.H09.1.454.CMB.1.raw
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (438)..(439): a, c, t, g, unknown or other
  misc_feature (438)..(439): n is a, c, g, or t
  modified_base (444)..(444): a, c, t, g, unknown or other
  misc_feature (444)..(444): n is a, c, g, or t
  modified_base (446)..(449): a, c, t, g, unknown or other
  misc_feature (446)..(449): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (466)..(468): a, c, t, g, unknown or other
  misc_feature (466)..(468): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (485)..(487): a, c, t, g, unknown or other
  misc_feature (485)..(487): n is a, c, g, or t
  modified_base (489)..(489): a, c, t, g, unknown or other
  misc_feature (489)..(489): n is a, c, g, or t
  modified_base (491)..(492): a, c, t, g, unknown or other
  misc_feature (491)..(492): n is a, c, g, or t
tcagtactctcgtgcacgaccggtgctcgatttagtgctatagacttgggcttggagtggatagggcggatccacggtggtagtggtggcgcatacgtcgcacctagaacgtttcagggccgcgtcaccatggccaaggtcgcgtccacgaatacagtgtatatggacttgagcagcctgaggtcctgacgacacggccatgtattacttgtgcgaggcaggacgggctaaaggcaataaagtggttcgaccccgtggggccacgggaaccctggtcaccgtctcctcagcctcacaggccatcggtctcccctggcgccctgctccaggcgcacctcgagagctacaggccgccctgggctgccgtggtcaagggactaccgttcccagagagtactggacgcgggctgggacaagggccgcagtagnacgtngtgnngcagngnnnntntntntntngngngannncgtntntngcgcncncnnncncnnc

SEQ ID NO: 225911 - DNA, 533 bp, Homo sapiens
  misc_feature: GYAE6OF02HEJ66.19.86.H09.1.454.CMB.1.raw
  modified_base (519)..(519): a, c, t, g, unknown or other
  misc_feature (519)..(519): n is a, c, g, or t
  modified_base (521)..(523): a, c, t, g, unknown or other
  misc_feature (521)..(523): n is a, c, g, or t
  modified_base (525)..(525): a, c, t, g, unknown or other
  misc_feature (525)..(525): n is a, c, g, or t
  modified_base (527)..(529): a, c, t, g, unknown or other
  misc_feature (527)..(529): n is a, c, g, or t
  modified_base (531)..(533): a, c, t, g, unknown or other
  misc_feature (531)..(533): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagccttccctggccatcaggaggctccagtctgaagatgaggctgattattactgtgcaatcgtggatgacagtgtagtacggttcggtttcggcggagggacaagctcgaccgtcgtaagtcacgccgaacggctcgccccgtcggtccacgttctccgttccccacccttcctcccgacggtacgtacgttacgtcggacgccgggtctcgggacgaacggcgacgtagtagntnnngncnnncnnn

SEQ ID NO: 225912 - DNA, 507 bp, Homo sapiens
  misc_feature: GYAE6OF02FZXNB.19.86.H09.1.454.CMB.1.raw
  modified_base (495)..(507): a, c, t, g, unknown or other
  misc_feature (495)..(507): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgacccgattctctggcgagaggtctggcgcctcagcttccctggccatcagagggctccagtctgaagatgaggctgattattactgtgcaatctgggatgacagtgtgaacggttccggttttcggcggagggaccaagcgtgaccgtcctaagtcagcccaaggctgcccctcggtcactcctgttccccaccctcctccacgacgacgtactgacgcgggctcgggcaacggcgcagtacgnnnnnnnnnnnnn

SEQ ID NO: 225913 - DNA, 526 bp, Homo sapiens
  misc_feature: GYAE6OF02HC5OH.19.86.H09.1.454.CMB.1.raw
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (517)..(526): a, c, t, g, unknown or other
  misc_feature (517)..(526): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtataagaaagtcccaggaacggcccccaaactcgtcatctataatgacgctgagcggtccttaagggtccctgaccgattctctggcgagaggtctggcgcctcagcttccctggccatcagagggcctccagtctgaagatgaggctgattattactgtgcaatcgtgggatgacagtgtggaacggttccggttttcggcgggagggaccaagctgaccgtcctaagcagcccgaaggctcgccccgtcggtcctactctcgttccccaccctcctccacgacgacgtactggacgccggtctgggaccaagggccgacgacgtacgncgtnacgnnnnnnnnnn

SEQ ID NO: 225914 - DNA, 557 bp, Homo sapiens
  misc_feature: GYAE6OF02IJ0RV.19.86.H09.1.454.CMB.1.raw
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (546)..(547): a, c, t, g, unknown or other
  misc_feature (546)..(547): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
tcagtactctcgtgcacgaccggtgctcgatttagtgctatagacttggggtttggggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttcctggccactcagagggctccagtctgaagatgaggctgattattactgtgcaatctggatgacagtgtagtaacgggttccggttttcggacgggacgggaacaagcgtggacccgttctaagtcaacgcccgaaaggcctcggccccctcggtccacgtccttcgttccccgcccttcctcccgtacgacggtacgttacgtggacgtcggggctcgggacgaacgggccgacgtacgtagcngctacngcacgnngtnacgntcg

SEQ ID NO: 225915 - DNA, 513 bp, Homo sapiens
  misc_feature: GYAE6OF02IAIXY.19.86.H09.1.454.CMB.1.raw
  modified_base (501)..(513): a, c, t, g, unknown or other
  misc_feature (501)..(513): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctggaccgattctctggcgagaggtctggcgcctcagcttccctggcccatcagagggctccagtctgaagatgaggctgattattactgtgcaatcgtgggatgacagtgtagtacggttccggtttcggcgggagggaccaagcgtgaccgtctaagtcacgccaaggctcgcccctcggtcactcctcgtcccgccctccgtcccacgacgacgtagtcgacgcgggcgtcggacgacggcgacagtgnnnnnnnnnnnnn

SEQ ID NO: 225916 - DNA, 490 bp, Homo sapiens
  misc_feature: GYAE6OF02GA06V.19.86.H09.1.454.CMB.1.raw
  modified_base (481)..(490): a, c, t, g, unknown or other
  misc_feature (481)..(490): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagcccaaggctgcccctcggtcactctgttcccaccctcctccacgagagtactgagcggctggcaggcgcatacgnnnnnnnnnn

SEQ ID NO: 225917 - DNA, 431 bp, Homo sapiens
  misc_feature: GYAE6OF02GGEZU.19.86.H09.1.454.CMB.1.raw
  modified_base (330)..(330): a, c, t, g, unknown or other
  misc_feature (330)..(330): n is a, c, g, or t
  modified_base (416)..(416): a, c, t, g, unknown or other
  misc_feature (416)..(416): n is a, c, g, or t
  modified_base (422)..(431): a, c, t, g, unknown or other
  misc_feature (422)..(431): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggngccacctccgagagcacagccggccctgggctgcctggtcaaggactacttcccacgagacgtactgagcgggctgggcaagggcncatagnnnnnnnnnn

SEQ ID NO: 225918 - DNA, 502 bp, Homo sapiens
  misc_feature: GYAE6OF02GWHM8.19.86.H09.1.454.CMB.1.raw
  modified_base (339)..(339): a, c, t, g, unknown or other
  misc_feature (339)..(339): n is a, c, g, or t
  modified_base (489)..(490): a, c, t, g, unknown or other
  misc_feature (489)..(490): n is a, c, g, or t
  modified_base (493)..(502): a, c, t, g, unknown or other
  misc_feature (493)..(502): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtncaatctgggatgacagtgtgaacggttcggtttcggcggagggaccaagctgaccgtctaagtcagcccaaggctcgcccctggtccactctcgttcccaccctcctccacgacgacgtactgacgcgggctggacaggccgacagtagnncgnnnnnnnnnn

SEQ ID NO: 225919 - DNA, 564 bp, Homo sapiens
  misc_feature: GYAE6OF02F612P.19.86.H09.1.454.CMB.1.raw
  modified_base (330)..(331): a, c, t, g, unknown or other
  misc_feature (330)..(331): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (338)..(339): a, c, t, g, unknown or other
  misc_feature (338)..(339): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (490)..(490): a, c, t, g, unknown or other
  misc_feature (490)..(490): n is a, c, g, or t
tcagtactctcgtgcacgaccggtgctcgatttagtgctatagacttgagcagcctgaggtctgacgacacggccatgtattattgtgcgaggcaggacggggctaaaggcataagtggttcgacccgtgggccagggaaccctggtccaccgtctcctcacgcctccaccgaacgggcccagtcggtccttccccgtggccgccctgcctccgaggacgccaccgtccgagacgccacaggccggccctgggcctcgccgttggtacaaggtactaccgttcccaggagagtacctggacggtccgggctcggcaacgggcgcagtagnngcngngnncgncgnctgcagcagcgcgactcgcgtcncgttagacgtcgngactcggcacggcggacacgtcgcgacgtacncgtcggntcgaccganccggcncgttcgcggtaccncgacgtcgcgacgctacgcgtacgaccgtcgtacgtaccgngtacgtcgtacgtacgtcgcgtacggactcgtcgtacggcgtaacgtccgtacgtgaccggtccgacgacgtcc

SEQ ID NO: 225920 - DNA, 661 bp, Homo sapiens
  misc_feature: GYAE6OF02HWO09.19.86.H09.1.454.CMB.1.raw
  modified_base (638)..(638): a, c, t, g, unknown or other
  misc_feature (638)..(638): n is a, c, g, or t
  modified_base (656)..(656): a, c, t, g, unknown or other
  misc_feature (656)..(656): n is a, c, g, or t
tcagtactctcgtgcacgaccggtgctcgatttagtgctatagacttgggtttggggccggttcctgggcccacgtcctggttcgcgtgactcaggtcgaccctcagcgtctggaccccgggcagacggtcaccatcgcttgttcgtgtcgaagcagctcggtaacctagttcgggagtcttaaggtggtcgtgatggtggtatcagaagtcccgaggaacggcccccaaacggtcggtcctagtcctaagtaacgtgggaccgctagacgtccggttcccttaagggtccctgaccgactttcgtcgtaggtccgacgtacggtacctggtcgcctcaggcttccctggtcccgactccaggacggcgtccgaggtcctaggaagtagtgacgctgattagttactagttgctaatctaggtatagtacagtgtacgtaacggtcggttttacggacgggacggacgtaagtctacgaaccgttccgtaacgtcgacgacccgtaacggaccgtaccgcccccgttcggttcctaccgttccttcgttaccccgtccgtcccgtaccgaccgacgacgtacgtcgtaggccgggacgtcgggacgtaaggtcgtactaacgtaggtacgagtagcgngagtcgagtacggtgcgngacgg

SEQ ID NO: 225921 - DNA, 481 bp, Homo sapiens
  misc_feature: GYAE6OF02IWCMF.19.86.H09.1.454.CMB.1.raw
  modified_base (472)..(473): a, c, t, g, unknown or other
  misc_feature (472)..(473): n is a, c, g, or t
  modified_base (475)..(481): a, c, t, g, unknown or other
  misc_feature (475)..(481): n is a, c, g, or t
tcagtactctcgtgcacgaccggtgctcgatttagtgctatagacttgggtttggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggccctgaccgattctctggcgagaggtctggcgcctcagcttccctggccatcagagggctccagtctgaagatgaggctgattatactgtgcaatctgggatgacagtgtgaacggtcggttttcgcgggagggaccaagctgaccgtctaagtcagcccaaggctgcccctgtcactctgttcccacctcctccacgagagtactgagcggctggcaaggcgcatagnncnnnnnnn

SEQ ID NO: 225922 - DNA, 499 bp, Homo sapiens
  misc_feature: GYAE6OF02HRLEF.19.86.H09.1.454.CMB.1.raw
  modified_base (491)..(499): a, c, t, g, unknown or other
  misc_feature (491)..(499): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattatactgtgcaatctgggatgacagtgtgaacggttccggttttcggcgggagggaccaagcgtgaccgtcctaagtcacgcccaggctcgccccttggtccactctcgttccccgccctcctccacgacgacgtactgacgcgggctggcaggcgcagtgnnnnnnnnn

SEQ ID NO: 225923 - DNA, 509 bp, Homo sapiens
  misc_feature: GYAE6OF02H2P0I.19.86.H09.1.454.CMB.1.raw
  modified_base (499)..(509): a, c, t, g, unknown or other
  misc_feature (499)..(509): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgcccccaaatcgtcatctataatgacgctgagcggtccttaagggtccctgaccgattctctggcgagaggtctggcgcctcagcttccctggccatcagagggctccagtctgagatgaggctgattattactgtgcaatctggatgacagtgtgaacggttccggttttcggcgggtagggaccagctgaccgtctaagtcacgccaggctcgcccctcggtcactctcgttcccaccctcctccacgacgtacgtactgacgccgggctcgggaccgaaggccgacacgtagcagnnnnnnnnnnn

SEQ ID NO: 225924 - DNA, 506 bp, Homo sapiens
  misc_feature: GYAE6OF02JB3YJ.19.86.H09.1.454.CMB.1.raw
  modified_base (498)..(506): a, c, t, g, unknown or other
  misc_feature (498)..(506): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagcccaaggcctcgccccctggtccacgtcctcgttccccgcccttccctcccacgacgacgtacctggacgcgggctggcgaaggcgcagtgnnnnnnnnn

SEQ ID NO: 225925 - DNA, 519 bp, Homo sapiens
  misc_feature: GYAE6OF02G56X9.19.86.H09.1.454.CMB.1.raw
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (514)..(516): a, c, t, g, unknown or other
  misc_feature (514)..(516): n is a, c, g, or t
  modified_base (518)..(519): a, c, t, g, unknown or other
  misc_feature (518)..(519): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagaccggtcaccatcgcttgttctgcaagcagctcgaacatcgggagcagtggtgtgatgtggtatcagaaagtcccaggaaccggccccaaactcgtcatctataatgacgctgagcggtccttaagggccctgaccgattctctggcgagaggtctggcgcctcagcttccctggccatcagagggctccagtctcgaagatgaggctgtattatactgtgcaatctgggatgacagtgtagtaacggtccgggttttcggcgggagggaccaaggctgaccgtcctaagtcagccaagctcgccctcggcactctcgttcccaccctccgtccacgcgagtactcgcgcgggcgtcggcgaacggcgacgacgtacggcngtancnctcgctcnnncnn

SEQ ID NO: 225926 - DNA, 747 bp, Homo sapiens
  misc_feature: GYAE6OF02FFHFN.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcacgccgaccggacgcccactcccgaggtcgcagcgtggtcgcagtcgtggggctggaggtgaagggcgccgtggggcctcgagtggaacggttctccgtggcgtaggtcgttttaggactacctacttcgagtctattatactattaacgtccgttcgtggggtcgaccgtacgccggtacccgtaggaacgtagggtcttaggaggtaggacggtacgggtcggtacgtcccgggtaagggttcggtagggtcggggtcgtacgtaccgtaacgtaccggtcgaccgtaacggtaacggttaaccggttccggaccgggtacccgtacgtacccgaacccggtaggttccggaaacccggtacgggtacccgaccgttaacccgaaacgtaactacggttaggttagtaacgttacggtacgtacgtagaccgtacgacggtccgttagggacgttcgtaacggaccgaccgtacggtcttagtagtttacgaggtcggtacggtacgggacggtaccgggtaacgggaaccgggtacggtaacggaccgttaagggtaaccgggttccggttacccggtaaccccgggg

SEQ ID NO: 225927 - DNA, 516 bp, Homo sapiens
  misc_feature: GYAE6OF02F5S1O.19.86.H09.1.454.CMB.1.raw
  modified_base (498)..(498): a, c, t, g, unknown or other
  misc_feature (498)..(498): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggataggggcggatccgacggtggtaggtggtggcgcgatacgtcgcacagaagtttcagggccgcgtcaccatggccaaggtcgcgtccacgaatacagtgtatatggacttgagcagcctgaggtctgacgacacggccatgtattagttgtgcgaggcgagggacggggctaaagggnaagtaaggtggtacccgg

SEQ ID NO: 225928 - DNA, 598 bp, Homo sapiens
  misc_feature: GYAE6OF02GLP5C.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcgagtgaaggtctcctgcgaggtcttttggatacaccttcagtcattatcattatactcgtggtgcgacacggccctggacaaggcttgagtggagtagggcggatccgacggtggtaggtggtggcgctagtacggtcgcacgagtaacgtttcgacgggccgcgtccacagtcggaccgtagggtccgcgtaccgaacgaactacgtagttgtatagtaggtacttgacgcgagtccgtggacggtcgtaggaaccgacgaccggtacctagttcgttatttagttaggtcggtacggacgggacggaacggggaacgggtacgtaaagggtacgtaaaggtaacggttcgggttacccggtaaccccgggg

SEQ ID NO: 225929 - DNA, 560 bp, Homo sapiens
  misc_feature: GYAE6OF02H4D0B.19.86.H09.1.454.CMB.1.raw
  modified_base (549)..(560): a, c, t, g, unknown or other
  misc_feature (549)..(560): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatccagaggctccagtctgagatgaggctgattatactgtgcaatctggatgacagtgtagaacggttccgggttttcggcgggtacgggaccgaaggcgtacggacccgttaccgtaagttccgacgacccgaaacgggcctcggaccccccgttcgggtcccacttcccgttacggttcccccaccccttccgtcccacggacgtacgtaccttcggacgccggggctcgggcgaacggcgacagtaggcnnnnnnnnnnnn

SEQ ID NO: 225930 - DNA, 519 bp, Homo sapiens
  misc_feature: GYAE6OF02I133U.19.86.H09.1.454.CMB.1.raw
  modified_base (319)..(319): a, c, t, g, unknown or other
  misc_feature (319)..(319): n is a, c, g, or t
  modified_base (505)..(507): a, c, t, g, unknown or other
  misc_feature (505)..(507): n is a, c, g, or t
  modified_base (509)..(510): a, c, t, g, unknown or other
  misc_feature (509)..(510): n is a, c, g, or t
  modified_base (512)..(512): a, c, t, g, unknown or other
  misc_feature (512)..(512): n is a, c, g, or t
  modified_base (514)..(519): a, c, t, g, unknown or other
  misc_feature (514)..(519): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcagagggctccagtctgaagntgagctgattattactgtgcaatcgtggatgacagtgtgacggttccggtttcggcgggtaggaccgagcgtacgaccgtacgtaagtcacgcccgaaggcctccgcccccgttggtcctacttccgttccgtccccgccctcctccgacgagtacgtctgacgcggcgtggacgaggcacagtgnnncnncngnnnnnn

SEQ ID NO: 225931 - DNA, 491 bp, Homo sapiens
  misc_feature: GYAE6OF02F8M2V.19.86.H09.1.454.CMB.1.raw
  modified_base (484)..(491): a, c, t, g, unknown or other
  misc_feature (484)..(491): n is a, c, g, or t
tcagtactctcgtgcacgaccggtgctcgatttagtgctatagacttgggtttgggggccgttcctgggcccagtctgtgctgactcaggcacccgtcaggcgtctgggacccccgggcagacggtcaccatcgcttgttctgcaagccagctcgaacatcgggagcagtggtgtgatgtggtatcagaaagtcccaggacggccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcgggagggccaagctgaccgtctaagtcagcccaaggctcgcccctcggtcactctcgttcccaccctcctccacgacgatactgagcggctggcaaggcgcagtagnnnnnnnn

SEQ ID NO: 225932 - DNA, 530 bp, Homo sapiens
  misc_feature: GYAE6OF02HAHD7.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggctgagtggatagggcggatccgacggtggtagtggtggcgcatacgtcgcacgagaagtttcgagggccgcgtcaccatggaccaaggtcgcgtccacgaatacgagtgtatagtggtacttgagcagcctgagtctgacgacgacggccagtgtattagttgtggcgaggcgagggaccggggagtaacgggctaagtaaaggtcggttaccgtaccccggg

SEQ ID NO: 225933 - DNA, 517 bp, Homo sapiens
  misc_feature: GYAE6OF02HVYB6.19.86.H09.1.454.CMB.1.raw
  modified_base (477)..(477): a, c, t, g, unknown or other
  misc_feature (477)..(477): n is a, c, g, or t
  modified_base (505)..(510): a, c, t, g, unknown or other
  misc_feature (505)..(510): n is a, c, g, or t
  modified_base (512)..(517): a, c, t, g, unknown or other
  misc_feature (512)..(517): n is a, c, g, or t
tcagtactctcgtgcacgaccggtgctcgatttagtgctatagacttgggtttgggggccgttcctgggcccagtctgtgctgactcaggcaccctcagcgtctggggacccccgggcagacggtcaccatcgcttgttctgcaagcagctcgaacatcgggagcagtggtgtgatgtggtatcagaaagtccccaggaaccggcccccaaactcgtcaattctataatgacgctgagcggttccttaagggtccctgaccgattctctggcgagtaggtctggcgcctcagcttccctggccatcagagggctccgagtctgaagatgaggctgtatttattacgtgtcgctaatcgtagggatgacgtagtgtagtaacggttcggtttcggcggagggaccaagctacgaccgtctaagtcacgccaaggctcgcccttcgtcactctcgtcccacctcaccagacgacgtacncgacgcgggctggacgaggcgcagtagnnnnnncnnnnnn

SEQ ID NO: 225934 - DNA, 656 bp, Homo sapiens
  misc_feature: GYAE6OF02HGVIU.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctcctgcgaggcttttggatacaccttcagtcattatcatatactctgggtgcgacacggcccctggacgaagggcttggagtggatagggcggatccgacgggtggtaggtgggtggcgcagtacgtcgcaacgaggtaacgtttcgacgggccgcgtcaccagtcggaccaagggtcgcgtacccgaacgtaaactacgtaagttgtaatagtcggactttggacgtcgaacgtccgtaggtacggtcgtacgggtaaccgaaccgacccgggtaccctaagttacggtacttttaacgttcgggttacgggaccggtaaggggtaccggtaaacgggggtacccgggggtaacgttaaaacggggaccttaaaagggtaaaaccgggtttcggggttaccccggtaaccccccggggg

SEQ ID NO: 225935 - DNA, 513 bp, Homo sapiens
  misc_feature: GYAE6OF02I8WHY.19.86.H09.1.454.CMB.1.raw
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
  modified_base (501)..(513): a, c, t, g, unknown or other
  misc_feature (501)..(513): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgtattctctggcgagaggtctggcgcctcagcttccctggccatcagagggctccagtctgaagatgaggctgattattactgtgcaatctgggatgactagtgtgtaacgggttccggttttcggcgggtagggaccaagctgaccgtcctaagtcagccaaggctcgcccctgtcnctctcgttccccnccctcctccacgacgtacgtacgtgacgcgggctgggcaacgggcgacgagtacgnnnnnnnnnnnnn

SEQ ID NO: 225936 - DNA, 664 bp, Homo sapiens
  misc_feature: GYAE6OF02IKL6A.19.86.H09.1.454.CMB.1.raw
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
  modified_base (385)..(385): a, c, t, g, unknown or other
  misc_feature (385)..(385): n is a, c, g, or t
  modified_base (397)..(397): a, c, t, g, unknown or other
  misc_feature (397)..(397): n is a, c, g, or t
tcagtactctcgtgcacgaccggtgctcgatttagtgctatagacttgggtttgggggtaggcgatcacccagcaaccacatctgtcctctagagaatcccctgagagctccgttcctcaccatggactggacctggaggatcctcctcttggtggcagcagccaccggacgcccacctcccaggtcgcagctggtgcagtcgtggggctgaggtggaaggagccgtggggcctcaggtgaaggtctccgtgcgaggtcttttggattacaccttnagtcattatnatatactcgtgggtcncgagacggtcccctagggaactaaggggctttaggacggtagggagtaggggcggatccgaagggtggtagtgggtgggcganaggttacgtcgnaacgtaagtaacggtttcgaaggggcccgacgtaccactacgtcgggaccaaacgggtccaccgggtaccaacggaagtacgaaggttgtaacgtagtcggtacgttaggagtgacggtctacgggagtccgtaggacgtaccgacggtccagttatagttttagtcggttaagaccgggtaacggtacggaacgggggttaacggggacgttaaaacgggccgttaaaggtaaaagggtttccgggttaacccggaacccccgggg

SEQ ID NO: 225937 - DNA, 502 bp, Homo sapiens
  misc_feature: GYAE6OF02HQ2PK.19.86.H09.1.454.CMB.1.raw
  modified_base (490)..(502): a, c, t, g, unknown or other
  misc_feature (490)..(502): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagaggctccagtctgaagatgaggctgattattactgtgcaatctgggatgacagtgtgaacggttccggtttcggcggagggaccaagctggaccgtctagtcagccaggctcgcccctgtcactctcgtcccaccctcctccgacgacgacgtacgtcgacggcgggctcgggacacgggcgcgagtgnnnnnnnnnnnnn

SEQ ID NO: 225938 - DNA, 513 bp, Homo sapiens
  misc_feature: GYAE6OF02FU3OZ.19.86.H09.1.454.CMB.1.raw
  modified_base (442)..(442): a, c, t, g, unknown or other
  misc_feature (442)..(442): n is a, c, g, or t
  modified_base (483)..(483): a, c, t, g, unknown or other
  misc_feature (483)..(483): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggagtagggcggatccgacggtggtagtggtggcgcatacggtcgcacagaagtttcgagggccgcgtcacatggccaaggtcgcgtccacgaatacagttgtatatggacttgagcagcctgagtcngacgacacggccatgtattatgtgcgaggcgagggacgggntaaggctaagtaacggtggttacgacccgg

SEQ ID NO: 225939 - DNA, 538 bp, Homo sapiens
  misc_feature: GYAE6OF02INPBW.19.86.H09.1.454.CMB.1.raw
  modified_base (365)..(365): a, c, t, g, unknown or other
  misc_feature (365)..(365): n is a, c, g, or t
tcagtactctcgtgcacgaccggtgctcgatttagtgctatagacttggggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctcctgcgaggtcttttggatacaccttcagtcattatcatatactctgggtgcgacaggcccctggacaagggcttgagtggatagggcggatccgacggtggtagtgggtggcgcagtacgtcgcanagtaagtttcagggccgcgtcaccgatggaccaaggtcgcgtccacgatacagtgtatagtaggacttgagcagcctgagtctgacgacgacggccagttagtattagttggtgacggaggcgaagggaccggggtacgtaaagggcaagtaaggtcggtaccgtaccccggg

SEQ ID NO: 225940 - DNA, 523 bp, Homo sapiens
  misc_feature: GYAE6OF02I3LLL.19.86.H09.1.454.CMB.1.raw
  modified_base (475)..(475): a, c, t, g, unknown or other
  misc_feature (475)..(475): n is a, c, g, or t
tcagtactctcgtgcacgaccggtgctcgatttagtgctatagacttgggtttgggggagagcatcacccagcaaccacatctgtcctctagagaatcccctgagagctccgttccctcaccatggactggacctggaggatcctcctcttggtggcagcagccaccggagcccactccccaggtgcagctggtgcagtctggggctgaggtgaaggagccgtgggcctcaggtgaaggtctcctgcgaggtcttttggataccaccttcagtcattatcatatatcgtgggtgcgacgacggccctaggacgaagggcttggagtggagtagggcgagtccgacggtggtagtggtgcgcagtacgtcgcacagagttcgagggcgcgtcacgagtcggccaaggtcgcgtcacgaatacagtgtatagtgatgagcagccgtagaggtctgacgacacgcatgtattagttgngacgaggacgaggggacggacgtaaggactaaggtaagtggtacccgg

SEQ ID NO: 225941 - DNA, 573 bp, Homo sapiens
  misc_feature: GYAE6OF02IGDAJ.19.86.H09.1.454.CMB.1.raw
  modified_base (287)..(287): a, c, t, g, unknown or other
  misc_feature (287)..(287): n is a, c, g, or t
  modified_base (354)..(354): a, c, t, g, unknown or other
  misc_feature (354)..(354): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactcgtgggtnccgacacggcccctggacaagggctttggagtggagtagggcgatccacggtggtaggtggtggcgnagtacgtcgcacgagtaagttcacggggccgcgtcaccgtatcgggccaaggtcgccgtaccgaacgtaactacgagttgtatagtggacttgagcagccgtgaggtctagaccgaacgaccgggaccagttcgttatttacgttggtggacggagggaccgtaggggaacggggtactaaagggccgtaagtaaaggttcgggttaccgaaccccggg

SEQ ID NO: 225942 - DNA, 546 bp, Homo sapiens
  misc_feature: GYAE6OF02G5YB5.19.86.H09.1.454.CMB.1.raw
  modified_base (359)..(359): a, c, t, g, unknown or other
  misc_feature (359)..(359): n is a, c, g, or t
  modified_base (534)..(546): a, c, t, g, unknown or other
  misc_feature (534)..(546): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatggtggtatcagaaagtcccaggaaccggccccaaaatcgtacatctataatgacgctgagcggtctaagggtcctgaccgattctctggcgagaggtctggcgcctcagcttcccgtggccatcagacgggctccagtctgaagatgagctagtattattactgtgacaatcgtggactgaacngtagtgtaacggttcggtttcggcgggagggaccaagctgacgtactaagtcgagtacccaaggcctaccgcccccgtacggtcctacgtccgttcgttccccgccccgttcccgtccgacgtacgtaccgtggacggtcgggccgtacggtacgaaggtccgactaagtaggcnnnnnnnnnnnnn

SEQ ID NO: 225943 - DNA, 497 bp, Homo sapiens
  misc_feature: GYAE6OF02FENMD.19.86.H09.1.454.CMB.1.raw
  modified_base (485)..(497): a, c, t, g, unknown or other
  misc_feature (485)..(497): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggcttagggccctaggaccgattactcgtggcgagaggtctggcgcctcagcttccctggccatcagaggctccagtctagaagatgaggctgattattactgtgcaatctgggatgacagtgtgaacggttcggtttcggcggaggaccaagctgacctctaagtcacgcccaaggctcgcccctgtcactctcgttcccaccctctccagagacgttacgtgacgcggactggacgtaggcacagtacgnnnnnnnnnnnnn

SEQ ID NO: 225944 - DNA, 555 bp, Homo sapiens
  misc_feature: GYAE6OF02IBUU4.19.86.H09.1.454.CMB.1.raw
  modified_base (286)..(286): a, c, t, g, unknown or other
  misc_feature (286)..(286): n is a, c, g, or t
  modified_base (452)..(452): a, c, t, g, unknown or other
  misc_feature (452)..(452): n is a, c, g, or t
  modified_base (512)..(512): a, c, t, g, unknown or other
  misc_feature (512)..(512): n is a, c, g, or t
tcagtactctcgtgcacgaccggtgctcgattagtgctatagactttggggtttggggggaagaggaagactgacggtcccactcccaggtgcagctggtgcagtctggggctgaggtgaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgngtcaccatggcaaggtcgcgtccacgaatacagtgtatatggacttgagcagcctgaggtctggacgtacacggccagtgtaattattgtgcgaggcagggacggggctaaaggcaataaagtggttcgaccctggggcagggaaccctggtacaccgtctcctcncgcctaccgaccaacgggcccagtcggtccttccccgtggccgccctgcctccgaggacnccgacccgtccgagacgccacgacggcggtacccgtggtcccg

SEQ ID NO: 225945 - DNA, 503 bp, Homo sapiens
  misc_feature: GYAE6OF02GVP0A.19.86.H09.1.454.CMB.1.raw
  modified_base (490)..(494): a, c, t, g, unknown or other
  misc_feature (490)..(494): n is a, c, g, or t
  modified_base (497)..(503): a, c, t, g, unknown or other
  misc_feature (497)..(503): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtccaggaacgccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggttccggtttcggcggagggaccaagctgaccgtctaagtcagcccaaggcctcgcccctcggtcactctcgtcccgcctcctccacgagacgtacgtcgacgcgggctgggacacgggcgacgagtacgnnnnncgnnnnnnn

SEQ ID NO: 225946 - DNA, 425 bp, Homo sapiens
  misc_feature: GYAE6OF02HH676.19.86.H09.1.454.CMB.1.raw
  modified_base (418)..(425): a, c, t, g, unknown or other
  misc_feature (418)..(425): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggactacttcccacgagagtactgagcgggctgggcaaggcgcatagnnnnnnnn

SEQ ID NO: 225947 - DNA, 494 bp, Homo sapiens
  misc_feature: GYAE6OF02I0JVT.19.86.H09.1.454.CMB.1.raw
  modified_base (459)..(459): a, c, t, g, unknown or other
  misc_feature (459)..(459): n is a, c, g, or t
  modified_base (483)..(484): a, c, t, g, unknown or other
  misc_feature (483)..(484): n is a, c, g, or t
  modified_base (486)..(494): a, c, t, g, unknown or other
  misc_feature (486)..(494): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagcccaaggcctcgcccctcggtcactctcgttccccgccctcctccacgagagtacngacgcgggctggcaaggcgcatgnngnnnnnnnnn

SEQ ID NO: 225948 - DNA, 549 bp, Homo sapiens
  misc_feature: GYAE6OF02HHK1S.19.86.H09.1.454.CMB.1.raw
  modified_base (543)..(543): a, c, t, g, unknown or other
  misc_feature (543)..(543): n is a, c, g, or t
tcagtactctcgtgcacgaccggtgctcgattagtgctatagacttgggtttgggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaagggcagtaaagtggttcgacccgtggggccagggaaccctgggtcaccgtctcctcagcctccaccgaacgggcccagtccggtcctccccgtggcccgccctcgcctccgacggacgcgaccctccgagacgcaccgaggccggccgnggtccg

SEQ ID NO: 225949 - DNA, 529 bp, Homo sapiens
  misc_feature: GYAE6OF02JDYUB.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcgagtgaaggtctccgtgcgaggcttttggatacaccttcagtcattatcatatactctgggtgcgacaggcccctggacaagggcttggagtggagtagggcggatccgaggtggtaggtggtggcgcagtacgtcgcacagaagtttcagggccgcgtcaccatggaccaggtcgcgtccacgaatacgagtgtatatggacttggagcagcctgaggtctgacgacgacggccatgtattagttggtgcgaggcgaagggcgggactaagggcaagtaaggttcggtaccgtaaccccggg

SEQ ID NO: 225950 - DNA, 485 bp, Homo sapiens
  misc_feature: GYAE6OF02GA27B.19.86.H09.1.454.CMB.1.raw
  modified_base (468)..(468): a, c, t, g, unknown or other
  misc_feature (468)..(468): n is a, c, g, or t
  modified_base (474)..(485): a, c, t, g, unknown or other
  misc_feature (474)..(485): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattatactgtgcaatctggatgacagtgtgaacggttccggttttcggcgggaggacaagcgtgaccgtctaagtcagccaaggctcgcccctgtcactctcgtcccgccctcctcacgagagtctgacgcggctgcaggcncagtgnnnnnnnnnnnn

SEQ ID NO: 225951 - DNA, 424 bp, Homo sapiens
  misc_feature: GYAE6OF02HCHN6.19.86.H09.1.454.CMB.1.raw
  modified_base (419)..(424): a, c, t, g, unknown or other
  misc_feature (419)..(424): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgcccctgctccaggagcacctccgagagcacagcggccctgggctgcctggtcaaggactacttcccacgagagtactgagcgggctgggcaaggcgcatagnnnnnn

SEQ ID NO: 225952 - DNA, 541 bp, Homo sapiens
  misc_feature: GYAE6OF02FPAVL.19.86.H09.1.454.CMB.1.raw
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtcacgaatacagtgtatatggacttgagcagcctgaggtctgacgacacggccatgtattattgtgcgaggcaggacggggctaaaggcataaagtggttcgacccctggggccagggaaccctgggtcaccgtctcctcacgccctccaccaacgggcccatccggtccttcccccgtgccgccctgcctccgaggacgccacctccgagacgcaccgagccggccctgggccg

SEQ ID NO: 225953 - DNA, 502 bp, Homo sapiens
  misc_feature: GYAE6OF02HYULZ.19.86.H09.1.454.CMB.1.raw
  modified_base (261)..(261): a, c, t, g, unknown or other
  misc_feature (261)..(261): n is a, c, g, or t
  modified_base (490)..(493): a, c, t, g, unknown or other
  misc_feature (490)..(493): n is a, c, g, or t
  modified_base (495)..(502): a, c, t, g, unknown or other
  misc_feature (495)..(502): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattcnctggcgagaggtctggcgcctcagcttccctggccatcagagggctcagtctgaagatgagctgattatactgtgcaatctgggatgacagtgtgaacggtcggttttcggcgggaggaccaagctgaccgtcctaagtcagcccaaggctcgccccctcggtcactcctcgttcccgccctcctccacgacgagtaccgtgacgcggggctggcgaggcgcagtagcnnnngnnnnnnnn

SEQ ID NO: 225954 - DNA, 698 bp, Homo sapiens
  misc_feature: GYAE6OF02I7CF0.19.86.H09.1.454.CMB.1.raw
  modified_base (270)..(270): a, c, t, g, unknown or other
  misc_feature (270)..(270): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagctggggctcagtgaaggtctccgtgcgaggtcttttggatacacttcagtcattancatatactctggtgcgacacggcccctggaacaagggcttgagtggagtagggcggatccgacggtggtagtggtcggcgtacgatacggtcgctacgagtaacgtttcgagggcccgacgtacaccgtagtcgggaccaacgggtcgaccgttaccgaacggtaaacgttacacgggttagttaacgttacgttacgggtaaccgtttaggaacggtacccgtaacgggtaccccttagggtaacggggtttccgtaacgggtaaaccgggtacccgtaaaccggggtacccaaggtttaccgtttaacggttttaccggttagggttacggtacgggtaacgggtaccggaacggggtacggggggtaacttaaacgggacggtaaacgttaaacgggttcgggtttaacccgggaacccccgggg

SEQ ID NO: 225955 - DNA, 648 bp, Homo sapiens
  misc_feature: GYAE6OF02JACR3.19.86.H09.1.454.CMB.1.raw
  modified_base (164)..(164): a, c, t, g, unknown or other
  misc_feature (164)..(164): n is a, c, g, or t
  modified_base (277)..(277): a, c, t, g, unknown or other
  misc_feature (277)..(277): n is a, c, g, or t
  modified_base (318)..(318): a, c, t, g, unknown or other
  misc_feature (318)..(318): n is a, c, g, or t
  modified_base (626)..(626): a, c, t, g, unknown or other
  misc_feature (626)..(626): n is a, c, g, or t
  modified_base (636)..(636): a, c, t, g, unknown or other
  misc_feature (636)..(636): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
tcagtactctcgtgcacgaccggtgctcgatttagtgctatagacttgggtttgggggccgttcctgggcccagtctgtgctgactcaggcacccttcagcgtctgggacccccgggcagacggtcaccatcgcttgttctgcaagcagctcgaacatcgggancagtggtgtgatgtggtatcagaaagtccaaggaacgccccaaatcgtcatctataatgacgctgagcggtccttaagggtccctgaccgattctctggcgagaggtctggcncctcagccttccctggccatcaggaggctccagtcagaagntgagctgattattacgtgtgacaatcgtgggatgacaggtcgttaggtaaccggttccgggtttacggacgggtaacgggacccgtaaaggccgttacggaacccgttaccgtaaaggtcccgaacggaccccgtaaaggggtcccttacccggccccccgttacggttacccaaccgtttcccgtccgtttaccccctaaccccttccccgttacccgaaccgggtaccgtaccgttaaccgtacgggtaaccgggccggggtccgttacgggaccgttaacgggccggtaactacgtaaggcctanagcgagtcgngtgngntntgcg

SEQ ID NO: 225956 - DNA, 539 bp, Homo sapiens
  misc_feature: GYAE6OF02FX7LQ.19.86.H09.1.454.CMB.1.raw
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (529)..(529): a, c, t, g, unknown or other
  misc_feature (529)..(529): n is a, c, g, or t
  modified_base (532)..(539): a, c, t, g, unknown or other
  misc_feature (532)..(539): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctcttggcgagaggtctggcgcctcagcttccctggccatcagagggctccagtcctgaagatgaggctgattattactgtgcaatctgggatgacagtgtgaacggtccggttttcggcgggagggaccaagctgaccgtcctaagtcgagcccgaaggctaccgccccttcggtcctacttccgtcgttccccacccttccctaccgacgtacgtaacgttacctaggacggcgggactcgggacgaacggccgcgagtaacgnanncncgnnnnnnnn

SEQ ID NO: 225957 - DNA, 422 bp, Homo sapiens
  misc_feature: GYAE6OF02G5KH8.19.86.H09.1.454.CMB.1.raw
  modified_base (413)..(413): a, c, t, g, unknown or other
  misc_feature (413)..(413): n is a, c, g, or t
  modified_base (418)..(422): a, c, t, g, unknown or other
  misc_feature (418)..(422): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgcccctgctccaggagcacctccgagagcacagcggccctgggctgcctggtcaaggactacttcccacgagagtactgagcgggctggcaaggcgnatagnnnnn

SEQ ID NO: 225958 - DNA, 496 bp, Homo sapiens
  misc_feature: GYAE6OF02HDWFP.19.86.H09.1.454.CMB.1.raw
  modified_base (354)..(354): a, c, t, g, unknown or other
  misc_feature (354)..(354): n is a, c, g, or t
  modified_base (486)..(496): a, c, t, g, unknown or other
  misc_feature (486)..(496): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgagctgatttattactgtgcaatctgggatgacngtgtgaacggttccggtttggcggaggacaagctgacgtcaagtcagcccaggctcgcccctggtccactctcgttccccaccctcctccacgagacgtactcgacgcgggctgggcaagggcgacagtagnnnnnnnnnnn

SEQ ID NO: 225959 - DNA, 534 bp, Homo sapiens
  misc_feature: GYAE6OF02HTXSB.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggagtagggcggatccgacggtggtagtggtggcgcatacgtcgcacgagaagtttcgagggccgcgtcaccatcggccaaggtcgcgtccacgaatacagtgtatagtggtacttgagcagccgtgaggtctgacgacgacggccagtgtatttagttgtggcgaggcgagggacggggacgtaagggcaaggtaaaggtcggttaccgtaaccccggg

SEQ ID NO: 225960 - DNA, 792 bp, Homo sapiens
  misc_feature: GYAE6OF02JDVJL.19.86.H09.1.454.CMB.1.raw
  modified_base (260)..(260): a, c, t, g, unknown or other
  misc_feature (260)..(260): n is a, c, g, or t
tcagtactctcgtgcacgaccggtgctcgatttagtgctatagacttgggtttggggccggttcctgggcccaccgtcctggttcgcgtgtactcaggtcgacctcagcgtctggaccccgggcagacggtcacatcgcttgtcgtgtcgagcagctcggttaacctattcgggatacttaaggtggtcgtgatgtggtatcagaacgttccgaggaacggtcccccaaaggtcggtctagtcctagtaacgtgggaccncgtagacgtccggttccttaagggtccctgaccgtactttctcgtaggtccgacgtaggtctaggtacgtccgtctagtcttccccgtacggcccgtacgttccgaaggccgggtcccgtaccggaggtaccgttaggaaagtaagttcggaacggtccgtagggttaattttaacggttaaaccgttagttacggaccgtaaatttaccgtagggtaattagtaacgtaggtacgtaagtaccggttaccgggttttacggacggggaacggaccgtaagtccgtacgaccgttacctaacgtcgatacccgtaacgaccgtaccgtccccgtcggtcctaaccttccgttacgttaaccccgtcccgttacccgttacccgaccggtaacgtacggtaccgtacgggtacgggtacccggggccgttacggggacccgtaagggtccgttaaccgtaacggttacgggtacggacgtacggagtaacggtacggttagtaaccggttgggttaggtacgggcgtaacggg

SEQ ID NO: 225961 - DNA, 501 bp, Homo sapiens
  misc_feature: GYAE6OF02GXJGB.19.86.H09.1.454.CMB.1.raw
  modified_base (352)..(352): a, c, t, g, unknown or other
  misc_feature (352)..(352): n is a, c, g, or t
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (492)..(493): a, c, t, g, unknown or other
  misc_feature (492)..(493): n is a, c, g, or t
  modified_base (495)..(501): a, c, t, g, unknown or other
  misc_feature (495)..(501): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattattactgtgacaatctggatgacngtgtagaacggttcggtttcggcggaggacagctgaccgtcgtagtcagccgaaggcctcgcccctcgtcnctctcgtcccgcccttcctccgacgagacgtacngacgcgggtctggacgaacggcgcagtcgncngcnngnnnnnnn

SEQ ID NO: 225962 - DNA, 524 bp, Homo sapiens
  misc_feature: GYAE6OF02GZ0KI.19.86.H09.1.454.CMB.1.raw
  modified_base (451)..(451): a, c, t, g, unknown or other
  misc_feature (451)..(451): n is a, c, g, or t
  modified_base (508)..(508): a, c, t, g, unknown or other
  misc_feature (508)..(508): n is a, c, g, or t
  modified_base (516)..(518): a, c, t, g, unknown or other
  misc_feature (516)..(518): n is a, c, g, or t
  modified_base (520)..(520): a, c, t, g, unknown or other
  misc_feature (520)..(520): n is a, c, g, or t
  modified_base (522)..(523): a, c, t, g, unknown or other
  misc_feature (522)..(523): n is a, c, g, or t
tcagtactctcgtgcacgaccggtgctcgatttagtgctatagacttgggtttgggggccgttcctggggcccagtctgtgctgactcaggcaccctcagcgtctgggaccccgggcagacgtcaccatcgcttgttctgcaagcagctcgaacatcgggagtcaggtggtgtgtatggtggtatcagaaagtcccaggaaccgccccaaatcgtcatctagtaatgacgctgacgcgggtccttaagggtccctgacccgtattcctcgtggccgagaggtctggcgcctcagcttccctggccatcagagggctccagtctgagatgaggctggattagttactgtgcaatctgggatgacagtgtagtacggtcggtttcggcgtagggacagctgaccgtctagtcagccagctcgcccctggtccactctcgttccccgccgtccnccgacgacgacgttactcggacgccgggtctacgggacaacgggcgacgagtcgagnactgcagnnncncnnc

SEQ ID NO: 225963 - DNA, 787 bp, Homo sapiens
  misc_feature: GYAE6OF02IPQ4M.19.86.H09.1.454.CMB.1.raw
  modified_base (782)..(782): a, c, t, g, unknown or other
  misc_feature (782)..(782): n is a, c, g, or t
tcagtactctcgtgcacgaccggtgctcgatttagtgctatagacttggggttttgggggccgttcctgggcccagtctgtgctgactcaggcacctcaggccgtctggaccccgggcacgacgggtcaccatcgcttgttctggcaacgcacgctcgaacatcgggagccaagttggtacgtgtatcgtggttactccagtaaacgttcccaggaacggtccccctaaaacttcggtacaactactataatcgaacgtcctaggtacggccggggttaccgtttaaaggggtcccctaggacccgtaatttccgtacgtcggcgtacgtaggtccgttgggtccgccgttcgacgccttaaccccgtggggccctacgttcccaaggaacggggcttcccgaggttcctaggaaggtattgaggtcctaggtatttagttacgtaggttcggtaccaattcgtacggggtataggtacgtaggtagtaggaaccggttccgggtttttcgggacggggtaacgggaaccgtaaacggtccgtacgtaacccgttacccgttaaacggtactacggtacccgaaggcccgttcccggtccccctaccgggtaccctaacccgtttccgttaccgttttaccccttaccccgttacccttacccgttaaccggtaacgttacgttaaccgtacggtaacggttacgggtccgttacgggtaccgtaaacgggtcggtaccgtaacggtcggacggtacgcgagagtacgacgtacgtagcggntgacg

SEQ ID NO: 225964 - DNA, 498 bp, Homo sapiens
  misc_feature: GYAE6OF02FHX3D.19.86.H09.1.454.CMB.1.raw
  modified_base (487)..(498): a, c, t, g, unknown or other
  misc_feature (487)..(498): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcgggagggaccaagctgaccgtcctaagtcagcccaaggctcgcccctcggtcactctcgttcccaccctcctccacgagacgtactgacgcgggctggcaaggcgcatagnnnnnnnnnnnn

SEQ ID NO: 225965 - DNA, 543 bp, Homo sapiens
  misc_feature: GYAE6OF02HP0W2.19.86.H09.1.454.CMB.1.raw
  modified_base (286)..(286): a, c, t, g, unknown or other
  misc_feature (286)..(286): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacacctttcagtcattatcatatactctgggtgcgacaggcccctggacaagggcttgagtggatagggcggatccacggtggtagtggtggcgcatacgtcgcacagaagtttcagggccgngtcaccatggccaaggtcgcgtccacgaatacagtgtatatggacttgagcagcctgaggtctgacgacacggccatgtattatgtgcgaggcaggacggggctaaaggcataagtggttacgaccctggggccagggaaccctggtcaccgtctcctcagccctccacccgaagggcccacgtccggtccttcccccgtggcccgccctcgctccgaggacgcaccgtccgagacgcacaggccggccgtggtccg

SEQ ID NO: 225966 - DNA, 506 bp, Homo sapiens
  misc_feature: GYAE6OF02FPRIR.19.86.H09.1.454.CMB.1.raw
  modified_base (492)..(492): a, c, t, g, unknown or other
  misc_feature (492)..(492): n is a, c, g, or t
  modified_base (495)..(498): a, c, t, g, unknown or other
  misc_feature (495)..(498): n is a, c, g, or t
  modified_base (500)..(501): a, c, t, g, unknown or other
  misc_feature (500)..(501): n is a, c, g, or t
  modified_base (504)..(506): a, c, t, g, unknown or other
  misc_feature (504)..(506): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagaggctccagtctgaagatgaggctgattattactgtgcaatctgggatgacagtgtgaacggttccggttttcggcggagggaccaagctgaccgtctaagtcagcccaaggctcgccccttcggtcactctcgttccccgcccttcctccacgacgtacgtactgacgcgggctggacgaggcgcagtagncgnnnncnngcnnn

SEQ ID NO: 225967 - DNA, 432 bp, Homo sapiens
  misc_feature: GYAE6OF02HJ1V2.19.86.H09.1.454.CMB.1.raw
  modified_base (423)..(432): a, c, t, g, unknown or other
  misc_feature (423)..(432): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaacccctggtcaccgtctcctcagcctccaccaagggcccatcggtcttccccctggccgcccctgctcccaggacgcaccctccgagagcacagcggccctgggctgcctggtcaaggactacttcccacgagagtactgagcgggctggcaaggcgcatagnnnnnnnnnn

SEQ ID NO: 225968 - DNA, 781 bp, Homo sapiens
  misc_feature: GYAE6OF02JXSHX.19.86.H09.1.454.CMB.1.raw
  modified_base (163)..(163): a, c, t, g, unknown or other
  misc_feature (163)..(163): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (756)..(756): a, c, t, g, unknown or other
  misc_feature (756)..(756): n is a, c, g, or t
  modified_base (770)..(770): a, c, t, g, unknown or other
  misc_feature (770)..(770): n is a, c, g, or t
tcagtactctcgtgcacgaccggtgctcgatttagtgctatagacttgggtttggggccgttcctgggcccagtctgtgctgactcaggcaccctcagcgtctcgggacccccgggcagacggtcaccatcgcttgttctgcaagcagctcgaacatcgggancagtggtgtgatgtggtatcagaaagtcccaggaaccgccccaaatcgcatctataatgacgctgagccggtacttaagggccctgaccgtattcnctggngagtagtcaggtccnctcagcttcccgtggaccatcaacggcggtctaccgtagtctacggaacgtagtacggaaggtccgttcgtaaagtttacgttacctaaggttccggtactaacggtaccggttaaggggtaagtttacggacgttaaggttcggtttaaccgggtaaaccggggttttcccgggttttaccgggggacgggtaaacggggtaaccctaaacgggtccgtaacgggtaccccgttaccgtaaacggttacccgaacggtaccccgtaaacgggtccttaacccggtacccccgttccgggttacctaacccggtttccctaccgggtttacccccctaccccgttacccgtttaccccggaaaccggtaccggtaaccgttaaccggtcgggtaaaccgggtccggggtccgttaaccggggaccgttaaacgggcccgtaacgggttaccgaagggttccaacgtacggcgttacncgtaacggctacgngtacgtagtcg

SEQ ID NO: 225969 - DNA, 278 bp, Homo sapiens
  misc_feature: GYAE6OF02IE75L.19.86.H09.1.454.CMB.1.raw
  modified_base (253)..(278): a, c, t, g, unknown or other
  misc_feature (253)..(278): n is a, c, g, or t
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaaccgccccaaatcgtcatctataatgacgctgacggcgggctggcgaaggcgcatgnnnnnnnnnnnnnnnnnnnnnnnnnn

SEQ ID NO: 225970 - DNA, 315 bp, Homo sapiens
  misc_feature: GYAE6OF02FW7R7.19.86.H09.1.454.CMB.1.raw
  modified_base (306)..(315): a, c, t, g, unknown or other
  misc_feature (306)..(315): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaacgggcccatcggtccttcccccgtggccgccctgcctccgaggacgcacctccgagacgcacagccggccctgggctgcctggtcaaggactacttcccagagagtactgaggcggctggcaaggcgcatagnnnnnnnnnn

SEQ ID NO: 225971 - DNA, 426 bp, Homo sapiens
  misc_feature: GYAE6OF02GA57Y.19.86.H09.1.454.CMB.1.raw
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
  modified_base (417)..(426): a, c, t, g, unknown or other
  misc_feature (417)..(426): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaaggcataaagtggttcgacccctggggccagggaaccctggtcaccgtctcctcagcctccaccagggcccatcggtcttccccctggcnccctgctccaggnccacctccgagagcacagcggccctgggctgcctggtcaaggactacttcccacgagagtactgagcgggctggcaaggcgcatagnnnnnnnnnn

SEQ ID NO: 225972 - DNA, 551 bp, Homo sapiens
  misc_feature: GYAE6OF02H1PT4.19.86.H09.1.454.CMB.1.raw
tcagtactctcgtgcacgaccggtgctcgattagtgctatagacttgggtttgggggaagaggaagactgacggtcccactcccaggtgcagctggtgcagtctggggctgaggtgaaggagcctggggcctcagtgaaggtctcctgcgaggcttttggatacacctttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacgggctaaagggcaataaagtggttccgacccgtggggccaagggaccctggtcaccgttctcctcagccctccgaccaacgggcccagtccggtcccttcccgcggccgccctcgcctccgacggcgcaccgtccgagacgcaccgacggcggccccgtgggtccg

SEQ ID NO: 225973 - DNA, 492 bp, Homo sapiens
  misc_feature: GYAE6OF02FY1GE.19.86.H09.1.454.CMB.1.raw
  modified_base (320)..(320): a, c, t, g, unknown or other
  misc_feature (320)..(320): n is a, c, g, or t
  modified_base (413)..(413): a, c, t, g, unknown or other
  misc_feature (413)..(413): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
  modified_base (481)..(492): a, c, t, g, unknown or other
  misc_feature (481)..(492): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcgagagggctccagtctgaagntgaggctgattattactgtgacaatcgtgggatgacagtgtgaacgggttccggttttcggcgggaggcagctgaccgtctagtcagccagcncgccccgtcgtcactctcgtcccaccctcctcacgagacgtacncgagcggctggcaggcgnagtagnnnnnnnnnnnn

SEQ ID NO: 225974 - DNA, 527 bp, Homo sapiens
  misc_feature: GYAE6OF02F4T3N.19.86.H09.1.454.CMB.1.raw
  modified_base (279)..(279): a, c, t, g, unknown or other
  misc_feature (279)..(279): n is a, c, g, or t
  modified_base (319)..(319): a, c, t, g, unknown or other
  misc_feature (319)..(319): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (515)..(515): a, c, t, g, unknown or other
  misc_feature (515)..(515): n is a, c, g, or t
  modified_base (519)..(527): a, c, t, g, unknown or other
  misc_feature (519)..(527): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctgggcncctcagcttccctggccatcagagggctccagtctgaagntgaggctggatttattactgtncaatcnggatgacagtgtagacgggttccgggtttcggcggagggaccgagcgtgaccgtcctaagtcagcccaaggctcgccccgttcggtccacttcctcgttccccacctccctccacgacgacgttctcgacggcggcgtcggacgaacgggcgacgtacgtaggactgntcgnnnnnnnnn

SEQ ID NO: 225975 - DNA, 546 bp, Homo sapiens
  misc_feature: GYAE6OF02H3NQG.19.86.H09.1.454.CMB.1.raw
tcagtactctcgtgcacgaccggtgctcgattagtgctatagacttgggtttggggggaagaggaagactgacggtcccactcccaggtgcagctggtgcagtctggggctgaggtgaaggagcctgggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagtttcagggccgcgtcaccatggccaaaggtcgcgtccaacgaatacagtgtatatggacttgagcagcctgaggtctgacgacacggccaatgatttattgtgcgaggcgaggacgggcgtaaagacgataaagtaggttcgtacccgcgggcgagggaaccgtacgtacgaccgtctcctcacgccgtacccaccaacggaccgaactcgtccgtcccttccgcgccctcgctcgcgagcgacgccgacgacgacgacacgacgccgcggtccgg

SEQ ID NO: 225976 - DNA, 574 bp, Homo sapiens
  misc_feature: GYAE6OF02IIDIW.19.86.H09.1.454.CMB.1.raw
  modified_base (378)..(378): a, c, t, g, unknown or other
  misc_feature (378)..(378): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggctttttggatacaccttcagtcattatcatatactcgtgggtgcgacacggcccctggacaagggtcttgagtggagtagggcgatccgacggtggtaggtggtggcgcatacgtcgcacagtaagtttcagggccgcgtcaccatggaccaaggtcgcgtccacgaatacagtgtatatggacttgagcagcctgagtctgacgacacggcatgtattattgngcgaggcgagggacggggataaaggcaagtaaagtggttccgacccgtggggaccgaacgggtacccgtggtccaccgtcctcctcgacgccctaccgaccgaacgggaccctagtccggttcccttcccccgtggcccgccctcgccgtccgaggacgcctaccgtcgagacgcacgacggccggccgtggtccg

SEQ ID NO: 225977 - DNA, 536 bp, Homo sapiens
  misc_feature: GYAE6OF02HGC97.19.86.H09.1.454.CMB.1.raw
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctccgtgcgaggtcttttggatacaccttcagtcattatcatatactctgggtgcgacacggcccctggacgaagggcttggagtggagtagggcggatccgaggtggtaggtgggtggcgcgagtacgtcgacacgagtaagtttcgacgggccgcgtcaccagtcggaccaaggtcgcgtacacgtaatacagttagtatagtggtacttgacgcagcgtgagtctgacgacgacgcatgtattagttgngngnggngagggaggactaaaggcaagtaaggtcggtccgtacccggg

SEQ ID NO: 225978 - DNA, 552 bp, Homo sapiens
  misc_feature: GYAE6OF02FSL4X.19.86.H09.1.454.CMB.1.raw
  modified_base (391)..(391): a, c, t, g, unknown or other
  misc_feature (391)..(391): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggagcctggggcctcgagtgaaggtctccgtgcgaggtcttttggatacacttcagtcattatcatatactcgtggtgcgacaggccccgtggacgaagggcttgagtggagtagggcggatccgaggtggtagtgggtggcgcagtacgtcgcacagtaagttcgagggccgcgtcacngtcggccaaggtcgcgtccaacgaactacgagttgatagtgacttgacgcagcctggacgttcgtcgacgacgaccggactagtagttagttacgttgtggcggaggacgagggaacgggactaaacgggctaaggtaacggttggtacccgtaccccggg

SEQ ID NO: 225979 - DNA, 514 bp, Homo sapiens
  misc_feature: GYAE6OF02FXEE4.19.86.H09.1.454.CMB.1.raw
  modified_base (445)..(445): a, c, t, g, unknown or other
  misc_feature (445)..(445): n is a, c, g, or t
  modified_base (466)..(466): a, c, t, g, unknown or other
  misc_feature (466)..(466): n is a, c, g, or t
  modified_base (487)..(487): a, c, t, g, unknown or other
  misc_feature (487)..(487): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttggagtggagtagggcggatccgacggtggtagtggtggcgcatacgtcgcacagaagtttcagggccgcgtcacatcggccaaggtcgcgtccacgaatacagtgtatagtggtacttgagcagccgtgagtcngacgacacggccagtgtattntggtgcgaggcagggacgggntaaggcaagtaaggtggtccgacccgg

SEQ ID NO: 225980 - DNA, 566 bp, Homo sapiens
  misc_feature: GYAE6OF02F6E9O.19.86.H09.1.454.CMB.1.raw
  modified_base (520)..(520): a, c, t, g, unknown or other
  misc_feature (520)..(520): n is a, c, g, or t
  modified_base (544)..(544): a, c, t, g, unknown or other
  misc_feature (544)..(544): n is a, c, g, or t
tcagtactctcgtgcacgaccggtgctcgatttagtgctatagacttggggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctcctgcgaggcttttggatacaccttcagtcattatcatatactctgggtgcgacacggcccctggacgaagggcttgaggtggagtagggcggatccgacgggtggtaggtgggtggcgcatacggtcgcaacgagtaagtttcgacggggcccgtcggtcaaccgagtcgggacccgaaaggggttccgaccggttcccgaacgtaaactaccgaggttagtattagtggtaccttggagcagccgtgaggtctgacgacgacggccatgttattattggngcgaggcagggcgggactaacggnaagtaagtcggtcgtacccggg

SEQ ID NO: 225981 - DNA, 534 bp, Homo sapiens
  misc_feature: GYAE6OF02GAX28.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggccctggacaagggcttgagtggagtagggcggatccgacggtggtaggtggtggcgcagtacgtcgcacagtaagtttcgagggccgcgtcaccagtcggaccgaaggtcgcgtaccaacgaactacagtagtatagtggacttgacgcagcctgagtctagacgacacggcagtgtattagtggtgcggaggcgagggacgggacgtaaggctaagtaacggtcggttccgtaccccggg

SEQ ID NO: 225982 - DNA, 509 bp, Homo sapiens
  misc_feature: GYAE6OF02FOY4R.19.86.H09.1.454.CMB.1.raw
  modified_base (496)..(498): a, c, t, g, unknown or other
  misc_feature (496)..(498): n is a, c, g, or t
  modified_base (500)..(501): a, c, t, g, unknown or other
  misc_feature (500)..(501): n is a, c, g, or t
  modified_base (503)..(509): a, c, t, g, unknown or other
  misc_feature (503)..(509): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcgggagggaccaagctgaccgtcctaagtcagcccaaggcctgccccctcggtccactcctgttccccgcccttccctcccacgagacgttactggacgcgggctggcagggcgcagtcgnnngnncnnnnnnn

SEQ ID NO: 225983 - DNA, 499 bp, Homo sapiens
  misc_feature: GYAE6OF02HJSO3.19.86.H09.1.454.CMB.1.raw
  modified_base (489)..(499): a, c, t, g, unknown or other
  misc_feature (489)..(499): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtcggttttcggcggagggaccaagctgaccgtctaagtcagcccaaggctcgcccctcggtcactcctgttcccaccctcctccacgagacgtactgacgcgggctgggcacgggcgcagtagcnnnnnnnnnnn

SEQ ID NO: 225984 - DNA, 524 bp, Homo sapiens
  misc_feature: GYAE6OF02I5EQ6.19.86.H09.1.454.CMB.1.raw
  modified_base (258)..(258): a, c, t, g, unknown or other
  misc_feature (258)..(258): n is a, c, g, or t
  modified_base (511)..(511): a, c, t, g, unknown or other
  misc_feature (511)..(511): n is a, c, g, or t
  modified_base (513)..(517): a, c, t, g, unknown or other
  misc_feature (513)..(517): n is a, c, g, or t
  modified_base (519)..(524): a, c, t, g, unknown or other
  misc_feature (519)..(524): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgccccaaatcgtcatctataatgacgctgagcggtccttaagggtccctgaccgattcnctggcgagaggtctggcgcctcagcttccctggccatcagaggctccagtctgaagatgaggctgattatactgtgcaatctggatgacagtgtgaacggtcgtttcggcggaggaccaagctgacctctaagtcagcccaaggctcgcccctcggtccacgtcctcgttccccgcccctccgttcccaaccggagtaaccgtaaccttcggaacgtccggggcttcgggacaacgggccgactacgtaaggncnnnnncnnnnnn

SEQ ID NO: 225985 - DNA, 507 bp, Homo sapiens
  misc_feature: GYAE6OF02FSTUV.19.86.H09.1.454.CMB.1.raw
  modified_base (341)..(341): a, c, t, g, unknown or other
  misc_feature (341)..(341): n is a, c, g, or t
  modified_base (447)..(447): a, c, t, g, unknown or other
  misc_feature (447)..(447): n is a, c, g, or t
  modified_base (494)..(495): a, c, t, g, unknown or other
  misc_feature (494)..(495): n is a, c, g, or t
  modified_base (497)..(498): a, c, t, g, unknown or other
  misc_feature (497)..(498): n is a, c, g, or t
  modified_base (502)..(507): a, c, t, g, unknown or other
  misc_feature (502)..(507): n is a, c, g, or t
tcagtactctcgtgcacgaccggtgctcgatttagtgctatagacttgggtttgggggccgttcctgggcccagtctgtgctgactcaggcacccctcagcgtctgggaccccccgggcagacggtcaccatcgcttgttctgcaagcagctcgaacatcggggagcagtggtgtgatgtggtatcagaaagtcccaggaaccggcccccaaatcgtcatctataatgacgctgagcggtccttaagggtcctgaccgattctctggcgagaggtctggcgcctcagcttccctggccatcagagggctccagtctgaagatgaggctgattatactgtgnaatctaggatgacagtgtagaacgggttccgggttttcggcgggagggacagctgaccgtctaagtcacgccaaggcctacgccccgtcgtccactctcgttcccncccttcctccacgagtagtactgacgcggctggcgaggcgcacgtgnncnngacnnnnnn

SEQ ID NO: 225986 - DNA, 598 bp, Homo sapiens
  misc_feature: GYAE6OF02GLA5U.19.86.H09.1.454.CMB.1.raw
  modified_base (217)..(217): a, c, t, g, unknown or other
  misc_feature (217)..(217): n is a, c, g, or t
  modified_base (534)..(534): a, c, t, g, unknown or other
  misc_feature (534)..(534): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctggaggtgaaggngccgtgggcctcagtgaaggtctccgtgcgaggtcttttggatacaccttcagtcattatcattatactcgtgggtgacgacgacggcccctggacgaagggtcttggagtggagtagggcgatccgacggtggtaggtggtggcgcgaatacggtcgacgaacgaaggtaacgttcgacgggtccgcgtaccaaccgagtcgggaccgtaagggtccgaccggtaccaacgtaatacgtagtgtatagtgacttggacgcgagccgtaggtacggtctacggaacgacgaccggactagttagttattagttcggnggacggaggacggaacggggacgggtaactaaaggactaaaggttaacggtcggtaaccccggg

SEQ ID NO: 225987 - DNA, 576 bp, Homo sapiens
  misc_feature: GYAE6OF02H0XDL.19.86.H09.1.454.CMB.1.raw
  modified_base (293)..(293): a, c, t, g, unknown or other
  misc_feature (293)..(293): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (563)..(567): a, c, t, g, unknown or other
  misc_feature (563)..(567): n is a, c, g, or t
  modified_base (569)..(570): a, c, t, g, unknown or other
  misc_feature (569)..(570): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacggtcaccatcgcttgttctgcaagcagctcgaacatcgggagcagtggtgtgatgtggtattagaaagtcccaggaaagcccccaaatcgtcatctataatgacgctgagcggtccttaagggtccctgaccgattctctggcgagaggtctggcgcctcacgtcttcccnggccatcagaggctccagtctgaagatgaggctgattattactgtgacaatcgtgggatgacagtgtgaacggttccggtttgggacggagggacccaagtcgtacgtaccgtaccgtaaagtcgacgcccgaacggcctccggtcccccgtacggtccaccttccgttccgttccccacccctccctacccgaaccggaagacgttaaccgtcggacggcccggggtcgtcggaaccgaaacgggtccgaaccgtagtaacggngcngnnnnnannacncan

SEQ ID NO: 225988 - DNA, 531 bp, Homo sapiens
  misc_feature: GYAE6OF02JJLWP.19.86.H09.1.454.CMB.1.raw
  modified_base (357)..(357): a, c, t, g, unknown or other
  misc_feature (357)..(357): n is a, c, g, or t
tcagtactctcgtgcacgaccggtgctcgatttagtgctatagacttgggtttgggggaggcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcgagtgaaggtctcctgcgaggtcttttggatacaccttcagtcattatcatatactctagggtgcgacaggccccctggacaagggccttgagtggatagggcggatccacggtggtagtgggtggcgnatacgtgcacgagaagtttcgagggtccgcgtcaccgatcgggaccaaggtcgcgtccgacgaactaccaggttgtatagttggactttgagcagcctggacggtctagacgtacgacggccatgtattatgtgcgaggcagggacggctaaggcaagtaagtgttcgacccgg

SEQ ID NO: 225989 - DNA, 568 bp, Homo sapiens
  misc_feature: GYAE6OF02F4BIQ.19.86.H09.1.454.CMB.1.raw
  modified_base (100)..(100): a, c, t, g, unknown or other
  misc_feature (100)..(100): n is a, c, g, or t
  modified_base (146)..(146): a, c, t, g, unknown or other
  misc_feature (146)..(146): n is a, c, g, or t
  modified_base (169)..(169): a, c, t, g, unknown or other
  misc_feature (169)..(169): n is a, c, g, or t
  modified_base (177)..(177): a, c, t, g, unknown or other
  misc_feature (177)..(177): n is a, c, g, or t
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (559)..(568): a, c, t, g, unknown or other
  misc_feature (559)..(568): n is a, c, g, or t
tcagtactctcgtgcacgaccggtgctcgattttagtgctatagacttgggtttgggggccgttaccgtgggcccagtctgtgctgactcaggcaccctnacgcgtctgggacccccgggctagacggttcaccatcgcttgttcngcaagcagctcgaacatcgggancagtggtntgattgtggtaaccagaaacgtcccaggaaccggcccccaaactcgtcgaatctataatgaccnctggagcggtccttaagggtccctgaccgattcncgtggcgagaggtcgtggcgcctacagcttcctggccatcagagggctccgagtcgtagaagactcgacggctagtatttagttactgttacgacctaagttcgtgggattggactaggtgtaggtaacgggttccggttttacgggcggtacgggaacctagcgtacgtaccgtacgtagtcacgcccgaaggcctcgcccctggtcctacgttcgtcgttccctaccctcctccacgagtacgtactggacgcggcgtcggcgagtcgacagacgnancgannnnnnnnnn

SEQ ID NO: 225990 - DNA, 582 bp, Homo sapiens
  misc_feature: GYAE6OF02G67VY.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctccgtgcgaggtcttttggatactaccttcagtcattatcatatactcgtgggtgcgacacggcccctggacgaagggtcttggagtggagtagggcggtatccgacggtggtagtgggtggcgcagtacgtcgcacgagtaacgttcgacgggccgcgtcaccagtcggaccgaaggtccgcgtaccgaacgtaatacgaggttagtatagtgtacgttgacgcaacgccgtggacggtctcggaacgaccgacggcctagttgttactttagttggtcgacggtaggcgacgggacgggacgtaaacggcgtaaagtaacggttcggtacccggtaaccccggg

SEQ ID NO: 225991 - DNA, 593 bp, Homo sapiens
  misc_feature: GYAE6OF02FNT96.19.86.H09.1.454.CMB.1.raw
  modified_base (580)..(580): a, c, t, g, unknown or other
  misc_feature (580)..(580): n is a, c, g, or t
  modified_base (583)..(584): a, c, t, g, unknown or other
  misc_feature (583)..(584): n is a, c, g, or t
  modified_base (586)..(589): a, c, t, g, unknown or other
  misc_feature (586)..(589): n is a, c, g, or t
  modified_base (591)..(593): a, c, t, g, unknown or other
  misc_feature (591)..(593): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagccggtccttaacgggtccctgaccgattctctggcgagaggtctggcgcctcagccttccctcggccatcgaggacgggctccgagttctaggaagacgtagacggcttaggtaatttaattactgtcgactaatcgtgggatgactagtgtacggtaacgggttccgggttttcgggacgggtacgggaccgtaacggtcctacggacccgttacctaacgtccgacgacccgaacggcctccggtcccccgttcggtcctaccttccgtccgttcccctacccttccctaccgacgacgtacgtactggacggtccggacgtcggcgacgggcgacgacgtagcnganngnnnncnnn

SEQ ID NO: 225992 - DNA, 630 bp, Homo sapiens
  misc_feature: GYAE6OF02JAMHO.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactccccaggtgcagctggtgcagtcgtggggctggaggtgaaggagccgtggggcctcagtgaaggtctccgtgcgaggtcttttggataccaccttcagtcattatcatatactcgtgggtgcgacacggccctggacgaggcttgagtggagtagggcgacgtccgacggtggtaggtggtggcgcagtacgtcgcacgagtaagttcgagggccgcgtccaccagtcggaccgtaagggtccgcgtccaacgtaatacgagttgtatagtcggtacttggacgtcgagcccgttagggtacggttaccgtacggaaccgtaccgacccgggtccaagtttcggtttaattttagttcgggttaggccgggtaagggaccggtagggggaaccggggtaacgttaaaggggaccttaaaggtaaacgggtttcgggttaccccggtaacccccgggg

SEQ ID NO: 225993 - DNA, 454 bp, Homo sapiens
  misc_feature: GYAE6OF02ISOMC.19.86.H09.1.454.CMB.1.raw
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (432)..(454): a, c, t, g, unknown or other
  misc_feature (432)..(454): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgaccctggggccaggaaccctggtcaccgtctcctcagcctccaccaaggcccatcggtctccccctggccgccctgcctcaggancactccgngagcacacgcggcccnggggctcggacctggtcaagggtacctacgttccccacggagaagtactcgaagccgggctggacaaggcgcaagtacgnnnnnnnnnnnnnnnnnnnnnnn

SEQ ID NO: 225994 - DNA, 672 bp, Homo sapiens
  misc_feature: GYAE6OF02I6T5H.19.86.H09.1.454.CMB.1.raw
  modified_base (120)..(120): a, c, t, g, unknown or other
  misc_feature (120)..(120): n is a, c, g, or t
  modified_base (643)..(643): a, c, t, g, unknown or other
  misc_feature (643)..(643): n is a, c, g, or t
  modified_base (649)..(649): a, c, t, g, unknown or other
  misc_feature (649)..(649): n is a, c, g, or t
  modified_base (668)..(668): a, c, t, g, unknown or other
  misc_feature (668)..(668): n is a, c, g, or t
tcagtactctcgtgcacgaccggtgctcgatttagtgctatagacttggggtttggggccgttcctgggcccagtctgtgctgactcaggcacccgtccagcgtctcgggacccccgggngagaccggtcaccatcgcttgttctgcaagcagctcgaacatcgggagcagtcggtgtcgacttgtcggtatcagaaacgtcccaggaaccggaccccaaatcgtacattctaataatgacgtcgtcggacgccggttccttaaagggtcccttaggtaccgtatttccgtcgtgggcgtagtacggttctggccaccgtacgacggtccttccccctaggtccctatacgacggtacggtcctaccgtagttacgttagaaaggtcgtacggtacggtctagtacttagttacgtgtcgactaagtcgtaggacttacgacgtagttgtacggtacggtttaccggttacggcggaacggactaggtctacggtaccgttacgtaacgtcgtaccgtaccgtacggtccgttacccgtcccgttacggtacccacgttccgtaccgttcccgtaccttcctaccgacgtacgtaccgtacgtcggacggtcggactcggacgtacgacgtatacgtagtacngtacgntacgatctagcttcgcctntacg

SEQ ID NO: 225995 - DNA, 426 bp, Homo sapiens
  misc_feature: GYAE6OF02HQVJ9.19.86.H09.1.454.CMB.1.raw
  modified_base (330)..(330): a, c, t, g, unknown or other
  misc_feature (330)..(330): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
  modified_base (415)..(426): a, c, t, g, unknown or other
  misc_feature (415)..(426): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagtctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggngccacctccgagagcacagcggccctgggctgcctggtcaaggctactcccacgngagtactgagcggntggcaaggcgcatagnnnnnnnnnnnn

SEQ ID NO: 225996 - DNA, 771 bp, Homo sapiens
  misc_feature: GYAE6OF02JEJYV.19.86.H09.1.454.CMB.1.raw
  modified_base (758)..(758): a, c, t, g, unknown or other
  misc_feature (758)..(758): n is a, c, g, or t
  modified_base (769)..(769): a, c, t, g, unknown or other
  misc_feature (769)..(769): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagccggtaccttaagggtccctgaccgtattcctcgtggcgagaggtctggcgcctcagtccttccctggcctatccgaggtacgggctccgagtcctagaagataggaggtcgtaggtaatttacgttaactggtacggactaaactttccggtaggggtaattcggaacctagggttcggtacgggtaaacccgggggtttccggggtttttacggggaccggggtaacggggaacccgtaaggtacccgttcgggtaaccccggtttacccggtaaaggttacccggaaaccggtaccccgtaaacggggtcccgttcccggggtacccccccgttacggggttacccctaaccggtttcccgttacccggtttccccccctaaccccgttcccgtacccgtaaacccgggtacggttaaccggttaccgttaccgggtaccgggtccgggggtaccctacggggtaaccgaaccgggccgggttaccgtaaggtaaccgggctcgtcgaaccgcgtacgtaccncgacgcgacgngc

SEQ ID NO: 225997 - DNA, 526 bp, Homo sapiens
  misc_feature: GYAE6OF02HBJ1Z.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgagggtgaaggagcctggggcctcagtgaaggtctcctgcgaggcttttggatacacctttcagtcattatcatatactctgggtgcgacaggccctggacaagggcttgagtggatagggcggatccacggtggtagtggtggcgcatacggtcgcacgagaagtttcgagggccgcgtcacatcggcaaggtcgcgtccacgaatacagtgtatatggacttgagcaagcctgacggtctgacgacacggccatgttattagttgtggcgaaggcaaggggacggggactaaagggcaagttaaggtcggttaacccgg

SEQ ID NO: 225998 - DNA, 695 bp, Homo sapiens
  misc_feature: GYAE6OF02IJ9ON.19.86.H09.1.454.CMB.1.raw
  modified_base (672)..(672): a, c, t, g, unknown or other
  misc_feature (672)..(672): n is a, c, g, or t
  modified_base (680)..(680): a, c, t, g, unknown or other
  misc_feature (680)..(680): n is a, c, g, or t
  modified_base (687)..(687): a, c, t, g, unknown or other
  misc_feature (687)..(687): n is a, c, g, or t
  modified_base (690)..(690): a, c, t, g, unknown or other
  misc_feature (690)..(690): n is a, c, g, or t
  modified_base (694)..(694): a, c, t, g, unknown or other
  misc_feature (694)..(694): n is a, c, g, or t
tcagtactctcgtgcacgaccggtgctcgatttagtgctatagacttgggtttgggggccgttcctgggcccagtctgtgctgactcaggcaccctcagcgtctgggaccccccgggcagacggtcaccatcgcttgttctgcaagcagctcgaacatcgggagcagtggtgtgatgtggtatcagaaagtcccaggaccgccccaaatcgtcatctataatgacgctgagcggttccttaacgggtccctgaccgtattctcgtggcgagtacggtctcggccgcctcgagtccttcccgtggcccatcgagacggctccgagtctagaagatgaggtcttagtatttagtacgtgcgactaagttcgtaggggattcggaactaggttacggtacggttaaacccggggtttccgggttttacggggaacgggtacgggtaacccgaaggtccgtacggtaccccgttaccgttaacgtccgaacgtaccccgaagggtcccgttcccgaccccccgttccgggtcctaacccgtttcccgtttcccggtttacccccggcccctttacccgtacccctaacggtaccgtaaccgttaccgttacgggaccgggtcccgggtacgtaccgggtacgaaccgggtccgaacccgtagtaacggcacggtcncgagacgngtaccgngcncgtnc

SEQ ID NO: 225999 - DNA, 534 bp, Homo sapiens
  misc_feature: GYAE6OF02FZQ0A.19.86.H09.1.454.CMB.1.raw
  modified_base (519)..(519): a, c, t, g, unknown or other
  misc_feature (519)..(519): n is a, c, g, or t
  modified_base (525)..(526): a, c, t, g, unknown or other
  misc_feature (525)..(526): n is a, c, g, or t
  modified_base (529)..(534): a, c, t, g, unknown or other
  misc_feature (529)..(534): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttcccctggccatcagacgggctccagtcctgaagatgaggctgtatttattactgtgacaatcgtgggatgactagtgtggaaccggttccgggttttcgggcgggtacgggaccaaggctgacccgtctaagtcacgcccaaggctccggcccctggtccactcctcgacccctaccctcctacccacgagtacgtactggacgtcgggctagggacaagggccacgagtgnagcagnngcnnnnnn

SEQ ID NO: 226000 - DNA, 564 bp, Homo sapiens
  misc_feature: GYAE6OF02FWI3F.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctggaggtgaaggagccgtggggcctcgagtgaaggtctccgtgcgaggtcttttggatacaccttcagtcattatcatatactcgtgggtgcgacacggcccctggacgaagggcttgaggtggagtaggggcggatccgacggtggtagtgggtggcgcgagtacggtcgcaacgagtaaggtttcgagggccgcgtcaccgagtcggaccgaaggtcgcgtcccagaactacgagtgtatagtggacttgagcagcctggagtcgtcgaacgacgacggaccagttagtatttagttggtcgacggagggtcgaagggacggggtactaaagggctaagtaaaggtcggttacccgg

SEQ ID NO: 226001 - DNA, 665 bp, Homo sapiens
  misc_feature: GYAE6OF02G4YTN.19.86.H09.1.454.CMB.1.raw
  modified_base (259)..(259): a, c, t, g, unknown or other
  misc_feature (259)..(259): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtgggcctcgagtgacggtctccgtgcgaggtctttggatacnccgttcagtcattatcatatactcgtgggtgcgtacacggccccgtaggaccgaagggtcttggacgtaggagtacggggcggtacgtccgacggtggtaggtggtcggcgcgagtacggtcgcaacgaggtaagtttcgacggggtccgcgtcaaccgtagtcgggaccgtaaacgggtccgaccgtaccgaacggtaaacgtaccgaggttacgttaagtagttgggtaacgtttaggaacgtcgaacggtccgttaggacggttcgtacgtaaccgaccgtaaccggccctaagttcgttagtttacgtttggtcggaccggtaacgggaccgtaaggggtaccggggtaacgttaaacgggtacaaaggtttaacggttcgggttacccggtaaccccgggg

SEQ ID NO: 226002 - DNA, 628 bp, Homo sapiens
  misc_feature: GYAE6OF02HQUQP.19.86.H09.1.454.CMB.1.raw
  modified_base (619)..(619): a, c, t, g, unknown or other
  misc_feature (619)..(619): n is a, c, g, or t
  modified_base (622)..(624): a, c, t, g, unknown or other
  misc_feature (622)..(624): n is a, c, g, or t
  modified_base (627)..(628): a, c, t, g, unknown or other
  misc_feature (627)..(628): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacagtcgggagcagtggtgtgatgtggtatcagaaagtcccaggaaccgccccaaatcgtcatctataatgacgctgagcggttccttaagggtccctggaccgtattctcgtggcgtagaggtcgtggcgcctcgacgtccttccctcggccatccgaggacgggtcctccgagtctagaagagtgaggctagtatttatacgtgtagactaagtcgtaggtatagacgtaaggttcggtacggtaaacgggttttcccgggttttacggacgggtaacgggaccgtaaggtccgttaacggtacccgtttacgtaaacggttcaacgtacccggtaacggtccgtaccgtccccgttacggtcctaccgttccgtcgttcccacccttcctaccgacgtacgtacgtacgtcgacggtcggcgtacgggaccgtacggacgtacgagtaacgcgtacagcacgncgnnncgnn

SEQ ID NO: 226003 - DNA, 551 bp, Homo sapiens
  misc_feature: GYAE6OF02JT5YY.19.86.H09.1.454.CMB.1.raw
  modified_base (112)..(112): a, c, t, g, unknown or other
  misc_feature (112)..(112): n is a, c, g, or t
  modified_base (174)..(174): a, c, t, g, unknown or other
  misc_feature (174)..(174): n is a, c, g, or t
  modified_base (209)..(209): a, c, t, g, unknown or other
  misc_feature (209)..(209): n is a, c, g, or t
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
  modified_base (455)..(455): a, c, t, g, unknown or other
  misc_feature (455)..(455): n is a, c, g, or t
  modified_base (510)..(510): a, c, t, g, unknown or other
  misc_feature (510)..(510): n is a, c, g, or t
tcagtactctcgtgcacgaccggtgctcgatttagtgctatagacttggtttgggtaagaggaagactgacggtcctgccacaggtgtgctggcacggtggcactcgacacnccatgcgctcaactgtcttgtccaccttggtgtagctggtgcagtctgggctgagtgaaggngcctggcctcagtgaagtctcctgcgagtcaaggntaccacctttccgatcatttatcattactaccttcgtgggggtgcgaacncggccccgtaggaacaagggggctgaggcgagtgcggatcgacggtgtagtgcgcgnanacgtgcacagaattcgnggccgngtaccacagtcggcaaggtcgcgtccaagactacgagtgtaatnggcttnacgcagccttagngcngacncacggtcattgtatnttgtcgagnggacgagggacggggttaanaaaggactaagtaaagtcggtttccgaaccccgtgggggacccagggaaaccccnggttccgaccggtcctcctacgcgtcccacgaccacccggg

SEQ ID NO: 226004 - DNA, 663 bp, Homo sapiens
  misc_feature: GYAE6OF02G0B56.19.86.H09.1.454.CMB.1.raw
  modified_base (326)..(326): a, c, t, g, unknown or other
  misc_feature (326)..(326): n is a, c, g, or t
  modified_base (641)..(641): a, c, t, g, unknown or other
  misc_feature (641)..(641): n is a, c, g, or t
  modified_base (652)..(652): a, c, t, g, unknown or other
  misc_feature (652)..(652): n is a, c, g, or t
  modified_base (657)..(657): a, c, t, g, unknown or other
  misc_feature (657)..(657): n is a, c, g, or t
  modified_base (660)..(663): a, c, t, g, unknown or other
  misc_feature (660)..(663): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtaccttaagggtccctgaccgattctctggcgagaggtcgtggcgcctcagccttcccgtggccatcgagacggctccgagtctagaagntagacggctgtaatttattacgtgtgacaattcgtgggtactgaactaggtggtacggtaaccgggtttccgggttttcgggacgggaagggtaaccgaaggtccgttacggtaaccccgttaccgttaaacggtccgaacggaccccgtaaagggtcccgttccgaccccccggttcggttaccctaccgttcccttcccgtttaccccctaacccctttccccgtacccgaaccggtacgtaaccgttaaccgttcgggaccgggtccgggtcgtacgggaccgtaacgggcccggtaactaaggttaacggnacgtcgagacncgcgncgnnnn

SEQ ID NO: 226005 - DNA, 491 bp, Homo sapiens
  misc_feature: GYAE6OF02JGYW0.19.86.H09.1.454.CMB.1.raw
  modified_base (319)..(319): a, c, t, g, unknown or other
  misc_feature (319)..(319): n is a, c, g, or t
  modified_base (427)..(427): a, c, t, g, unknown or other
  misc_feature (427)..(427): n is a, c, g, or t
  modified_base (479)..(483): a, c, t, g, unknown or other
  misc_feature (479)..(483): n is a, c, g, or t
  modified_base (486)..(491): a, c, t, g, unknown or other
  misc_feature (486)..(491): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagntgaggctgattattactgtgcaatctgggatgacagtgtgaacggtccgttttcggcggagggaccagctcgacgtcctagcagcccaagctgcccctcggtcactcngttcccgcctcctccacgcgacgtactgagcggctcggcaggcgcagtagcnnnnngcnnnnnn

SEQ ID NO: 226006 - DNA, 501 bp, Homo sapiens
  misc_feature: GYAE6OF02HVSSG.19.86.H09.1.454.CMB.1.raw
  modified_base (164)..(164): a, c, t, g, unknown or other
  misc_feature (164)..(164): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (492)..(501): a, c, t, g, unknown or other
  misc_feature (492)..(501): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacggtcaccatcgcttgttctgcaagcagctcgaacatcgggancagtggtgtgatgtggtatcagaaagtcccaggaaccggcccccaaaactcgtcatctataatgacgctgagcggtccttaagggtccctgaccgattctcgtggcgagaggtctggcgcctcagtccttccctggccatcagagggctccagtctgaagatgagctgattattatgtncaatntgggangacngtgtgacggttccggtttggacggnggaccagctgaccgtactagcacgccaggctcgccctggtccnctctctcccncctccnccacgacgactacgtgacgcgggctcggacgacgacgntacgtagcngcnnnnnnnnnn

SEQ ID NO: 226007 - DNA, 436 bp, Homo sapiens
  misc_feature: GYAE6OF02IAK2W.19.86.H09.1.454.CMB.1.raw
  modified_base (280)..(280): a, c, t, g, unknown or other
  misc_feature (280)..(280): n is a, c, g, or t
  modified_base (333)..(333): a, c, t, g, unknown or other
  misc_feature (333)..(333): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (421)..(436): a, c, t, g, unknown or other
  misc_feature (421)..(436): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacgggctaaaggcataaagtggttcgaccctggggccagggaaccctggtcaccggtctcctcngcctccaccaagggcccatcggtccttccccctggccgcccctgcctccaggngccacctccgagacgcaacgagccggccctgggctcgcctggcaaggctactcccagagagtacngagccggctggcaaggcnanagnnnnnnnnnnnnnnnn

SEQ ID NO: 226008 - DNA, 688 bp, Homo sapiens
  misc_feature: GYAE6OF02F0GPQ.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctggaggtgaaggagccgtggggcctcgagtgaaggtctccgtgcgaggtcttttggatacaccttcagtcattatcatatactcgtgggtgcgacacggcccctaggacgaagggtcttggaggtggaagtagggcgatccgacggtggtagtgggtggcgacgagtacggtcgacacgagtaacgttcgacgggtccgcgtcaccgagtcgggaccgtaacgggtccgaccggtaccaacggtaaactaccgtaaggttaggttaattaacggttgggtaaccgtttagggaaccgtcgaacggtcccgttagggtaaccgggttccgtacggaaaccggaccgaccgggtaccgtaagtttacggtttacgtttagtttgggtacggacggtaacggggaccggaacgggggtaaccggggtaacgttaaacggggaccgtaaacgggtttaaacggttccggggttaacccgtacccccgggg

SEQ ID NO: 226009 - DNA, 733 bp, Homo sapiens
  misc_feature: GYAE6OF02G8YI0.19.86.H09.1.454.CMB.1.raw
  modified_base (217)..(217): a, c, t, g, unknown or other
  misc_feature (217)..(217): n is a, c, g, or t
  modified_base (274)..(274): a, c, t, g, unknown or other
  misc_feature (274)..(274): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatccctcctcttggtggcagcagccaccggagcccacctcccaggtgcagctggtgcagtcgtggggctgacggtgaaggngccgtggggcctcgagtgaaggtcctccgtagcgtaggtcgttttggatacaccttnaacgtcaattactcatatactcgtagggtgacgacgtacggtcccccgtaggaaccgaaggggcctttagggacggtagggtaacgtagggggtaccggtaacgttccggaccggggttagggtaacggtggggttcgggcggaccgtaacgttaccggttccggacctaaccgtaaaggtaaccggttttaccgaaccggggtcccgtaccgggttacccaacccgtagttccgggaacccgtaaacgggtccgggaccgttaccaaccggtaaactaccgtaaggttacgttagttaacgtgggtaccttagacgacaccggtacctggtaggtcctaggaaccgtacgaccggacctagtacgtagtttacgttaggtcggaccggtaagggacgacgggtaacggggacttaacgggaccttaaggtaaacggttcgggttacccgtaccccggg

SEQ ID NO: 226010 - DNA, 764 bp, Homo sapiens
  misc_feature: GYAE6OF02H7SGL.19.86.H09.1.454.CMB.1.raw
  modified_base (253)..(253): a, c, t, g, unknown or other
  misc_feature (253)..(253): n is a, c, g, or t
  modified_base (295)..(295): a, c, t, g, unknown or other
  misc_feature (295)..(295): n is a, c, g, or t
tcagtactctcgtgcacgaccggtgctcgatttagtgctatagacttgggtttgggggagagcatcacccagcaaccacatctgtcctctagagaatcccctgagagctccgttcctcaccactggactggacctgggaggatcctcctcttggtggcagcagccaccggagccccacctcccaggtgcagctggtgcgagtcgtggggctggaggtggaaggaggccgtggggcctcgagtgaaggtctcgngcggaggtcttttaggatacgaccttcgacgtcctatttaanctattattaccttcggtgggttgcggtaacgacggcccccgtagggtaaccgaaggggtcctttgggacggtagggtaacgttacgggggacggtacgtcccgtagggttagggtaggtcggggtgggaccggtactaaggttaccggtccgtaccgaacgtaaacggtaacgttttaccgggaacggggtcccggtccgttacccgaacctacggttaccggggaccgttaacggggtaccgcccgggttaccgaacgggtaaacttaacgaacggtttacgtaattaacggtacgggtactcggtaacgcgtaacggacccgtggtagggtccgttaggaaccgtacggaacccggtacgtacttagttaagttgttcgggtagtgggtaaccggacggtaccgggggaacgggtacggtaaaccgggtaccgtaaagttaacgggttaccgggtttaaccccgggg

SEQ ID NO: 226011 - DNA, 520 bp, Homo sapiens
  misc_feature: GYAE6OF02GXBYU.19.86.H09.1.454.CMB.1.raw
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (507)..(508): a, c, t, g, unknown or other
  misc_feature (507)..(508): n is a, c, g, or t
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
  modified_base (519)..(520): a, c, t, g, unknown or other
  misc_feature (519)..(520): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatcgtggatgacagtgtagacggtcggttttcggcgggacgggacaagctgaccgtctaagtcacgccaaggctccgcccccgtcgtccactcgtcgttcccaccctccctccacgacgtacgtacgtcggacgcgggcctggaccaggccgctagtacgntnagnngntgnactngnn

SEQ ID NO: 226012 - DNA, 560 bp, Homo sapiens
  misc_feature: GYAE6OF02GNP1X.19.86.H09.1.454.CMB.1.raw
  modified_base (453)..(453): a, c, t, g, unknown or other
  misc_feature (453)..(453): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggtcttttggatacaccttcagtcattatcatatactctgggtgcgacacggcccctggacgaagggcttgagtggatagggcggatccgacggtggtagtggtggcgcatacggtcgcacagtagtttcgagggccgcgtacaccatcggacctagggtccgcgtcccacgtaatacgagtgtatagtggtacttgagcacggcctggngtcgtcggaacgaccgacgaccagttagtattgttggtgacggaggtcgaacggggcgggtacgtaaagggacgtaagtaaacggttcggttaccgtaaccccgggg

SEQ ID NO: 226013 - DNA, 574 bp, Homo sapiens
  misc_feature: GYAE6OF02G6Q4D.19.86.H09.1.454.CMB.1.raw
  modified_base (259)..(259): a, c, t, g, unknown or other
  misc_feature (259)..(259): n is a, c, g, or t
  modified_base (561)..(561): a, c, t, g, unknown or other
  misc_feature (561)..(561): n is a, c, g, or t
  modified_base (564)..(566): a, c, t, g, unknown or other
  misc_feature (564)..(566): n is a, c, g, or t
  modified_base (568)..(574): a, c, t, g, unknown or other
  misc_feature (568)..(574): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtccaggaacggccccaaactcgtcatctataatgacgctgagcggtccttaagggtccctgaccgattcnctggcgagaggtctggcgcctcagcttccctggcccatcaggagggctccagtctgaagatgaggctgtattattacgtgtgactaattcgtcgggtatgactaggttgtacgtaacgggttccgggtttacgggcgggtaacgggaccgtaaggcgtacggtaaccgttaccgtaacgtcgtacggacccgaaggtcccgtaccggcccccgttaccgggtcctaccgttccgttccgttacccctaccctccctaccgaccgtagactacgtgacgcggctaggcgacggcacgagtgcngcnnngnnnnnnn

SEQ ID NO: 226014 - DNA, 510 bp, Homo sapiens
  misc_feature: GYAE6OF02JISJQ.19.86.H09.1.454.CMB.1.raw
  modified_base (319)..(319): a, c, t, g, unknown or other
  misc_feature (319)..(319): n is a, c, g, or t
  modified_base (452)..(452): a, c, t, g, unknown or other
  misc_feature (452)..(452): n is a, c, g, or t
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
  modified_base (500)..(510): a, c, t, g, unknown or other
  misc_feature (500)..(510): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagntgaggctgattattactgtgacaatctggatgacagtgtgaacggttccggtttacggcgggaaggaccaagcgtagaccgtacgtaagcagccaaggctccgcccctggccacgtctcgttcccgccctccnccacgacgtagtacnggagccgggntcggacaggcncgaatggancgnnnnnnnnnnn

SEQ ID NO: 226015 - DNA, 576 bp, Homo sapiens
  misc_feature: GYAE6OF02IRAVL.19.86.H09.1.454.CMB.1.raw
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctcctgcgaggtcttttggatacaccttcagtcattatcatatactcgtggtgcgacacggccctggacaaggcttgagtggagtagggcggatccgacggtggtagtgggtggcgctagtacgtcgacgaacgagtaacggtttcgacggggcccgtcgtaccaccgagtcggaccgaagggtccgacgtaccgaacgaatacagtagtatagtagtactgacgacgacgcctaggtacggtctacgaccgacgaccgcagttagtattagttggtgccggaggcgacggggacgggtacgtaaggacgtaagtaaggtcggtacccggtaaccccggg

SEQ ID NO: 226016 - DNA, 557 bp, Homo sapiens
  misc_feature: GYAE6OF02I4KKW.19.86.H09.1.454.CMB.1.raw
  modified_base (392)..(392): a, c, t, g, unknown or other
  misc_feature (392)..(392): n is a, c, g, or t
  modified_base (447)..(447): a, c, t, g, unknown or other
  misc_feature (447)..(447): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctagacgacacggccagtgtattattgtgcgaggcgaggacggggntaaaggcaagtaagtggttacgacccgtgggccgaggacctggtcaccgtctccncacgcctccaccgacggccacgtccgtccttccccgtggcccgtcccgtcgcctccgacggacgccgaccctccggacgacgccacgacggccgggtcccgtcgggtccg

SEQ ID NO: 226017 - DNA, 446 bp, Homo sapiens
  misc_feature: GYAE6OF02JHQPR.19.86.H09.1.454.CMB.1.raw
  modified_base (421)..(446): a, c, t, g, unknown or other
  misc_feature (421)..(446): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattatgtgcgaggcaggacggggctaaaggcataaagtggttcgacccctggggccaggggaaccctggtcaccgtctcctcagcctccaccaagggcccatcggtcttccccctggcgcccctgctccaggagccacctccgagagcacgagcggccctgggctgcctggtcaaggactactcccacgagagtactgagcgggctgggcaaggcgacatagnnnnnnnnnnnnnnnnnnnnnnnnnn

SEQ ID NO: 226018 - DNA, 830 bp, Homo sapiens
  misc_feature: GYAE6OF02JSBCL.19.86.H09.1.454.CMB.1.raw
  modified_base (157)..(157): a, c, t, g, unknown or other
  misc_feature (157)..(157): n is a, c, g, or t
  modified_base (169)..(169): a, c, t, g, unknown or other
  misc_feature (169)..(169): n is a, c, g, or t
tcagtactctcgtgcacgaccggtgctcgatttagtgctatagacttgggtttgggggagagcatcacccagcaaccacatctgtcctctagagaatcccctagagagctccgttcctcaccatggactggacctggaggatcctctctggtgcagnacgcacccgacncccacgtccacgtgcagtcgtggtgcgtggtcgtcgggtacgtacgaagggaggacggtcgggccggtcggtacgtcgtacggtacgtacggtcgtcgtaggtcgttacggtacgtttacgtaccttaccgtacgttacgttaactacttacttacgttactacgttacgttacggtcggtaccggaccgtacttttacgggttaaacggttgaaccggttaacggggttttaggtacggttacgggtacggtacgggtacggtacggaccggttaccggttttacggttacgggttcgggtcgacgtacgttaacggttaccggtaccggtaccggtaaccgttacggttaacgggttaccgggtaccgggtacccgggtaccggtaccgtaccggaaccggttaccgggtaaccgggtaacggttaccggttaccggttaaccgttaaccgtaacgtaacgaaaccggtacgttagttacgtacggtaacgtaccgtacgacggtaccggtaccgtacggtacgtacggtacgtacgaacgtacggtacgtacgtacggtaccggttacggtacgggtaacgggcgggtaactagggaccggtacgtaaccggtcgggttaccgtaacccggttacgggtacccgtaccggtaacccgg

SEQ ID NO: 226019 - DNA, 508 bp, Homo sapiens
  misc_feature: GYAE6OF02IWOZL.19.86.H09.1.454.CMB.1.raw
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (437)..(437): a, c, t, g, unknown or other
  misc_feature (437)..(437): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
  modified_base (496)..(499): a, c, t, g, unknown or other
  misc_feature (496)..(499): n is a, c, g, or t
  modified_base (501)..(508): a, c, t, g, unknown or other
  misc_feature (501)..(508): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggccctgaccgattctctgcgagaggtctggcgcctcacgcttccctggccatccgaggacgggcctccgagtctagaacgntggaggctgattatactgtncatcgtggatgactagtgtgaacggttccggtttcggcggaggaccagctagacgtctagtcagccagcctcgcccctgtctcttcgtcccnccctcctccacgtagacgtactcggacgcggcgtacggactacgggcncgatagntagnnnngnnnnnnnn

SEQ ID NO: 226020 - DNA, 567 bp, Homo sapiens
  misc_feature: GYAE6OF02GN88N.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggagcctggggcctcagtgaaggtctcctgcgaggtctttggatacacttcagtcattatcatatactctggtgcgacaggcccctggacaaggcttgagtggagtagggcggagtccgacggtggtaggtggtggcgcgatacgtcgcaacgagtaagtttcgacgggcgcgtcaccagtcggccaaggtcgcgtaccacgaatacgagtagtatagtggtactgagcagcctggacggtctagacgaacaccgggacagtgttagttagttggtcggacggtagggcgagggtaacggggtacgtaaagggttaacgttaaaggttcgggttacccggaccccggtaccggggg

SEQ ID NO: 226021 - DNA, 766 bp, Homo sapiens
  misc_feature: GYAE6OF02ICBLZ.19.86.H09.1.454.CMB.1.raw
  modified_base (764)..(764): a, c, t, g, unknown or other
  misc_feature (764)..(764): n is a, c, g, or t
tcagtactctcgtgcacgaccggtgctcgatttagtgctatagacgttggggtttgggggccgttcctgggcccagtctgtgctgactcaggcaccctcagcgtctgggaccccgggcagacggtcaccatcgcttgtctgcaagcagctcgaacatcgggagcagtggtgtgatgtggtatcagaaagtcccaggaaccggcccccaaatcgtccatctataatgacgctgagccggtccttaagggcctgaccgattctcgttggccgagtacggtctcggcgcctacgagtccttcccgtggcccaatccaggacgggccttacccgagttctaggaacgacgttaggacgggtccttagggtaatttaacgtttaccgtggttacgacccgtaaagttccgtagggggtaattcggaacgtacgggtttaggtacggtaaaccgggggttttcccgggttttacggggccggggtaacggggtaaccctaaggtcccgttacggtaccccggtttaccgtaaacggtaccgtaacggccccggtaaaggtcccgttacccggtacccccgttacgggttacctaccgttccgtttcccggttaccccccggtaccccttcccgtaccccgtaaaccgggttacgtaaaccggtttccggacggtaccggggtcccgggtacgttaccggggaaccggtaacgggtaccccggtagttaacggtcggccgttagctacgtgcggaaccttgcccgctacgntc

SEQ ID NO: 226022 - DNA, 509 bp, Homo sapiens
  misc_feature: GYAE6OF02HAZ32.19.86.H09.1.454.CMB.1.raw
  modified_base (334)..(334): a, c, t, g, unknown or other
  misc_feature (334)..(334): n is a, c, g, or t
  modified_base (453)..(453): a, c, t, g, unknown or other
  misc_feature (453)..(453): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (503)..(509): a, c, t, g, unknown or other
  misc_feature (503)..(509): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgtctgcaagcagctcgaacatcgggagcagtggtgtgatgtggtatcagaaagtcccaggaacgccccaaatcgtcatctataatgacgctgagcggtcttaagggtccctgaccgattctctggcgagaggtctggcgcctcagcttccctggccatcagagggctccagtctgaagatgaggctgattattactgtncaatctgggatgacagtgtgaacggtccggttttcggcggagggaccaagctgaccgtcctaagtcagtcccgaaggctcgccccctcggtcactctcgtccccacctccctccacganagtactgagcgggctgggacctaaggccgcgaagtacgcncngcgtancnnnnnnn

SEQ ID NO: 226023 - DNA, 701 bp, Homo sapiens
  misc_feature: GYAE6OF02G40NM.19.86.H09.1.454.CMB.1.raw
  modified_base (269)..(269): a, c, t, g, unknown or other
  misc_feature (269)..(269): n is a, c, g, or t
tcagtactctcgtgcacgaccggtgctcgatttagtgctatagacttggggtttgggagcagtcacccctagccaaccgacactacgtcgttccctcttagagaatcccctgagagctccgttcctcaccagtggactggacctggaggtagtcctcctcttggtggtctagcagcctaccggagcccacctccgaggtgccagctggtgcgaggtcgtggggctggtaggtgaaggcgtccgggtcgggcctcgagtgacggtctcgngcgacgtcgtttggacttacgtaccttgagtctatttagtctagttacttacgtcgtcggtcgtccgacgacgggccccgtaggacggaagggtcgttaggacgtacggagtacggggcggtacgtccggtacggttaggtaacgtggtcggacgtctaggtcgtcggacacgagttacgttccgacgggtccgtacgtccaaccgtacgtaacggaccgtaacggtccgtaccgtaccaacgtacgtacaaggttagtagtacgtacggtacttaggacgtaccgacggtccgtaggtacgttcgtacggtaaccgtacgtaccggtcgtaagttagttagtttagttaggtacggtaacggtaacggtcggaacgggtaacgggtacgtaaaggtcgtaagttaagggttccgttaccggtaaccccggg

SEQ ID NO: 226024 - DNA, 572 bp, Homo sapiens
  misc_feature: GYAE6OF02IC5NT.19.86.H09.1.454.CMB.1.raw
  modified_base (118)..(118): a, c, t, g, unknown or other
  misc_feature (118)..(118): n is a, c, g, or t
  modified_base (164)..(164): a, c, t, g, unknown or other
  misc_feature (164)..(164): n is a, c, g, or t
  modified_base (183)..(183): a, c, t, g, unknown or other
  misc_feature (183)..(183): n is a, c, g, or t
  modified_base (265)..(265): a, c, t, g, unknown or other
  misc_feature (265)..(265): n is a, c, g, or t
  modified_base (352)..(352): a, c, t, g, unknown or other
  misc_feature (352)..(352): n is a, c, g, or t
  modified_base (559)..(559): a, c, t, g, unknown or other
  misc_feature (559)..(559): n is a, c, g, or t
  modified_base (561)..(564): a, c, t, g, unknown or other
  misc_feature (561)..(564): n is a, c, g, or t
  modified_base (566)..(569): a, c, t, g, unknown or other
  misc_feature (566)..(569): n is a, c, g, or t
  modified_base (571)..(572): a, c, t, g, unknown or other
  misc_feature (571)..(572): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttctgcaagcagctcgaacatcgggancagtggtgtgatgtggtancagaaagtcccaggaaccggcccccaaatcgtcatctaataatgacgctgaggtccggtaccttaagggtccctagaccgtnttctcgtggcgagacggtctgggcgcctcagccttcccgtggcccatcagacgggcctccagtctgaagatgaggctgattatctgngacatcgtggatgacagtgagtacgggttccggtttggcggtacgggaccagctgacccgtacgtaagtcgacgacccgaaggcctacggtcccccgtaggtccctacttccgtccgtttaccccacccttcccgcccgtaacgtacggaacgttaccgtggaccggtccgggacgttgggaccgaaggaccgacttagaacggtcngnnnngnnnncnn

SEQ ID NO: 226025 - DNA, 495 bp, Homo sapiens
  misc_feature: GYAE6OF02IC5T9.19.86.H09.1.454.CMB.1.raw
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (484)..(485): a, c, t, g, unknown or other
  misc_feature (484)..(485): n is a, c, g, or t
  modified_base (489)..(495): a, c, t, g, unknown or other
  misc_feature (489)..(495): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgcccccaaactcgtcatctataatgacgctgagcggtaccttaagggtccctgaccgattctctggcgagaggtctggcgtcctcagcttccctggccatcagaggctccagtcctgacgatgaggctgtattattactgtgctaagtctgggatgacagtcgtgtaacggtcggtttcggagggtcggacaagctgaccgtctagtcacgccaaggctgcccctgtcnctcctctcccgcctcncaccgagctacngcgcggcgtgngacgtcgnacgtgacnntagnnnnnnn

SEQ ID NO: 226026 - DNA, 753 bp, Homo sapiens
  misc_feature: GYAE6OF02GFV1U.19.86.H09.1.454.CMB.1.raw
  modified_base (163)..(163): a, c, t, g, unknown or other
  misc_feature (163)..(163): n is a, c, g, or t
  modified_base (740)..(740): a, c, t, g, unknown or other
  misc_feature (740)..(740): n is a, c, g, or t
  modified_base (743)..(743): a, c, t, g, unknown or other
  misc_feature (743)..(743): n is a, c, g, or t
  modified_base (748)..(748): a, c, t, g, unknown or other
  misc_feature (748)..(748): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaagtcccaggaccgccccaaatcgtcatctataatgacgctgacgcggtccgttaagggtccctgaccgtattcctcgtggcgagaggtctggccgcctcagtccttcccgtggccacgtcgacggacgggcctaccgaggtccgtagaaacgtgttacggaggttacgttaggtaacttttacgtttacgtacggttagacctaaagtttcgtagggggtacttacgggaactaagggttaggttaacggggtaaacccggggtttttcccggggttttcgggggacccgggtaaaggggtaacccgtaaggtcccgttaccggtaacccggttacccgttaaacggtccgacccgtaaccccggtagggacccctccccggtaccccccgttcgggttacccctaccgtttcccgttcccttttacccccaccccgtttcccctaaccggaaccggtaccgtaacgttaccgtcggtaaccggggtcccgggtaccgtacgggaacccggtacgggtaccgaactaccgggtaacggccacggtcacggtgcncgngcgcngtgtc

SEQ ID NO: 226027 - DNA, 444 bp, Homo sapiens
  misc_feature: GYAE6OF02IBGM0.19.86.H09.1.454.CMB.1.raw
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
  modified_base (418)..(444): a, c, t, g, unknown or other
  misc_feature (418)..(444): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaaggcaataaagtggttcgacccctggggccagggaaccctggtcaccgtctcctcagcctccaccaaggcccatcgtcttcccccnggcgccctgctccaggancacctcgagancacngcgcccngggctcgctgtcaaggactacttcccacgagagtactgacgcgggctggacaggcgcatagcngnnnnnnnnnnnnnnnnnnnnnnnnnnn

SEQ ID NO: 226028 - DNA, 520 bp, Homo sapiens
  misc_feature: GYAE6OF02F4F8A.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctgggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagaagtttcgagggccgcgtcaccatggccaaggcgcgtccacgaatacagtgtatatggacttgagcagcctggaggtctgacgacgacggccatgtacttagttgtggccgaggcgagggacggggcttaaagggcaagttaaggtggttacccgg

SEQ ID NO: 226029 - DNA, 495 bp, Homo sapiens
  misc_feature: GYAE6OF02GQVEB.19.86.H09.1.454.CMB.1.raw
  modified_base (483)..(495): a, c, t, g, unknown or other
  misc_feature (483)..(495): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagaggctccagtctgaagatgagctgattattactgtgcaatctgggatgacagtgtgaacggtcggtttcggcggagggacgagcgtgaccgtctaagtcagcccaggctcgcccctcggtcactctcgttcccacccttccctccaccgagacgtactgacgcggctggcaggcgcagtnnnnnnnnnnnnn

SEQ ID NO: 226030 - DNA, 643 bp, Homo sapiens
  misc_feature: GYAE6OF02G84IR.19.86.H09.1.454.CMB.1.raw
  modified_base (226)..(226): a, c, t, g, unknown or other
  misc_feature (226)..(226): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctggaggtgaaggagccgtgggcctnagtgaaggtctctggcgaggtctttggatactaccttcagttcattatgatatactcgtggtgcgacgacggcccctggacgaagggtctggagtggagtagggcgatccgaggtcggtaggtggtggcgacgagtacgtcgcgtaacgagtaagtttcgacgggtccgcgtaccacacgtcggaccgaaagggtccgcgtaccaacgaagtaactaggttgtaagttagtggaacttagagacgagtaccgtggtaacgtcgtacggaccgtaaccgaccggtaccagtttagttaagttttaacgttcggtaggttaccggaagggacccggtaacggggaaccgggggtaacgttaaaacgggcctaaaagggttaaacgggttaccgggtttaaccccggttaacccccgggg

SEQ ID NO: 226031 - DNA, 682 bp, Homo sapiens
  misc_feature: GYAE6OF02IS4AE.19.86.H09.1.454.CMB.1.raw
  modified_base (296)..(296): a, c, t, g, unknown or other
  misc_feature (296)..(296): n is a, c, g, or t
  modified_base (666)..(666): a, c, t, g, unknown or other
  misc_feature (666)..(666): n is a, c, g, or t
  modified_base (672)..(673): a, c, t, g, unknown or other
  misc_feature (672)..(673): n is a, c, g, or t
  modified_base (677)..(678): a, c, t, g, unknown or other
  misc_feature (677)..(678): n is a, c, g, or t
  modified_base (680)..(681): a, c, t, g, unknown or other
  misc_feature (680)..(681): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaactcccaggaaccggcccccaaatcgtcatctataactgacgctgagcggtaccttaaggtccctgaccgattcgtctggcgagaggtctggcgcctcaggtccttccncggcctaactcaaggcgggtcctacccgtagttctacggaaggattcggaacggtctagtacgtttattaccgttgagtactaaagttccgtaggggtaactaggtaactagggttgtaacggggttaaccggtttcccggggtttttacgggaccggggtaacgggtaccgtaaacggtccgtacgtaacccggttaccgtaacggttacgaccgacggtaaccgtccgtaccgtcccccgtacggttacctaccgttccgttcccgttacccctaccccgttccctacccgtaacgacgtaacgtacgtacggtccgggtacgggcgttacggaccggaacggccgtacggtaacgtaacggactgcncgagcnngagnngnng

SEQ ID NO: 226032 - DNA, 646 bp, Homo sapiens
  misc_feature: GYAE6OF02IT7B6.19.86.H09.1.454.CMB.1.raw
  modified_base (197)..(197): a, c, t, g, unknown or other
  misc_feature (197)..(197): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggtcttttggatacaccttcagtcattatcatatactcgtgggtncgacaggcccctggacaagggcttgagtggatagggcgatccgaggtggtagtgggtggcgcatacgtcgcacagtaagtttcgagggccgcgtcaccatcggccaaggtcgcgtccacgaatacagtgtatatggacttgagcagcctgaggtctgacgacgacggccagtgtattatgtgtcggaggcgagggacggggtactaaagggctaagtaaaggtggttaccgacccgtcggggaccgaacggggtaccctgggtccaccgttcctcctcacgccctaccgaccgaacggggcccaagtcccggttaccccgttcccccgtgggcccgtaccccgtcgtcccgtcccggtaacgggacccggaccctaaccccggttacccggaaccggtacgaacccgtaaccggaaccgggccccggggtaccccggtggggtccccgg

SEQ ID NO: 226033 - DNA, 650 bp, Homo sapiens
  misc_feature: GYAE6OF02ILKOL.19.86.H09.1.454.CMB.1.raw
  modified_base (258)..(258): a, c, t, g, unknown or other
  misc_feature (258)..(258): n is a, c, g, or t
tcagtactctcgtgcacgaccggtgctcgatttagtgctatagacttgggtttgggggaagaggaagactgacggtcctgccacaggtggtgctgggcacggtgggcactcgacacaacatttgcgctcaactgtcttgtccaccttggtgtagctggtgcagtctggggctgaggtgaaggagcctggggcctcagtgaaggtctcctgcgaggtcttttggatacaccttcagtcattatcatatactctggggtncgacacggccctggacaagggcttgaggtggatagggcgatccgacggtggtagtggtggcgcagtacgtcgacacgagtaacgttcgagggcccgcgtcaccagtcggaccaaggtcgccgtaccgaacgaatacgagtcgtatagtggtacttggagcgagccgtaggtacggtctggaacgtaccgacggtacctagtacgttattagttcgtcggcggaggcgaggggaaccggggtacgtaaacgggctaaagtaaacgggttcggttaccggtaaccccggtcgggggaacccggtaaccgggtaaccccgtagggttaccccgtacccggttaccgttacccgtaccgtaccggtaccccgttacccgacccggtaaacccgggg

SEQ ID NO: 226034 - DNA, 283 bp, Homo sapiens
  misc_feature: GYAE6OF02G61PG.19.86.H09.1.454.CMB.1.raw
  modified_base (162)..(162): a, c, t, g, unknown or other
  misc_feature (162)..(162): n is a, c, g, or t
  modified_base (250)..(250): a, c, t, g, unknown or other
  misc_feature (250)..(250): n is a, c, g, or t
  modified_base (255)..(257): a, c, t, g, unknown or other
  misc_feature (255)..(257): n is a, c, g, or t
  modified_base (260)..(283): a, c, t, g, unknown or other
  misc_feature (260)..(283): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacgtcaccatcgcttgttctgcaagcagctcgaacatcgggancagtggtgtgatgtggtatcagaaagtcccagggaaccggcccccaaactcgtcatctaataatgacactgagcgggctggcaggcgntatgnnngcnnnnnnnnnnnnnnnnnnnnnnnn

SEQ ID NO: 226035 - DNA, 792 bp, Homo sapiens
  misc_feature: GYAE6OF02H660K.19.86.H09.1.454.CMB.1.raw
  modified_base (217)..(217): a, c, t, g, unknown or other
  misc_feature (217)..(217): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggacgcccactcccgaggtgcagctggtgcagtcgtggggctggaggtgaaggngccgtgggcctcgagtgaacggtctccgtgcggtaggtcgttttggactacctaccttacgagtactagttactactatattacgtcgtgggtcgacggaccgacggtcccgtagggacgtaagggtcgttaggacggtgggacgtaggggacggtacgtccggtaggggttggtacgggttgggtcggcgacgacggttaccggtcggtacaacgtacggttaacggtttcggacggggtcccgtcggttaccaccggtacggtccgggaaccggtaacgggtccggtaccgtaccgtaaaccggaaattaacggaggttactttaaagtacggttacgggttacttcgggaacggttccgtaagggtacccgtttagggacccgggtttcgtaaccgggtaacccgtaaccggtaaccggaccgttaagtttacgggttactttacgggttttacggacgggtaacgggtcggggtaacccggttaacggggggaacccggggttaacgtaaaccgggtaggtaaaacgggtttaacgggtttccccgggtaacccggttaacccccgggggg

SEQ ID NO: 226036 - DNA, 587 bp, Homo sapiens
  misc_feature: GYAE6OF02G7OX8.19.86.H09.1.454.CMB.1.raw
  modified_base (217)..(217): a, c, t, g, unknown or other
  misc_feature (217)..(217): n is a, c, g, or t
tcagtactctcgtgcacgaccggtgctcgatttagtgctatagacttggggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggngccgtggggcctcagtgaaggtctcctgcgaggcttttggatacacttcagtcattatctatatactcgtgggtgcgacgacggccctggacaagggcttggagtggagtaggggcggagtccgacggtggtaggtggtggcgcgagtacgtcgcgacagaagtttcgagggcgcgtcaccagtggcagtcgcgtccacgaatacgagtgtatagtggacttggagcagccgtgacggtctcgacggtacaccgggtaccagttagttacgtttagtttcggttagtccgggtaagggccggaagggggtaccgggggtaacggttaaaaggccggtaaaggttaaacgggttagggtttaacccccggg

SEQ ID NO: 226037 - DNA, 782 bp, Homo sapiens
  misc_feature: GYAE6OF02GDACA.19.86.H09.1.454.CMB.1.raw
  modified_base (771)..(771): a, c, t, g, unknown or other
  misc_feature (771)..(771): n is a, c, g, or t
  modified_base (774)..(775): a, c, t, g, unknown or other
  misc_feature (774)..(775): n is a, c, g, or t
  modified_base (778)..(778): a, c, t, g, unknown or other
  misc_feature (778)..(778): n is a, c, g, or t
  modified_base (780)..(780): a, c, t, g, unknown or other
  misc_feature (780)..(780): n is a, c, g, or t
  modified_base (782)..(782): a, c, t, g, unknown or other
  misc_feature (782)..(782): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcagaaagtcccgaaggaaccggccccaaactcgtcatctataatgacgctgacggtccggtaccttaacgggtccctggaccgtattctcgtggcgaggaggtctggcgtcctcgagtccttccctcggcctactcgacgggaacggggccctacccgtacggtccgtaggaaaggagtggtaagggtccgttaggtaactttaagtttacgtggttacgtacgtaaattcggttaggggtaattacggaccgtaaaggtttcggtaacgggttaaccggggtttttcccgggggtttttccggggaacccggggggtaacgggggtaacccgaaacggtaccggttaccgggtaaaccccggtttcccggttaaacgggtacccgtaacggacccccggtaaacgggtcccgtacccggtccccccggttacgggttaccctaacccgttcccgttcccgtttaacccccctcccgttacccccttacccgaccggtaaccggtaaacgttacccgtacgggtaccgggtccgggtccggtacgggaccgtaacggggcccgaccgtaagtcggtatcgactgacgngcnngcncntn

SEQ ID NO: 226038 - DNA, 498 bp, Homo sapiens
  misc_feature: GYAE6OF02JRACA.19.86.H09.1.454.CMB.1.raw
  modified_base (340)..(340): a, c, t, g, unknown or other
  misc_feature (340)..(340): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (465)..(498): a, c, t, g, unknown or other
  misc_feature (465)..(498): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaaggcataaagtggttcgacccctggggccaggaaccctggtcaccgtctcctcagcctccaccaagggccccagtccggtccttcccccgtggccgacccctgcctccaggcnccacccgtcgagagcacgacgcggcccgtgggctcgccgtggtcgaaaggccttaccttcccgacgtacgagttaccgtggacggcgggtcctcgggaccaagggtccgactaagtaggcngncnnnnnnnnnnnnnnnnnnnnnnnnnnnnnnnnnn

SEQ ID NO: 226039 - DNA, 574 bp, Homo sapiens
  misc_feature: GYAE6OF02ITIIJ.19.86.H09.1.454.CMB.1.raw
  modified_base (454)..(454): a, c, t, g, unknown or other
  misc_feature (454)..(454): n is a, c, g, or t
  modified_base (494)..(494): a, c, t, g, unknown or other
  misc_feature (494)..(494): n is a, c, g, or t
tcagtactctcgtgcacgaccggtgctcgatttagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgacggtggtagtggtggcgcatacgtcgcacagaagtttcagggccgcgtcaccatggccaaggtcgcgtccacgaatacagtgtatatggacttgagcagcctgaggtctgacgacacggccatgtattatgtgcgaggcaggacggggactaaggcaagtaaagtggttcgaccccgtggggccgagggtacccgtggtccaccgtctcctcgngcctccaccaacgggcccacgtccggttaccttcccccgngggtcccgccctcgccctccgacggacgcctacccgtccgacggtacgcctaaccgacggcccggtcccgtggggtcccg

SEQ ID NO: 226040 - DNA, 567 bp, Homo sapiens
  misc_feature: GYAE6OF02G6GIH.19.86.H09.1.454.CMB.1.raw
  modified_base (284)..(284): a, c, t, g, unknown or other
  misc_feature (284)..(284): n is a, c, g, or t
  modified_base (356)..(356): a, c, t, g, unknown or other
  misc_feature (356)..(356): n is a, c, g, or t
  modified_base (508)..(508): a, c, t, g, unknown or other
  misc_feature (508)..(508): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcgagtgaaggtctccgtgcgaggtcttttggatacaccttcagtcattatcatatactntgggtgcgacacggcccctggacaagggcttgagtggagtagggcggatccgaggtggtaggtgggtggcgntagtacgtcgcacgagtaacgtttcgacgggtccgcgtaccaccagtcgggaccctaagggtccgcgtaccgaacgtaactacgagttgtaattagtgtacttgagtcgagcctggacgtcgtagaccgacgaccgacctagttgtagtttntggtcggcgaggcgagggacgggacgtaaggctaagtaacggttggtaccgtacccggg

SEQ ID NO: 226041 - DNA, 490 bp, Homo sapiens
  misc_feature: GYAE6OF02F813B.19.86.H09.1.454.CMB.1.raw
  modified_base (228)..(228): a, c, t, g, unknown or other
  misc_feature (228)..(228): n is a, c, g, or t
  modified_base (413)..(413): a, c, t, g, unknown or other
  misc_feature (413)..(413): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (477)..(482): a, c, t, g, unknown or other
  misc_feature (477)..(482): n is a, c, g, or t
  modified_base (485)..(490): a, c, t, g, unknown or other
  misc_feature (485)..(490): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacnctgagcggtccttaagggtccctgaccgattctctggcgagaggtctggcgcctcagccttcctggccatcagagggctccgagtctgaagatgaggctgatttattactgtgcaatctgggatgacagtgtagacggtcggttttggcggagggacagctgaccgtcctagtcacgccaaggcncgcccgtcggcactctcgtcccacctccnccacgcgagtacngagcggcgtgcaggcacatagnnnnnntgnnnnnn

SEQ ID NO: 226042 - DNA, 536 bp, Homo sapiens
  misc_feature: GYAE6OF02HF3PS.19.86.H09.1.454.CMB.1.raw
  modified_base (493)..(493): a, c, t, g, unknown or other
  misc_feature (493)..(493): n is a, c, g, or t
  modified_base (523)..(524): a, c, t, g, unknown or other
  misc_feature (523)..(524): n is a, c, g, or t
  modified_base (526)..(536): a, c, t, g, unknown or other
  misc_feature (526)..(536): n is a, c, g, or t
tcagtactctcgtgcacgaccggtgctcgatttagtgctatagacttgggtttgggggccgttcctgggcccagtctgtgctgactcaggcaccctcagcgtctgggaccccccgggcagacggtcaccatcgcttgttctgcaagcagctcgaacatcgggagcagtggtgtgatgtggtatcagaaagtcccaggaaccgcccccaaatcgtcatctataatgacgctgagcggtccttaagggtccctgaccgattctctggcgagaggtctggcgcctcagccttccctggcccatcagagggctccagtctgaagatggagctgatttattactgtgcaatcgtgggatgactagtgtaggaacggttccgggtttcgggcgggagggacctaaggcctgaccgttactaacggtacacgcccgaagccgtccgcccccgtcgtccaccttctccgttccccgccctcctcccgacgtacgagtaccnggacgcgggcgcggacgaggccgcagtagnngnnnnnnnnnnn

SEQ ID NO: 226043 - DNA, 513 bp, Homo sapiens
  misc_feature: GYAE6OF02HHKYV.19.86.H09.1.454.CMB.1.raw
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (507)..(508): a, c, t, g, unknown or other
  misc_feature (507)..(508): n is a, c, g, or t
  modified_base (512)..(512): a, c, t, g, unknown or other
  misc_feature (512)..(512): n is a, c, g, or t
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtccaggaacggccccaaaatcgtcatctataatgacgctgagcggtccttaaagggtccctgaccgattctctggcgagaggtctggcgcctcagcttcctggcatcagaggctccagtctgaagatgaggctgattaattactgtgcaatcgtgggatgacagtgtagaacggttcggtttcggcggtagggacaagcgtagaccgtctaagtcagccaaggctcgccccgtgtcactcgtcgtcccgccctctccacgacgagtactgacgcgggctaggcgaaggcgacgacgtagactacngacngacgtcgacnnacgnc

SEQ ID NO: 226044 - DNA, 521 bp, Homo sapiens
  misc_feature: GYAE6OF02FZZ7Y.19.86.H09.1.454.CMB.1.raw
  modified_base (483)..(483): a, c, t, g, unknown or other
  misc_feature (483)..(483): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (511)..(515): a, c, t, g, unknown or other
  misc_feature (511)..(515): n is a, c, g, or t
  modified_base (517)..(520): a, c, t, g, unknown or other
  misc_feature (517)..(520): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatagacagtgtgtaacggttccggttttcggcgggtagggaccaagctgaccgtctaagtcgacgcccgaaggcctcgccccgtcgtccacttccgtcgttccccacccttcctcccacgacgtacgtacgtcgngccggcgtggacagggcncagtgncngnnnnncnnnnc

SEQ ID NO: 226045 - DNA, 706 bp, Homo sapiens
  misc_feature: GYAE6OF02IAIC1.19.86.H09.1.454.CMB.1.raw
  modified_base (191)..(191): a, c, t, g, unknown or other
  misc_feature (191)..(191): n is a, c, g, or t
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatccctcctcttggtggcagcacgcccaccggacgccccacctcccgaggtcgcngctggtgcagtcgtgggctggaggtgaaggngccgtgggcctgagtgacggtctccgtggcgaggtcgtttggatactaccttnagtcattactctatactactggtcgggtgcgaacgcggtccccgtaggacgaggtctaggtacgtggagtacgggcggtacgtccggtacggggtggttagggtgggtcggcgactacgtacgtcgtacgaacgtaggtaacgttcggacgggcccgtcgtccgacgaggtccggaccgtaggtccgtccgtaaccgtacgaaactacgtaggttacgtatacgtggtacgttgacggttcaacggtccgttaggtacgttacgacggaaccgaaccggaccggtaccctaggttaacgttacgtttacggtttacggccgggttaacgggacgggtaaccggtaacggggggtacccggttaacgggttaaacggacggttaaaacggtttaacgggttaccccgggtacccggttaaacccccgggggg

SEQ ID NO: 226046 - DNA, 633 bp, Homo sapiens
  misc_feature: GYAE6OF02JD104.19.86.H09.1.454.CMB.1.raw
  modified_base (620)..(621): a, c, t, g, unknown or other
  misc_feature (620)..(621): n is a, c, g, or t
  modified_base (623)..(625): a, c, t, g, unknown or other
  misc_feature (623)..(625): n is a, c, g, or t
  modified_base (627)..(633): a, c, t, g, unknown or other
  misc_feature (627)..(633): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcagaaagtcccaggaaccggcccccaaatcgtcatctataatgacgctgagcggttaccttaagggtccctgaccgattctcgtggcgagaggtcgtggccgcctcacgtccttccccgtaggccctaatccgaaggcggggtcctccgagttcgtaggaacgagtggaggctaggtaatttactacgtgtacactaagttcggtgggaacttagacgtggttacgtacggggttaaacccggggtttccgggtttacggggacgggaccgggtaactaacgtcgtacgtacccgttactaacggttcacggtaccgacggtcccgtaccgtccccgttagtccctacgttcccgtccgttacccccgtccctaccctaccgacgtacggtacgtacgtcggacggccgggtcgcggagtaccggcgacgagtcggnngnnncnnnnnnn

SEQ ID NO: 226047 - DNA, 857 bp, Homo sapiens
  misc_feature: GYAE6OF02J3H7R.19.86.H09.1.454.CMB.1.raw
tcagtactctcgtgcacgaccggtgctcgatttagtgctatagacttggggtttggggagagctctggggagtctgcaccatggcttggaccccactcctcttcctcaccctcctcctccactgcacagggtctctctccagcttgtgctgacctcaatccgccctcgtcgcctctcgccctccgtggggacgcctcggtacaacgtctcatctgcactcgtagacgcgaggtcggaccacacgtaccaactaccggctacgtccgactagtcggacacgtccgaacgccgacgacacggaccaaagggaccggaaccgggtcccttaacgggttacttaacggtaacgttaaggaaaccgggtttaacgaggtacgtacggacggaaccctaaccggaaccccgaaccggaaaccgggggtaacgggggaaccgtccgttacccggttaggttaccggtttaccggtttaccggacgggtaccgtacgtaccggttacggggttcgggaccgttacgggtaccgtcccgtaacccggttacccctacgtaaccccgttaacgttccccggtaaccgtacccgggttaccccgttacggtaccgggttaacccggaaggggttacgtacggtaacggggtcctaagttaccgttaacgttacgtttacgtacccggttacggtaaccgggttaccgggttaccggtaaccgttaacgggttaggttccgggtttacggggtttaccgggttaccgggaacggggttacccgtaacggtaacggtccggtaacccgttaccgaaccgggttacggaccggaccccgtaacggtcccgggtaccctcccgttccccggg

SEQ ID NO: 226048 - DNA, 490 bp, Homo sapiens
  misc_feature: GYAE6OF02FO13Z.19.86.H09.1.454.CMB.1.raw
  modified_base (316)..(316): a, c, t, g, unknown or other
  misc_feature (316)..(316): n is a, c, g, or t
  modified_base (350)..(350): a, c, t, g, unknown or other
  misc_feature (350)..(350): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (460)..(490): a, c, t, g, unknown or other
  misc_feature (460)..(490): n is a, c, g, or t
tcagtactctcgtgcacgaccggtgctcgatttagtgctatagacttgggcttgagtggatagggcggatccacgggtggtagtggtggcgcatacgtcgcacagaagtttcagggccgcgtcaccatggccaaggtcgcgtccacgaattaccagtgtatattggacttgagcagcctgaggtctgacgacacggccagtgtattattgtgcgaggcaggacgggctaaaggcataaagtggttcgacccctggggccaggaaccctggtcaccgtctcctcagcctccaccacgggcccatcggtcttcccccnggcgccctgcctccgaggcgccaccttccgagancacgagccggtcccgtagggctcgccgtggtacgaacggaccttaccgttacccacgacgacgtactgacgcgggctgggaccaaggccgtacataggcntncnancnannnnnnnnnnnnnnnnnnnnnnnnnnnnnnn

SEQ ID NO: 226049 - DNA, 768 bp, Homo sapiens
  misc_feature: GYAE6OF02HG659.19.86.H09.1.454.CMB.1.raw
  modified_base (215)..(215): a, c, t, g, unknown or other
  misc_feature (215)..(215): n is a, c, g, or t
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtcgtgggctggaggtgaaggngccgtggggcctcgagtgaggtctccgtgcgaggtctttggatactccgttcagtcattatctatatactcggtgggtcgacgacgccggtccccgtaggaaccgaagggtcttaggagtaggagtacggggcggtactccggtaggggtggttagggtcgggtgggccgtacgtaacgttaccggtacgaccgaacgtaaggttaacggttaccggacggggcccgtacgtacccgaccgtaggtaccgggaccgtaaacgggtccgacccgtaccgaacggtaaactacggtacggttaagttacgttaaggtcggttaacttggacgtaccgtaacggtccgtagggtaccggttccgtaacggtaacccggaaccgaacccgggtacctaaggtttacggtttaagtttacggtttacgggtacgggtacccgggtaaggggtaaccggggaaaccgggggtcccgggggttaaaacgttaaacggggaacgttaaaacgggtttaaacggggtttcccggggttacccccgggtaaacccccgggggg

SEQ ID NO: 226050 - DNA, 649 bp, Homo sapiens
  misc_feature: GYAE6OF02FGFL8.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctcctgcgaggtcttttggatacaccttcagtctattatcatatactcgtgggtgcgacacggtcccctggacgaagggcttgagtggagtgggcggactccgaggtggtaggtgggtggcgcagtacgtcgacacgagtagttcgagggccgcgtcaccagtcggaccgtaacgggtccgaccggtacccgaacgaaactacgtagttagttaattaagttcggtactttaggacgtacgtacggtaccgtggtaacggttccgtaggaacccgtacgacccgggctaagttcgtttaagttacgtttggtcggacggtagggaccggtaacgggggtaaccggggtaacgttaaaacggggaccgttaaaggttaaacggggttccgggtttaacccgggtaacccccgggg

SEQ ID NO: 226051 - DNA, 645 bp, Homo sapiens
  misc_feature: GYAE6OF02F65X3.19.86.H09.1.454.CMB.1.raw
  modified_base (321)..(321): a, c, t, g, unknown or other
  misc_feature (321)..(321): n is a, c, g, or t
  modified_base (343)..(343): a, c, t, g, unknown or other
  misc_feature (343)..(343): n is a, c, g, or t
  modified_base (623)..(623): a, c, t, g, unknown or other
  misc_feature (623)..(623): n is a, c, g, or t
  modified_base (636)..(636): a, c, t, g, unknown or other
  misc_feature (636)..(636): n is a, c, g, or t
  modified_base (638)..(639): a, c, t, g, unknown or other
  misc_feature (638)..(639): n is a, c, g, or t
  modified_base (641)..(642): a, c, t, g, unknown or other
  misc_feature (641)..(642): n is a, c, g, or t
  modified_base (644)..(645): a, c, t, g, unknown or other
  misc_feature (644)..(645): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaccggcccccaaactcgtcatctataatgacgctgagcggtccttaagggtccctgaccgattctctggcgagaggtctggcgcctcagcttccctggccatcgagagggctccagtctagaagntgagctgtatttattactgtcncaatcgtgggtatgactaggtgtagtaaccgggtttccggggttttccgggacggggtacgggtaacccggaagtccgtacggtacccggttacccgttaaggtcccgtacggaccccggaaacggtcccgtcccggtccccccgttaccggtccctaacctttccgttcccggttacccccgtcccctacccgttcccgtaaccgggttacgaacggttaaccgtcggacgggtccgggtaccggtacgggtaccgaacgggaccggctaacgtacggntacgagcagtcgngnngnngnn

SEQ ID NO: 226052 - DNA, 601 bp, Homo sapiens
  misc_feature: GYAE6OF02HJ49O.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcgagtgaaggtctccgtgcgaggtcttttggatacaccttcagtcattatcatatactcgtggtgcgacacggccctaggacgaagggctgagtggagtagggcggatccgacggtggtagtgggtggcgcagtcggtcgcacgagaagtttcgacgggccgcgtccaccgagtcggaccgtaaggtcgccgtaccaacgaactaccgaagtcgttatagtaggtacttggacgtcgacgtccgtaggtacggtcgtacgaacggacgaaccggccgtagttcgttaatttacgttggtacggtacggtagggcgaacggggacgggtaacggtaaaggtaccgtaacggttaaggttccggttaaccccggg

SEQ ID NO: 226053 - DNA, 616 bp, Homo sapiens
  misc_feature: GYAE6OF02F6ON1.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctggaggtgaaggagccgtggggcctcagtgaaggtctctgcgaggtctttggatacaccttcagtcattatcatatactcgtgggtgcgacgacggcccctaggacaagggtcttgagtggagtagggtcggactccgaggttggtaggtgggtggcgacgagttacggacgcacgtaggtaacgtttcggacgggccgtcgtccaacgatcggaccgtaaggtccgacgtaccgaaccgaagtaccgaggttagtattaggtacggtactttacggagtacgacgtccgtggtacgggtctaggaccggaacaccgggtcctaagtgttacttacttgggtcgacgggtacgggcgacgggtacggggtactaacgggctaaaggttaacggttcggttacccgtaacccgggg

SEQ ID NO: 226054 - DNA, 710 bp, Homo sapiens
  misc_feature: GYAE6OF02IPG7Z.19.86.H09.1.454.CMB.1.raw
  modified_base (116)..(116): a, c, t, g, unknown or other
  misc_feature (116)..(116): n is a, c, g, or t
  modified_base (260)..(260): a, c, t, g, unknown or other
  misc_feature (260)..(260): n is a, c, g, or t
  modified_base (687)..(687): a, c, t, g, unknown or other
  misc_feature (687)..(687): n is a, c, g, or t
  modified_base (693)..(693): a, c, t, g, unknown or other
  misc_feature (693)..(693): n is a, c, g, or t
tcagtactctcgtgcacgaccggtgctcgatttagtgctatagacttgggtttggggccgttcctgggcccagtctgtgctgactcaggcaccctcagcgtctgggacccccgggnagacggtcaccatcgcttgttctgcaagcagctcgaacatcgggagcagtggtgtgatggtgtatcagaaacgtcccaggaaccgccccaaatcgtcatctataatgacgctgagcggtccttaagggtccctggacctattcncgtggcgagaggtctggcgcctcgagcttccctggcctatcgagagggctcagtctagaagatgaggcgtgtattattactgtgcaattctggggtatagactaggttcgtacggtaacgggttacccgggttttcggacggggtaacgggtaccgtaaggtccgtacggtaaccccggttacccttaaaggttacccgaaccgtaccccggtaaacgggtcccgttacccgggtccccccgttaccggggttccctaaaccccgtttccggtttaccccggtttcccccccgtccccgtttaccccgttaccccggaaccgggttaccggtaaccggtttaacccgtacgggtaccgggtacccgggtccggttaaccggggccggtaaacggggcccgggtactaacgggttacgacacgttcgngtacgngtcagccggatcgctcg

SEQ ID NO: 226055 - DNA, 597 bp, Homo sapiens
  misc_feature: GYAE6OF02F0R9J.19.86.H09.1.454.CMB.1.raw
  modified_base (278)..(278): a, c, t, g, unknown or other
  misc_feature (278)..(278): n is a, c, g, or t
  modified_base (316)..(316): a, c, t, g, unknown or other
  misc_feature (316)..(316): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (592)..(597): a, c, t, g, unknown or other
  misc_feature (592)..(597): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaaggtccctgaccgattctctggcgagaggtctggcncctcagcttccctggccatcgaggagggctccgagtcnggaagatggagtctgtatttattactggtgactaagtcgtgggatgacgtagtggtagacgggtttccgggtttcggccgggtaagggacctaaggccgtacggtacccgtaccgttaacgtccgaaccggacccgaacgggccgtccgccccccgttcgtccctaccgttccgttccgttccccctaccctccctaccgacggacgtacggttacgtcggaccgggtcggtccgacggacgaacggtcgacgtagtaacgngtnacgtngnacgnnnnnn

SEQ ID NO: 226056 - DNA, 489 bp, Homo sapiens
  misc_feature: GYAE6OF02I9JFN.19.86.H09.1.454.CMB.1.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (386)..(386): a, c, t, g, unknown or other
  misc_feature (386)..(386): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
  modified_base (478)..(489): a, c, t, g, unknown or other
  misc_feature (478)..(489): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcggggagcagtggtgtgatgtggtatcagaaagtcccaggaccggcccccaaatcgtcatctataatgacgctgaggcggtccttaagggtccctgaccgattctctggcgagaggtctggcnccgtnacgcttccctggccatccagcgggcttccgagtctgaagatgaggctgtattattactggtnacaattcgnggatgacagtgtagacggttcggtttcggnggaggcagctgacgtcaagtcagccaggctcgcccgcgtacactcgtctcccacccttcncacgnagtcngagcggcnggcagcncagtcgnnnnnnnnnnnn

SEQ ID NO: 226057 - DNA, 557 bp, Homo sapiens
  misc_feature: GYAE6OF02GOSPR.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagaagtttcgagggccgcgtcaccagtcggaccaagggtccgcgtccacgaatacagtgtatatggacttgagcagtcctggaggtctggaccgacgaccggacagttgtatttacgttggtcgacggtagggaccgaggggaaccggggtactaaagggccgtaagtaaaggttcgggttacccgtaacccccggg

SEQ ID NO: 226058 - DNA, 598 bp, Homo sapiens
  misc_feature: GYAE6OF02GZYVO.19.86.H09.1.454.CMB.1.raw
  modified_base (258)..(258): a, c, t, g, unknown or other
  misc_feature (258)..(258): n is a, c, g, or t
  modified_base (305)..(305): a, c, t, g, unknown or other
  misc_feature (305)..(305): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (595)..(598): a, c, t, g, unknown or other
  misc_feature (595)..(598): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgnttctctggcgagaggtctggcgcctcgagccttcctggcccatcagngggctccagtctgaagatgaggctgattattactgtgcaatcgtgggatcgacgtagtgtaggtaaccgggtttccgggtttttaccggggcgggtaacgggacccgtaagcgtacggacccgttacgtaacgtccacggcccaagggcctccggtcccccgttacgggtccacgttccgttccgttccccctacccgttccctcccgacgacggtacgtaaccgttcggacgtccggggtacgtcgggccaacgggccgacgtacgtaggacngtcgngactgatcgannnn

SEQ ID NO: 226059 - DNA, 675 bp, Homo sapiens
  misc_feature: GYAE6OF02GY8HG.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggacgcccactcccaggtgcagctggtgcagtccgtggggctggaggtgaaggagccgtggggcctcgagtggaaggtcctcgtgcggaggtcgttttggactacctaccttcagtctattatacatatactcgtggtcgcgacgcggccccgtggacgaaggtctggagtggagtagggcgtacgtccgtacgggtggtaggtgggtcggcgacgtacgtacggtcgacgaacgtaagtaacggtttaccggacggggtcccgtccgtaccgaaccgtacggtacgggaccgtaacgggtccggccgtacccgaacggtaacgtacgaaggttagtagttacgtacgggtacttaggacggcgacggtaccgtggacgttcgtacggaaccgaccggaccggtaccgtagttacgttattagttcggtcggacggagggacggacgggtacggggtaccgtaaagggtaccgtaaaggtttaaaccggtcgggtaccccgtaaccccgggg

SEQ ID NO: 226060 - DNA, 608 bp, Homo sapiens
  misc_feature: GYAE6OF02G7RH1.19.86.H09.1.454.CMB.1.raw
  modified_base (275)..(275): a, c, t, g, unknown or other
  misc_feature (275)..(275): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctgggctgaggtgaaggagccgtgggcctcgagtgaaggtctcctgcgaggtcttttggatacaccttcagtcattancatatactctgggtgcgacgacggccctggacgaagggtcttggagtggataggggcgatccgacggtggtagtggtggcgcgagtcgtcgcacgaggtaagtttcgagggccgtcgtcacgaagtcggaccgaaggtccgcgtaccgaacgtaactacgagttagtatagttggacttgagcgagtccgtaggtacggtcacggtacgaaccgtccgggacctaagttgttaacgtttaagtttcggacggtacggaagggacggtaagggggtaacggggtaacctaaaaggggtcctaaagggtttaaacggtcgggtttaacccccggg

SEQ ID NO: 226061 - DNA, 735 bp, Homo sapiens
  misc_feature: GYAE6OF02GPDSG.19.86.H09.1.454.CMB.1.raw
  modified_base (715)..(715): a, c, t, g, unknown or other
  misc_feature (715)..(715): n is a, c, g, or t
  modified_base (727)..(727): a, c, t, g, unknown or other
  misc_feature (727)..(727): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaccggccccaaatcgtcatctataatgacgctgagccggtccttaagggtccctgaccgtattcctcgtggcgagaggtctggcgcctcagccttccctggccagtcaggagggcctccgagtcctaggaagagtggagtctagtatttattactggtgacaattcgtagggtatagacaggttggtacggtaaccgggtttccgggtttttagggaccgggtaacggggtaccgtaaggtcccgttacgggtacccggttaccgtaacggttaccgaaccgggtacccgtaaacgggtcccgttccccggttaccccccggttaccgggttacccctaaccgtttccccggttacccggtttcccccccggtacccgtttacccccgttacccgaacccgggttaacgtaaccgggttaaccgtttacgggaacccggggttcccggggtaccgggttaccgggaaccggtaacggggtacccggtacgtaacgggtaacggcgtacgtacgcgtacncggtactccgancgcagtcg

SEQ ID NO: 226062 - DNA, 579 bp, Homo sapiens
  misc_feature: GYAE6OF02HOLHN.19.86.H09.1.454.CMB.1.raw
  modified_base (317)..(317): a, c, t, g, unknown or other
  misc_feature (317)..(317): n is a, c, g, or t
  modified_base (374)..(374): a, c, t, g, unknown or other
  misc_feature (374)..(374): n is a, c, g, or t
  modified_base (503)..(503): a, c, t, g, unknown or other
  misc_feature (503)..(503): n is a, c, g, or t
tcagtactctcgtgcacgaccggtgctcgattagtgctatagacttgggtttgggggggaagaggaagactgacggtcccactcccaggtgcagctggtgcagtctggggctgaggtgaaggagcctggggcctcagcgaaggtctcctgcgaggcttttggatacacattcagtcattatcatatactctgggtgcgacaggcccctggacaagggcttgagtggatagggcggatccacggtggtagtgggtgcgcatacgtcgcacagaagtttcagggccgcgtcaccatggcccaaggtcgcgtccacgaancagtgtatatggacttgagcagcctgaggtctgacgacacggcatcgtattattgtncgaggcagggacgggactaaaggcagtaaagtggttccgacccgtgggaccgagggaccctggtccaccgtctcctcacgccctccgaaccgacgggaccctaagtccggttccttccccgtgggcccncccgttcgcccgtaccgacgggtacgtcccgacccgtccggtacggacgaccgacgacggtccggccccgtcgggg

SEQ ID NO: 226063 - DNA, 605 bp, Homo sapiens
  misc_feature: GYAE6OF02I3N0C.19.86.H09.1.454.CMB.1.raw
tcagtactctcgtgcacgaccggtgctcgatttagtgctatagacttgggtttggggggaagaggaagactgacggtcctgccacaggtggtgctgggcacggtgggcactcgacacaacatttgcgctcaactgtcttgtccaccttggtgtagctggtgcagtctggggctgaggtgaaggagcctggggcctcagtgaaggtctcctgcgaggctttttggatacaccttcagtcattatcatatactctgggtgcgacaggcccctggaacaagggcttgagtggatagggcggatccacggtggtagtggtgggcgcatacgtcgcacagaagtttcgacgggaccgtccgtcaccgatcggccaagggtccgcgttacccacggaaatacgacgtagtatagtacggacgtttgagctagctggaggtctaggacgacgacggacccatcgttattattcgtggacgagggccgaaggggacggggtacgtaaagggactaagtaaaggttcgggttaccgacccgtcggggcccgaacgggtaccccgtggtacgacccgtctcccgtcgaccgtcccgtacccgaccgtaacccggg

SEQ ID NO: 226064 - DNA, 637 bp, Homo sapiens
  misc_feature: GYAE6OF02IU218.19.86.H09.1.454.CMB.1.raw
  modified_base (358)..(358): a, c, t, g, unknown or other
  misc_feature (358)..(358): n is a, c, g, or t
  modified_base (627)..(627): a, c, t, g, unknown or other
  misc_feature (627)..(627): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggtcttttggatacaccttcagtcattatcatatactctgggtgcgacacggcccctggacaagggcttgagtggagtagggcgatccgacggtggtagtgggtggcgcatacgtcgcacagaagttttcgagggccgcgtcaccagtcggccaaggtcgccgtccgaacgaatacagtgtatagtggacttgagcagctgagtcngacgacacgcatgttattagttgtcgcggagcgagggacgggactaaaggctaaagtaaggtacggttaccgaccccgtggggaccgacgggtaaccctcgggttaccgaccgttcgtccctccgcgtccctaccgacccgaacgggcccctacgtcccggttcccgttcccccgtcggtcccgtacccgtcgacccgttcccggaacggcccgtaccgtacccctacccgggacgacgacccgacccggacggcccgggtaccccggngggtacccgg

SEQ ID NO: 226065 - DNA, 651 bp, Homo sapiens
  misc_feature: GYAE6OF02GCOHJ.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctggaggtgaagggagcctggggcctcgagtgaaggtctcctgcgaggtcgttttggatacaccttcagtcaattatcatatactctgggtgcgacacggcccctggacgaagggtcttggagtggagtagggcgtagtccgacggttggtaggtgggtcggcggcgtagtacggtcgcaacgtaggtaacgttttcggaacgggcccgtccggtccaaccgagtacgggacccaaacgggtccgccgttacccgaacggtaacgtacgaagttagtagtaagtcggaacttggaggtcacgtccgtagtacgggttcgtaggtaaccgaaccgtaccggaccgtagttacgttatttaagttcggtaggccggtagggccgtacgggacgggggtaacgtaacgggacgtaaacggttaacggttaccgggttacccggtaaccccgggg

SEQ ID NO: 226066 - DNA, 489 bp, Homo sapiens
  misc_feature: GYAE6OF02FX2JS.19.86.H09.1.454.CMB.1.raw
  modified_base (466)..(489): a, c, t, g, unknown or other
  misc_feature (466)..(489): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaaggcataaagtggttcgacccctggggccagggaccctggtcaccgtctcctcagcctccaccgaaggcccatccggtccttcccccgtggccgcccctgcctccgagggacgccaccctccgagacgcaccaggtccggcccgtgggcctggacccttgggaccgtaacggtacccttacttccccgaacgacgtacggtactggacggcgggcgtggacgaagggccgcagtagcgnnnnnnnnnnnnnnnnnnnnnnnn

SEQ ID NO: 226067 - DNA, 695 bp, Homo sapiens
  misc_feature: GYAE6OF02H98SH.19.86.H09.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (351)..(351): a, c, t, g, unknown or other
  misc_feature (351)..(351): n is a, c, g, or t
tcagtactctcgtgcacgaccggtgctcgatttagtgctatagacttggggtttggggagcatcacccagcaaccacatctgtcctctagagaatcccctgagagctccgttcctcaccatggactggacctggaggatcctcctcttgggtggccagcagtccacggagcccactccaggtgcagctggtgcagtcgtggggctggaggtgaaggngcgtggggcctnagtgaaggtctcngacgngtctttggatacnccttnagtcattactcatataccgtntagggtgcgaacgacggtcccctaggaccgaaggtccgttaggaagggttggaaggttacggggnggtaactacccgggtaaggtgggtaagttggggttcggcgacctaaggtacgttcgccgaagtaaggttaacggtttcggaacggggcccgtccggttacgaaccgtagtacgggacctaaacgggccgtcgttccgaaaccgaagttaaccgaggtagtaatacggtacgtacgtttggaacgttcgacgacccgttagaacggtctaggaccgaacgttacggacccgtagtaccggttattacggttacggtcgaccgggtagggaccgttacgggggaaccgggaacggttaaacggaccggttaaagtaaaccgggttcgggttacccgtaacccgggg

SEQ ID NO: 226068 - DNA, 552 bp, Homo sapiens
  misc_feature: GYAE6OF02HSAU6.19.86.H09.1.454.CMB.1.raw
tcagtactctcgtgcacgaccggtgctcgattagtgctatagacttgggtttgggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtgtagtggtggcgcagtacgtcgcacagaagtttcaggccgcgtcaccatggccaaggtcgcgtccaccgaatacagtgtatatggactgagcagtcctgaggtctgacgacacgcatcgtattattgtgcgaggcaggacgggctaaaggcaagtaaagtgtacgacccgtgggccgaggaacctggtctaccgtctcctcacgccctaccaccgacgggcccacgtccggtccttccccgtggccgtcccgtgcctccgacggacgccgtacctccgaagcgccacgacgaccggtcccgacgggtccg

SEQ ID NO: 226069 - DNA, 701 bp, Homo sapiens
  misc_feature: GYAE6OF02GXDCK.19.86.H09.1.454.CMB.1.raw
  modified_base (163)..(163): a, c, t, g, unknown or other
  misc_feature (163)..(163): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (685)..(685): a, c, t, g, unknown or other
  misc_feature (685)..(685): n is a, c, g, or t
  modified_base (689)..(689): a, c, t, g, unknown or other
  misc_feature (689)..(689): n is a, c, g, or t
  modified_base (694)..(695): a, c, t, g, unknown or other
  misc_feature (694)..(695): n is a, c, g, or t
  modified_base (697)..(697): a, c, t, g, unknown or other
  misc_feature (697)..(697): n is a, c, g, or t
  modified_base (699)..(701): a, c, t, g, unknown or other
  misc_feature (699)..(701): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtccaggaaccgccccaaatcgtcatctataatgacgctgagcggtccttaagggtccctgaccgtattctctggcgagaggtcnggcnctnagcttcctggccatcagnggcctccagtctagaagntgaggctgtattattactgtacgactaattcgtaggggattgaacgtggttacgtacgggttaaacccggggttttccggggttttacggggaccgggtaacggggtaaccgtaacgggtccgttaaccgggtaaccccggttacccgttaaacggttacccgtaaccggtaccccgtaaaacggggtccccgttaccccggtcccccccggtttacgggtaccccgttaacccgtttcccgtttaccccggttcccccgtccccttaccccgtacccggaaccggtacgtaaccgtttacgtacggtaccgggtccgggtcgttacgggaccgtaaccggggtcccgacgttaacgtacggctacggnacgngacgnngncnnn

SEQ ID NO: 226070 - DNA, 610 bp, Homo sapiens
  misc_feature: GYAE6OF02GJLWX.19.86.H09.1.454.CMB.1.raw
  modified_base (371)..(371): a, c, t, g, unknown or other
  misc_feature (371)..(371): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtgggcctcagtgaaggtctctgcgaggtcttttggatactaccttcagtctattatcatatactcgtggtgcgacacggccccgtaggacgaagggcttgaggtggagtaggggcgagtccgaggtggtaggtggtggcgcagtacgtcgnacaggtagttcgagggccgcgtcaccgtagcggtccgaaggtcgccgtcgaacgatacgtgtagttatagtggtacttagacgcgacggtcccgtaggacggttccgtacgaacgtaccgaacggtcctaagttagttaacgtttaggttacggtaggtaccggaacggtcgaaggggggtaaccgggtaacggtaaacgggacgtaaacggtttaacgggtcgggtttaacccccggg

SEQ ID NO: 226071 - DNA, 529 bp, Homo sapiens
  misc_feature: GYAE6OF02GOWI5.19.86.H09.1.454.CMB.1.raw
  modified_base (344)..(344): a, c, t, g, unknown or other
  misc_feature (344)..(344): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
  modified_base (514)..(515): a, c, t, g, unknown or other
  misc_feature (514)..(515): n is a, c, g, or t
  modified_base (518)..(522): a, c, t, g, unknown or other
  misc_feature (518)..(522): n is a, c, g, or t
  modified_base (525)..(525): a, c, t, g, unknown or other
  misc_feature (525)..(525): n is a, c, g, or t
  modified_base (528)..(529): a, c, t, g, unknown or other
  misc_feature (528)..(529): n is a, c, g, or t
tcagtactctcgtgcacgaccggtgctcgatttagtgctatagacttgggtttgggggccgttcctgggcccagtctgtgctgactcaggcaccctcagcgtctgggaccccccgggcagacggtcaccatcgcttgttctgcaagcagctcgaacatcgggagcagtggtgtgatgtggtatcagaaagtcccaggaacgcccccaaatcgtcatctataatgacgctgagcggtccttaagggtccctgaccgattctctggcgagaggtctggcgcctcagtcttccctggcccatcaggaggcctccagtctagaagagtgaggctgtattattactgtnctaatcgtgggatgacaggtgtaggaacggttccgggtttcggcgggacgggaccagcctgaccgtactaagtcagtaccgaaggcctccgccccgttcggtcctactccttcgtccccaccctcctccacgagtacgtacngacggcggtcgnggacacggcgcagtanncgnnnnngcngcnn

SEQ ID NO: 226072 - DNA, 752 bp, Homo sapiens
  misc_feature: GYAE6OF02JYLSR.19.86.H09.1.454.CMB.1.raw
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
  modified_base (268)..(268): a, c, t, g, unknown or other
  misc_feature (268)..(268): n is a, c, g, or t
  modified_base (730)..(730): a, c, t, g, unknown or other
  misc_feature (730)..(730): n is a, c, g, or t
  modified_base (748)..(748): a, c, t, g, unknown or other
  misc_feature (748)..(748): n is a, c, g, or t
tcagtactctcgtgcacgaccggtgctcgatttagtgctatagacttgggttttgggggccggttccgtgggcccgagtctgtgctgactcaggcaccctcagccgtctgggaccccgggccgagacggtcaccatcgctgttctgcaaggcagctcggaacatcggggtagngaggtgttagtaggtntggtgggttatccgtaaggtaaagtccccgagggaaaccgccccccgaaaacgtcggtaccggacgttctagttaaacnggaccggtacgtcgaaggcggtacccgttaaacgggtcccttcggaacccggtattcctcgttggcggacgtaggtcgtacggccgtccgtccgtagtccttacccgttcggccctacgtccgtacgagggtcctccgaggtacgtcggaagacgttgacggtcgtcggtaattaaccgttacgtacgtacgtaccgtaaacgttccgtaagggtattacggtaaccgtaggtagtacgggttacggttacggggttttaccggcgggtaacgggaccgtaacgggtccgtacggtaccgttaccgacggttacgacgacccgaaggtccgtaccgcccggttcggtaaccctcgcccgtttcgtccccgtacccgtccgtacccgtacgtaccgtaagttaccgacggttacgggacggttccgaacgggtactacgggctacggtcaggactgcgacgtntacgcgtatccgtagtcncgtg

SEQ ID NO: 226073 - DNA, 616 bp, Homo sapiens
  misc_feature: GYAE6OF02IAFTP.19.86.H09.1.454.CMB.1.raw
  modified_base (261)..(261): a, c, t, g, unknown or other
  misc_feature (261)..(261): n is a, c, g, or t
  modified_base (610)..(616): a, c, t, g, unknown or other
  misc_feature (610)..(616): n is a, c, g, or t
tcagtactctcgtgcacgaccggtgctcgatttagtgctatagacttgggtttgggggccgttcctgggcccagtctgtgctgactcaggcaccctcagcgtctcggggacccccgggcagacggtcaccatcgcttgttctgcaagcagctcgaacatcgggagcagtggtgtgatgtggtatcaagaaacgtcccaggaaccgccccaaatcgtcatctaataatgacgctgagtcgtaccttaagggtcctgaccgtnttctcgtggcgagaggtctggcgcctcgagccttcccgtggccctatcgaggacgggtcctacgagttctaggaacgagtggacggtcttaggtaatttattacgtgtagactaatcgtagggatggactaggtgtacggtaaccgggtttccgggtttcgggacgggtaacgggacacgtcgtacgaccgttctacgcgtacgaccgaaggtccgtaccgtccccgttcgtcctacgttcccgttccgttcccctcccgttacccgtaccgtaaccggtacgtaccggtacgtacgggacgggccgggtaccgtggacccggtaaggccgagtaccgagctgcatgcnnnnnnn

SEQ ID NO: 226074 - DNA, 694 bp, Homo sapiens
  misc_feature: GYAE6OF02JQHX2.19.86.H09.1.454.CMB.1.raw
  modified_base (220)..(220): a, c, t, g, unknown or other
  misc_feature (220)..(220): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagcccaccggagcccacctcccaggtcgcagctggtgcagtcgtgggctggaggtgaaggngccgtgggcctcgaggtgacggtctccgtgcggaggtcttttggactacaccttcagtccattagtcatatactcgtgggtcgtacgacgcggccccgtggaacgaacgggtctaggaggtgggtaagtcggggaccggtactccggtaacgggtggtagggttagggtcggcgtacgtacgtaccggtcgactaacggtaaggtaacggtttcgggacgggccgtaccgtaccgaccgtaaggtcgggaccgtaacgggtccggaccgttccgaaacgtaataccggaaggttagtacgttagtacggtacgttaggacgacgtacgtccgtagtacggtacgttcggaaccgtaacgacccgggacttagtcgtttaagttacgttggtacgacgggtaagggaccggtaaggggtaccgggtaacggtaacgggtaactaacgggttaagggttcccggttaaccccgggg

SEQ ID NO: 226075 - DNA, 526 bp, Homo sapiens
  misc_feature: GYAE6OF02H3JG7.19.86.H09.1.454.CMB.1.raw
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
  modified_base (512)..(512): a, c, t, g, unknown or other
  misc_feature (512)..(512): n is a, c, g, or t
  modified_base (516)..(519): a, c, t, g, unknown or other
  misc_feature (516)..(519): n is a, c, g, or t
  modified_base (521)..(526): a, c, t, g, unknown or other
  misc_feature (521)..(526): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggttccttaagggtccctgaccgattctctggcgagaggtcnggcgcctcagccttcctggccatcagagggctccngtctgaagntgaggctgattatactgtgcaatctggntgacagtgtagacggttcggtttggcgggtaggacagctgaccgtctagtcagtccaggcctacgccccgtcggtaccactccttacgttcccccacccttcccgtacccaacggacgtacgttaccgtgaccgggcggcgtcggacgaacggcgccagtagcncgannnncnnnnnn

SEQ ID NO: 226076 - DNA, 800 bp, Homo sapiens
  misc_feature: GYAE6OF02IT9H4.19.86.H09.1.454.CMB.1.raw
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactccaggtgcagctggtgcagtcgtggggctggaggtgaaggtcgccgtggggcctcgtaggtcggaaggtctccgtagcggtagtcgttttaggactactaccgttcgaggtcctaattaacgtactacttaagttacttcgtacgggtgaccgacgtaccggtcccctagggaactaacggggtcttacggtaaggtacggacgttaaggggcgtaagtccgaacggggttaggtaggttcggggttacggccggtacgtagttaccgggtcggtaccgtaacgtaaaggttaacggtttcccggaacggggtcccggtccgggtacctaaccgtaggttaaccgggaccggtaaaacgggtccgtaccgttaaccgaacggaaccgttaacgtacggttacggttaacgtacgttacgggtaacgtttcggaacggtaccgtacggtaccgttaagggtaccgttacgttccgggaaacgttaacggacccgtaccgtaagttacgggtactttaacggtttacgggcggtaccggacgggtaccggtaacggggaccggggttaacgttaaacgggaaccgttaaggttaaacgggtttacccgggtacccgtaaccccggggg

SEQ ID NO: 226077 - DNA, 664 bp, Homo sapiens
  misc_feature: GYAE6OF02JJTD1.19.86.H09.1.454.CMB.1.raw
  modified_base (428)..(428): a, c, t, g, unknown or other
  misc_feature (428)..(428): n is a, c, g, or t
  modified_base (641)..(641): a, c, t, g, unknown or other
  misc_feature (641)..(641): n is a, c, g, or t
  modified_base (650)..(650): a, c, t, g, unknown or other
  misc_feature (650)..(650): n is a, c, g, or t
  modified_base (655)..(655): a, c, t, g, unknown or other
  misc_feature (655)..(655): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (662)..(663): a, c, t, g, unknown or other
  misc_feature (662)..(663): n is a, c, g, or t
tcagtactctcgtgcacgaccggtgctcgatttagtgctatagacttgggtttgggggccgttcctgggcccagtctgtgctgactcaggcaccctcagcgtctcgggaccccgggcagacggtcaccatcgcttgttctgcaagcagctcgaacatcgggagcagtggtgtgatgtggtatcaagaaacgtccgaggaaccgccccaaatcgtcatctaataatgacgcgtgacgcggttaccgttaacgggtccctaggaccgtatttccgtcgtgggaccgtaaggcgggttctgggccgtcccgttcgacggtcctttccccgaggcctaactcggaggtacgggcctaccgagtcgtaggaagtagtcggacgtctagtactttagttacgtggtcacaacgttcggtagggacttagaacgnggtttagtacgggtacgggttttcccgggtttgggacgggaacggtaaccgtaggtccgtacggtacccgttacgtaacgtacgtaccgaccgacggtccgtcccgaccccgttcggtacctacgtccgttccctaccccgtacctccctaccgaacgtacgtacgtaacggcggacggtcggcgtacgggaccgtaggccgagtacggtggntcgagcgancgtcnctncncnnc

SEQ ID NO: 226078 - DNA, 645 bp, Homo sapiens
  misc_feature: GYAE6OF02HBVYP.19.86.H09.1.454.CMB.1.raw
  modified_base (501)..(501): a, c, t, g, unknown or other
  misc_feature (501)..(501): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgagggtgaaggagccgtggggcctcgaggtggaacggtctccgtgcggaggtcttttggatacaccttcagtcattatcatatactctgggtgcgacgacggccccgtaggaacgaacgggtcgttaggaggtgggaagtaggggccggtagtacccgtagggtggttagggtgggtcgggcgcgtagtacggtcgacgacaggtaaggtttcgacggggccgcgtaccaccgagtcgggacctaagggtccgccgtaccaacgtaagaccgtaggttagtatagtagtacgttaggngacacgtccgtggtacgtcgtacgacgacgaccggtctacgttgttattagtttggcggtacggacgggacggaacggggaccgggtaacgttaaacgggacgttaaaggttaacggttccgggttacccggtaacccccgggg

SEQ ID NO: 226079 - DNA, 589 bp, Homo sapiens
  misc_feature: GYAE6OF02GR72C.19.86.H09.1.454.CMB.1.raw
  modified_base (333)..(333): a, c, t, g, unknown or other
  misc_feature (333)..(333): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
  modified_base (580)..(582): a, c, t, g, unknown or other
  misc_feature (580)..(582): n is a, c, g, or t
  modified_base (584)..(589): a, c, t, g, unknown or other
  misc_feature (584)..(589): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggccgcctcgacgtccttccctggccctagtcgaggacgggctccgagtctagaagntgaggtctagtattattactgtgctaactcgtgggatgacgtagtgtacggtaaccggtttccgggtttacgggacgggtaacgggaaccgaaggtccgtacggaacccgttaccgtaacggtaccgacgacccgaacgggtccctccgtcccccgttcggtacctaccttccgttaccgttccccgcccttcctaccgacgagtacgtacgtggacgcgggctcggacgacgcgcagtcgnngntnnngnnnnnn

SEQ ID NO: 226080 - DNA, 671 bp, Homo sapiens
  misc_feature: GYAE6OF02HLY6K.19.86.H09.1.454.CMB.1.raw
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatccctcctcttggtggcagcagccaccggacgcccactcccaggtgcagcgtggtgcagtcgnggggctggaggtggaaggcgccgtggggcctcgagtgaacggtctcgngcggaggtctttggactacctacttcagttcatttanctatatactcgtgggtcgacgacgccggccccgtaggacgtagggtcgttggagtggagtgggcggatcgtacggtggtaggtgggtggcgcgtacgtacgcgactaacgtaggttaacggttcgacggggtcccgtcgtacccaccgtacgtcggaccggtaacgggtccgaccggttacccgaaacggtaacgtacgtaaggttagtaacgttaaggttacgggaacttacgggacgacgtaacggttcccgtagggtacgtacgttacggaccgaaccgcggtaacctagttagttattaccggttggaggaccggacgggtagaacggggtacgggtacgtaaaggcgtaaaggttaacggtccggtaccgtacccccgggg

SEQ ID NO: 226081 - DNA, 424 bp, Homo sapiens
  misc_feature: GYAE6OF02G3ZOP.19.86.H09.1.454.CMB.1.raw
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (413)..(413): a, c, t, g, unknown or other
  misc_feature (413)..(413): n is a, c, g, or t
  modified_base (418)..(424): a, c, t, g, unknown or other
  misc_feature (418)..(424): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggactaaaggcataaagtggttcgaccccgtgggccagggaaccctggtcaccgtctcctcagcctccaccagggccccatcggtcttccccctggcgcccctgcctccaggcnccacctcgagagcacagcgcccnggctgcctggtcaaggctactcccacgagagtactgagcggctcggcgaaggcgnatagnnnnnnn

SEQ ID NO: 226082 - DNA, 512 bp, Homo sapiens
  misc_feature: GYAE6OF02IN41Q.19.86.H09.1.454.CMB.1.raw
  modified_base (450)..(450): a, c, t, g, unknown or other
  misc_feature (450)..(450): n is a, c, g, or t
  modified_base (500)..(500): a, c, t, g, unknown or other
  misc_feature (500)..(500): n is a, c, g, or t
  modified_base (502)..(505): a, c, t, g, unknown or other
  misc_feature (502)..(505): n is a, c, g, or t
  modified_base (507)..(512): a, c, t, g, unknown or other
  misc_feature (507)..(512): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaaatcgtcatctataatgacgctgagcggtccttaagggtcccctggaccgattcgtctggtcgagaggtctggcgcctcagcttccctggccatcagagggctcagtctacgagatgaggctgaacttattactgtgcaatcgtggatgacagtgtgaacgtccggtttcggcggaggaccaaggctgaccgtctaagcacgccgaaggctcgccccttcggtcactctcgtcccgcctccnccacgagacgtactgacgcgggatcggacgaaggccgtacgactaggacngnnnnannnnnn

SEQ ID NO: 226083 - DNA, 641 bp, Homo sapiens
  misc_feature: GYAE6OF02G1A1O.19.86.H09.1.454.CMB.1.raw
  modified_base (215)..(215): a, c, t, g, unknown or other
  misc_feature (215)..(215): n is a, c, g, or t
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggnggccgtggggcctcgagtgaggtcctccgtgcgagtcttttggatacctaccttcagtcattatctatatactcgtgggtgcgacgacggccccgtggacgagggtctggagtggagtaggggcgtacgtccgtacgggtggtaggtgggtcggcgcgtagtacgtcgacaacgtagtaaggtttcgagggtccgcgtcaccgtagtacggacgaaggtccgcgtaccaacggaactacgtaggtgttagtaacgtggtaccttggacgactaggtccgttggacgtcgtagaccggacgaccggacctaggttacgttagtttagtttgggtcggacggtacggggacgacgggggtaacgggggtaccgttaacgggaccgtaaggtttaaacgggttccgggttaccccgtaacccccggggg

SEQ ID NO: 226084 - DNA, 609 bp, Homo sapiens
  misc_feature: GYAE6OF02GLLIK.19.86.H09.1.454.CMB.1.raw
  modified_base (118)..(118): a, c, t, g, unknown or other
  misc_feature (118)..(118): n is a, c, g, or t
  modified_base (234)..(234): a, c, t, g, unknown or other
  misc_feature (234)..(234): n is a, c, g, or t
  modified_base (587)..(587): a, c, t, g, unknown or other
  misc_feature (587)..(587): n is a, c, g, or t
  modified_base (595)..(595): a, c, t, g, unknown or other
  misc_feature (595)..(595): n is a, c, g, or t
  modified_base (603)..(605): a, c, t, g, unknown or other
  misc_feature (603)..(605): n is a, c, g, or t
  modified_base (607)..(608): a, c, t, g, unknown or other
  misc_feature (607)..(608): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttctgcaagcagctcgaacagtcgggagcagtggtgtgatgtggtatcaagaaagtcccgaggaaccggacccccaaatcgtacatctataatgacnctgagtccggttaccgttaaggtccctgacctattctcgtggcgaggtacggtctggccgtcctcgacgtcctttccgtcggacccatcgaggacggtcctccgagtcgtaggaacgtgtaggacggtcttagtaatttacgttacgtgtgactacgtcgtagggatcgacgtagtcggtacggtaccgggtttccgggtttacgggacgggtaacggacacgtcgtacgtaccgtacgtacgcgacgaccgaggccctccgcccgttcgtccacttccctcgtccctacctccgtacacgtacgtacgtacgcggacggtccggacgtcgacgacgggcctacgtagtcggntcgcgtancgagacgnnngnnc

SEQ ID NO: 226085 - DNA, 678 bp, Homo sapiens
  misc_feature: GYAE6OF02IESEA.19.86.H09.1.454.CMB.1.raw
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagcccacggagcccactcccaggtgcagctggtncagtctgggctgaggtgaaggngccgtgggcctacagtgaggtcctctgacgagtctttggatacnccttgagtcatntcattatactcgtggcncgaccgtacggcccgtggacgaggacttggacgnggagtagggcgacgtccgtaggtaggtaggtggtcggcgngaacgtggtccgacacgtaacggtaaggtttcgacggggtaccgtccgtacgtaacccaggttacggaccgtaaacgggtccgtaccgtaacccgaacgtaaacgtacgtacgttacgacgttaagttcgggtaactttcggacgtacgaacggtccgtagggtacgttcgtacggacgtaaccggaccgtaccgtaagtttacgtaacgttttacggttcggtacggacgggtaacggacccggtaagggtaccggggggttaactaaaacgggtacgtttaaaacggttaacgggtttacggttaaccccgggg

SEQ ID NO: 226086 - DNA, 556 bp, Homo sapiens
  misc_feature: GYAE6OF02FLX8Q.19.86.H09.1.454.CMB.1.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (544)..(544): a, c, t, g, unknown or other
  misc_feature (544)..(544): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgacgcggtccttaagggtccctgaccgtattctcgttggcgagaggtctggcgcctcagccttcccnggccatcagaggctccagtcngaagatgaggctgattattactgtgcaatcgtggatgactagtgtgacggtttccggtttcggcggaggacagctcgaccgtctagcacgcccgaaggtcctccgcccctggtcctacgttcctccgttaccccaccccttcccgtaccaaccggtacgtaacgttcctacggacggtccgggacgtacgggacgtaacggccgtacgtaagtacggcagtcgacngcngngncnngc

SEQ ID NO: 226087 - DNA, 731 bp, Homo sapiens
  misc_feature: GYAE6OF02J13JX.19.86.H09.1.454.CMB.1.raw
  modified_base (118)..(118): a, c, t, g, unknown or other
  misc_feature (118)..(118): n is a, c, g, or t
  modified_base (164)..(164): a, c, t, g, unknown or other
  misc_feature (164)..(164): n is a, c, g, or t
  modified_base (183)..(183): a, c, t, g, unknown or other
  misc_feature (183)..(183): n is a, c, g, or t
  modified_base (712)..(712): a, c, t, g, unknown or other
  misc_feature (712)..(712): n is a, c, g, or t
  modified_base (720)..(720): a, c, t, g, unknown or other
  misc_feature (720)..(720): n is a, c, g, or t
  modified_base (723)..(725): a, c, t, g, unknown or other
  misc_feature (723)..(725): n is a, c, g, or t
  modified_base (729)..(729): a, c, t, g, unknown or other
  misc_feature (729)..(729): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttctgcaagcagctcgaacatcgggancagtggtgtgatgtggtancagaacgtcccaggaaccgccccaaatcgtcatctatatgacgctgagcggtaccttaagggtccctagaccgtatttctgtggcgagaggtctggcgcctcagtccttcctggccatccgaggaggtcctccgacgttcgaggtaagacgttacggacggtccttaggtattttaattaccgttggtcggtacctaaagttccgttaggggtatttacggaacgttaggttcgttacggggtaaacccgggttttcccggggtttttacgggaccggggtaacgggtaacccgaaggtccgtaccggttaaccccgttaaccgttaaacggttccggaaccgtacccggtaaacgggttcccgtcccgggtaccccccgttccggttacccgtaccgtttacccgtacccgtttaccccccgtacccccgtttacccgtaccccggaaccggtacggttaccgtaaccggttcgggaacgggtcccgggtcgtacgggaccgtacgggccgtacgaacgtcggctagngtcgcgcncgnnngcgntc

SEQ ID NO: 226088 - DNA, 607 bp, Homo sapiens
  misc_feature: GYAE6OF02FT1M2.19.86.H09.1.454.CMB.1.raw
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcgagtgaaggtctccgtggcgaggtcttttggatactaccttcagtctattatcatatactcgtgggtgcgacacggcccctggacgaagggcttgaggtggagtagggcgatccgacggtggtaggtggtggcgcgagtacgtcgcacgagtagtttcgacgggccgngtccacngtcggaccgaaggtcgccgtaccgaacgaatacgagttagtatagtaggtacttggacgcacgccgttagggacggttcgtcggaaccgacgaccggtacctagttacggttatttacgttgggtggaccggtagggccggtaaggggaccggggtaacgtaacgggtactaaggttaacggttcgggttacccggtaccccggg

SEQ ID NO: 226089 - DNA, 685 bp, Homo sapiens
  misc_feature: GYAE6OF02JCXTO.19.86.H09.1.454.CMB.1.raw
  modified_base (117)..(117): a, c, t, g, unknown or other
  misc_feature (117)..(117): n is a, c, g, or t
  modified_base (264)..(264): a, c, t, g, unknown or other
  misc_feature (264)..(264): n is a, c, g, or t
  modified_base (332)..(332): a, c, t, g, unknown or other
  misc_feature (332)..(332): n is a, c, g, or t
  modified_base (646)..(646): a, c, t, g, unknown or other
  misc_feature (646)..(646): n is a, c, g, or t
  modified_base (662)..(662): a, c, t, g, unknown or other
  misc_feature (662)..(662): n is a, c, g, or t
  modified_base (671)..(671): a, c, t, g, unknown or other
  misc_feature (671)..(671): n is a, c, g, or t
  modified_base (679)..(679): a, c, t, g, unknown or other
  misc_feature (679)..(679): n is a, c, g, or t
  modified_base (683)..(684): a, c, t, g, unknown or other
  misc_feature (683)..(684): n is a, c, g, or t
tcagtactctcgtgcacgaccggtgctcgatttagtgctatagacttggggtttgggggccgttcctgggcccagtctgtgctgactcaggcaccctcagcgtctgggaccccgggnagacggtcacatcgcttgttctgcaagcagctcgaacatcgggagcaggtggtgtgatggtggtatcaagaaagtcccgaggaccgccccaaatcgtcatctataatgacgctagacgtcggtccttaagggccctgaccgtattcnctggcgagaggtctggcgacctcacggtcttccctggacccatccgaggacggctccgagtctgaagntgacggctggtattacttacgtgtacgtacaaagtccgttaggggacttaggaacggtaggtaggtttacgggtaaacccggggttttcccggggtttttacggggaccggggtaacggggaacccgtaaacgggtccgtttaacggtaaccccggttaccgttaaacggtccgtaaacgaccccgaaacgggtccgtacccgtacccccgttcgggtacctaacccgttccgtacgtttacccccacccttacccgttccgaacggtaacgcgttaaacgttcgacggacgggtcctagggaccaaccgggtnaccgtaagtcgacgtntcgattacngcttaagnacgnnc

SEQ ID NO: 226090 - DNA, 709 bp, Homo sapiens
  misc_feature: GYAE6OF02GRFFV.19.86.H09.1.454.CMB.1.raw
  modified_base (195)..(195): a, c, t, g, unknown or other
  misc_feature (195)..(195): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggagtagggcgatccgacgggtggtagtggtggcgcagtacggtcacacagtaagtttcgagggccgcgtcaccagtcggaccaaggtccgcgtcccaacggtaactacgagtcgtatagtggacttgacgcacgccgtggaggtctaggaccgtacgaccggcctagtacgttatttattggtacgcggtaggacggagggacggggtacgtaaacgggcaagtaaaggttcggttaccggaccccggtcggggtaccgaacgggtaacccgttcgggtacccgtacccgttcgtacccgtaccgaccgccctacccgaccggaaaccgggtccccgacgtttccccgggttacccctttacccccggcggtaccccgtccccgttccggtaccgtacccggaacgggaccggtacccgtaaccccgtacccggaacggtaccgaccgaccggtaccggccccgggtccccggtagggtccccgg

SEQ ID NO: 226091 - DNA, 530 bp, Homo sapiens
  misc_feature: GYAE6OF02F1AKJ.19.86.H09.1.454.CMB.1.raw
  modified_base (318)..(318): a, c, t, g, unknown or other
  misc_feature (318)..(318): n is a, c, g, or t
  modified_base (464)..(464): a, c, t, g, unknown or other
  misc_feature (464)..(464): n is a, c, g, or t
  modified_base (516)..(520): a, c, t, g, unknown or other
  misc_feature (516)..(520): n is a, c, g, or t
  modified_base (523)..(524): a, c, t, g, unknown or other
  misc_feature (523)..(524): n is a, c, g, or t
  modified_base (526)..(530): a, c, t, g, unknown or other
  misc_feature (526)..(530): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccagggaaccggcccccaaatcgtcatctataatgacgctgagcggtccttaagggtccctgacccgattctctggcgagaggtctggcgcctcagccttccctcggccatcagagggctccagtcngaagatggagctgtattattacctgtgcaatcgtggatgacgagtgtagaacggttccggttttcggcggacgggaccagctgaccgtctaagtcacgaccctaggcgtcgcccccgtggtccacgtcctcgttcccgcccttccnccacgacgtacgtacgtggacggcggtcgtggcaacgggcgacgtacgtagnnnnngcnngnnnnn

SEQ ID NO: 226092 - DNA, 446 bp, Homo sapiens
  misc_feature: GYAE6OF02I7KWQ.19.86.H09.1.454.CMB.1.raw
  modified_base (434)..(446): a, c, t, g, unknown or other
  misc_feature (434)..(446): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgaccccgtgggccagggaaccctggtcaccgtctcctcagcctccaccaagggcccatcgtcttccccctggcgccctgcctccaggagcaccctccgacgagccacgacgccggacccgtgggcctgccctggtcaacgggacctacgtacccacgaagagtaactgaggcgggctgggcaaggcgcatgnnnnnnnnnnnnn

SEQ ID NO: 226093 - DNA, 574 bp, Homo sapiens
  misc_feature: GYAE6OF02JMN4T.19.86.H09.1.454.CMB.1.raw
  modified_base (365)..(365): a, c, t, g, unknown or other
  misc_feature (365)..(365): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
  modified_base (543)..(545): a, c, t, g, unknown or other
  misc_feature (543)..(545): n is a, c, g, or t
  modified_base (547)..(549): a, c, t, g, unknown or other
  misc_feature (547)..(549): n is a, c, g, or t
  modified_base (552)..(552): a, c, t, g, unknown or other
  misc_feature (552)..(552): n is a, c, g, or t
  modified_base (555)..(559): a, c, t, g, unknown or other
  misc_feature (555)..(559): n is a, c, g, or t
  modified_base (561)..(573): a, c, t, g, unknown or other
  misc_feature (561)..(573): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacaccggccatgtatttattgtgcgaggcgagggacggggactaaaggcaataaagtgggttccgaccccgtggggccacgggaaccctggtccaccgtctcctcacgccctcccaaccgaacgggccccagttccggttcccttccccccgtggcccgtcccctcgcctccgaggacncccgacccgtccgacgacgccacgaccggccggcccgtcgggcctcgtcccgttcgggtaccgaaacgggtaccttacccgttacccacggaaggtacgtaacgtcgggtacggccgggtccgtagggacccgaaggggaccgacgaacgttaacggngngngcngncncgangnngnnngnnngcngcnnnnngnnnnnnnnnnnnnc

SEQ ID NO: 226094 - DNA, 622 bp, Homo sapiens
  misc_feature: GYAE6OF02G838L.19.86.H09.1.454.CMB.1.raw
  modified_base (218)..(218): a, c, t, g, unknown or other
  misc_feature (218)..(218): n is a, c, g, or t
  modified_base (415)..(415): a, c, t, g, unknown or other
  misc_feature (415)..(415): n is a, c, g, or t
  modified_base (558)..(558): a, c, t, g, unknown or other
  misc_feature (558)..(558): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagcccaccggacgcccactcccgaggtgcagctggtgcagtcgtgggctggaggtggaaggngccgtcgggcctcgaggtgacggtctcgtgcggaggttctttggactacgtaccttgagtctattatcatatactgtggtgcgacgacggcccgtaggacgaggtctggagtggaggtacgggcgaacgtcggtaggtggtagggtgggtggcgactacgtacgtcgacaacgtaggtaacggttcggacgggtccncgtacaccgtaggccggaccgtaacgggtccgaccgttaccaagtaacgtaacgtagttcgtaagtacgtaggttacgttagacgcacggtcgttaggacggtctacggaacgaccggacgcctagttacgttatggttcggngcggtaggacggaagggtacggaacgtaaggacgtaaggttacggtacggtaccggtacccggg

SEQ ID NO: 226095 - DNA, 610 bp, Homo sapiens
  misc_feature: GYAE6OF02INS2E.19.86.H09.1.454.CMB.1.raw
  modified_base (605)..(606): a, c, t, g, unknown or other
  misc_feature (605)..(606): n is a, c, g, or t
  modified_base (609)..(610): a, c, t, g, unknown or other
  misc_feature (609)..(610): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgacgcggttccttaagggtccctgaccgattctctggcgagaggtctgggcgcctcagccttcccgtggcctatccgaggacggggcctccgagtctagaagatgaggctgtattattactgtgacaatcgtggatgactaggtgtaggtaacgggttccggtttacggcgggtacgggacaacggcgtacggacccgttacgtaacgtcgacgacccgtaacgggcctcccggtcccccgttcggtacctaccgttccgtaccggtttcccccgcccgttccccgtccgaacggtacgtacgttacgtcggacggtccggggcgtacgggacgaagggtccgaccgtagttacggctacgagctagcgtgcgnncgnn

SEQ ID NO: 226096 - DNA, 741 bp, Homo sapiens
  misc_feature: GYAE6OF02IP6CI.19.86.H09.1.454.CMB.1.raw
  modified_base (122)..(122): a, c, t, g, unknown or other
  misc_feature (122)..(122): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggngcctggggcctcagtgaaggtctcctgcgaggcttttggatacaccttcagtcattatcatatactctgggtgcgacacggccccgtggacaagggtcttgagtggagtagggcgacgtccgacggttggtaggtgggtaggcgcagtaccgtcgacacgagtaaggtttcgagggccgcgtcaccagtcggaccaacgggtccgcgtccacgaactacgagtgtatagtggacttgagcacgctggaggtcgtagaccggaacgaccggcctagttacgtaattttacgttggtcggtaccgggtaggccggtaagggggaaccggggtaacggtaaaaggaccgtaaaggttaaacggttcgggttacccggtaacccgggtcgggggacccgtaacggggtaaccccgttcgggtacccgtacccgttccgtacccgtccgacgtccccgtaccgaacccggaacgggtaccccgtacgttcccggtttcccgttacccccgtcgggccccgtaccgttccgtccgtacccggtaagggtaacccgtcccgtaacccgtcccggaaggacccggccgtaaccggaccgggccccgggtcccggtccggggtacccg

SEQ ID NO: 226097 - DNA, 702 bp, Homo sapiens
  misc_feature: GYAE6OF02IXCCN.19.86.H09.1.454.CMB.1.raw
  modified_base (550)..(550): a, c, t, g, unknown or other
  misc_feature (550)..(550): n is a, c, g, or t
  modified_base (670)..(670): a, c, t, g, unknown or other
  misc_feature (670)..(670): n is a, c, g, or t
tcagtactctcgtgcacgaccggtgctcgatttagtgctatagacttgggtttgggggaagaggaagactgacggtcccactcccaggtgcagctggtgcagtctggggctgaggtgaaggagcctgggcctcagtgaaggtctcctgcgaggcttttggatacaccttcagtcattatcatatactcgtgggtgcgacacggccccgtggaccgaagggtcttagagtaggagtagggcgtaagtccgtaccggtaggtagtacggtggacgactagtacgtcgacgacgagtaagtttacgacggccggccgtctaccgacgtacggtaccgaacggtacggtccgtccgaaccgtaagtaacctagttagtacttagtacgtaccgttgtaagtccgacgtaccgtcgtacggtacgtcggtacgaacgaccggtaccgtagttaacgttagtttacgttcggtaggccggtaacgggcggaacggggtacccggggtaataaacggtacgaacgtttaaacggttcgggttcccgtaaccccgggngggtaacccgacggtaaccgtcgttacgaccgtccgtctacgctcccgaccacgtacgcgtctccgtcctcccgtgacccgcctacgttcgcccggaggtaccgacctacccgtcgaagngcccaaccggtcgaccggtcccgtgggtcccg

SEQ ID NO: 226098 - DNA, 592 bp, Homo sapiens
  misc_feature: GYAE6OF02HSPFT.19.86.H09.1.454.CMB.1.raw
  modified_base (352)..(352): a, c, t, g, unknown or other
  misc_feature (352)..(352): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtgagtagggcgatcgacggtggtagtggtggcgcatacgtcgcacagtaagtttcgagggccgcgtcaccatcggaccaaggtccgcgtccacgaatacgagtgtatatggacttgagcagcctgagtcngacgacacgcatgtattatgtgcgaggcaggacggggactaaaggcaagtaaaggtcggttaccgacccgtggggaccacgggaaccctggtaccaccgttctcctcgacgcccgtaccaccgaaccgggccctacgtccggttccccttccccgtcggccgtccccgtcgcccgtccgaacggaccgccgacccgttccgaaggtccgacgaccgacggccggtaccccggtgggtccg

SEQ ID NO: 226099 - DNA, 547 bp, Homo sapiens
  misc_feature: GYAE6OF02GL8SM.19.86.H09.1.454.CMB.1.raw
  modified_base (332)..(332): a, c, t, g, unknown or other
  misc_feature (332)..(332): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagccgtggggcctcagtgaaggtctcctgcgaggcttttggatacaccttcagtcattatcatatactctgggtgcgacacggcccctggacaagggcttgagtggataggggcganccgacggtggtagtggtggcgcagtacgtcgacacagaagtttcgagggccgcgtccaccagtcggccaaagggtcgccgtccaacgaactacgagtgtatagtggacttggagtcagcctaggaggtctgacgacgacggcctagtgtatttagttgtaggcggtaggcgaaggggacgggtacgtaaaggcaaggttaaggtggttaccccgg

SEQ ID NO: 226100 - DNA, 724 bp, Homo sapiens
  misc_feature: GYAE6OF02HTMPR.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttccctcaccatggactggaccgtggagactcctccttcgttggtggcagcacgcccgaccgggacgccccacctcccgaggtgccgagcgtgggtgaccaggttcgtgggggctggagggtaggaagggacggcccggtacgggggccctacgtaggtacggaagggttccctcgtaggcggtaggttcgttttggacttaacctaccttcagtcctaatttacacattacttacgtcgttaggggtcgaccgacgtccggtccccgttaggaaccgtaaggggtcttaggaggtagggaggtacggggcggtacgtccggtaagggtcgggttaggtgggtcggacgcgtaataccggtcgacgacgtaaggtaagttcgggacgggtcccgtacgccgaccgtagtcggaccgaaggtccgaccctacgaacggtaatacgaggttagtagttacgacggtacttaggacgagcgccgtgggtacggtgtaccgaacggacgacccgtactagttacgttacttaaggttcggacggacgggtagggaccggaggggaccgggtaaggtaaaccggacgtaaaggttacgggttaggtaacccccgggg

SEQ ID NO: 226101 - DNA, 550 bp, Homo sapiens
  misc_feature: GYAE6OF02I7F78.19.86.H09.1.454.CMB.1.raw
  modified_base (266)..(266): a, c, t, g, unknown or other
  misc_feature (266)..(266): n is a, c, g, or t
  modified_base (378)..(378): a, c, t, g, unknown or other
  misc_feature (378)..(378): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgagggtgaaggagccgtggggcctcagtgaagggtctcctgcgaggtcttttggatacaccttnagtcattatcatatactctgggtgcgacacggcccctggacaagggcttgagtggatagggcggatcgacggtggtagtgggtgcgcagtacgtcgcacgagacggtttacncgggccgcgtcaccgtagtgggccgaaaggtcgccgtaccaacggaactaccagtacgtatacgtggtacttgagcagcctggacgtctgacgacacggcatgtattattgtggcgaggcgacgggacggggaactaagggctaagtaacggttcggttaccgtaccccggg

SEQ ID NO: 226102 - DNA, 566 bp, Homo sapiens
  misc_feature: GYAE6OF02H3WOO.19.86.H09.1.454.CMB.1.raw
  modified_base (282)..(282): a, c, t, g, unknown or other
  misc_feature (282)..(282): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (556)..(557): a, c, t, g, unknown or other
  misc_feature (556)..(557): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(566): a, c, t, g, unknown or other
  misc_feature (564)..(566): n is a, c, g, or t
tcagtactctcgtgcacgaccggtgctcgatttagtgctatagacttgggttttgggggccgttcctgggcccagtctgtgctgactcaggcaccctcagcgtctgggacccccgggcagacggtcaccatcgcttgttctgcaagcagctcgaacatcgggagcagtggtgtgatgtggtatcaagaaagtcccaggaacgcccccaaaatcgtgatctataaatgacgctgagcggttccgttaacgggtccctagaccgattcgtctggcgagaggtcnggcgcctacagtccttcccgtggccatcgagagggcctccgagtcgtagaagatggaggctaggattattacgtgtagacaattcgagggtatgactaggtgtaggtaacggttccgggtttaggcggaaggtacacgcgtacggaccgttcgtaaatccgagacccgaaggcctccgtccccgtcggtacctactcgttcgtaccccacccttcctaccaacgagtaactacgttgaccgcgggcctggaacgacgcgcaacgtgancngacnnacngnannn

SEQ ID NO: 226103 - DNA, 722 bp, Homo sapiens
  misc_feature: GYAE6OF02HT7WG.19.86.H09.1.454.CMB.1.raw
  modified_base (117)..(117): a, c, t, g, unknown or other
  misc_feature (117)..(117): n is a, c, g, or t
  modified_base (163)..(163): a, c, t, g, unknown or other
  misc_feature (163)..(163): n is a, c, g, or t
  modified_base (268)..(268): a, c, t, g, unknown or other
  misc_feature (268)..(268): n is a, c, g, or t
  modified_base (697)..(697): a, c, t, g, unknown or other
  misc_feature (697)..(697): n is a, c, g, or t
  modified_base (703)..(703): a, c, t, g, unknown or other
  misc_feature (703)..(703): n is a, c, g, or t
  modified_base (706)..(706): a, c, t, g, unknown or other
  misc_feature (706)..(706): n is a, c, g, or t
  modified_base (720)..(720): a, c, t, g, unknown or other
  misc_feature (720)..(720): n is a, c, g, or t
tcagtactctcgtgcacgaccggtgctcgatttagtgctatagacttgggtttgggggccgttcctgggcccagtctgtgctgactcaggcaccctcagcgtctgggacccccgggnagacggtcaccatcgcttgttctgcaagcagctcgaacatcgggancagtggtgtgatgtggtatcagaaagtcccaggaaccgccccaaatcgtcatctaataatgaccgctgacggtcggttaccgttaagggtcccctggaacccgtntttccgtcgtgggccggaggaggttcgtcgggccgtccttcgacgcctttaccccgtcggccctaatccgaggacgggtcctccgagttcctaggaacggtagtcggacggtctagtatttattacgtgtcgtctaagttcgtaggtatgacgtaggtcgtaggtaaccgggttccgggttttacgggacgggtacgggtaacccgaacggtcgttccggaaccccgttacttaacggaccgtaaccggtacccgaacggtcccgtcccggtacccccgttaccgggttccctaacccgttcccgtttaccccgttacccccgttacccccgttcccgtacccgaaccggtaaccggttaacggttaccgtacgggaccgggtccggggtacctacgggaccggtacgggccgtacgtaacggtcggantcgacngtntacgcgtgactagncg

SEQ ID NO: 226104 - DNA, 511 bp, Homo sapiens
  misc_feature: GYAE6OF02IM1WT.19.86.H09.1.454.CMB.1.raw
  modified_base (453)..(453): a, c, t, g, unknown or other
  misc_feature (453)..(453): n is a, c, g, or t
  modified_base (460)..(460): a, c, t, g, unknown or other
  misc_feature (460)..(460): n is a, c, g, or t
  modified_base (492)..(492): a, c, t, g, unknown or other
  misc_feature (492)..(492): n is a, c, g, or t
  modified_base (494)..(497): a, c, t, g, unknown or other
  misc_feature (494)..(497): n is a, c, g, or t
  modified_base (500)..(501): a, c, t, g, unknown or other
  misc_feature (500)..(501): n is a, c, g, or t
  modified_base (505)..(506): a, c, t, g, unknown or other
  misc_feature (505)..(506): n is a, c, g, or t
  modified_base (508)..(510): a, c, t, g, unknown or other
  misc_feature (508)..(510): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtcccctgaccgattctctggcgagaggtctggccgcctcacgcttccctggccatcaggagggctccagtctgaacgatgaggctgattattactgtgcaatctggatgacagtgtgaacggttccggtttcggcggagggaccagctacgaccgtctaagtcagcccgaaggcctcgcccctcggtcactctcgttcccaccctccnccacganacgtactgacgcggctggcaacggcacgtagngnnnncgnngtcnncnnnc

SEQ ID NO: 226105 - DNA, 614 bp, Homo sapiens
  misc_feature: GYAE6OF02FK1EU.19.86.H09.1.454.CMB.1.raw
  modified_base (164)..(164): a, c, t, g, unknown or other
  misc_feature (164)..(164): n is a, c, g, or t
  modified_base (356)..(356): a, c, t, g, unknown or other
  misc_feature (356)..(356): n is a, c, g, or t
  modified_base (607)..(608): a, c, t, g, unknown or other
  misc_feature (607)..(608): n is a, c, g, or t
  modified_base (612)..(613): a, c, t, g, unknown or other
  misc_feature (612)..(613): n is a, c, g, or t
tcagtactctcgtgcacgaccggtgctcgatttagtgctatagacttgggtttgggggccgttcctgggcccagtctgtgctgactcaggcaccctcagcgtctgggaccccccgggcagacggtcaccatcgcttgttctgcaagcagctcgaacatcgggancagtggtgtgatgtggtatcagaaagtcccaggaaccggcccccaaatcgtcatctataatgacgctgagtcggtccgttaacgggtccctgaccgtattctcgttggcgaggaggtcgtggcgtcctcacgcttcccctgggccattcaggacggctccagttctgaagatgaggctgattattactgtgntaactcgtgggatgacgtagtgtagtaccgggttccgggttttcgggcgggtacgggaccaagtcgtcggacccgttctaacggtcacgacccgtaacggtccgtcccgtcccccggttcggttacctacccgtccgttcccgttcccccgtccccttcccgttaccgaaccgtacgtaccgttacgtacgggacggtcgggccgtcgggacgaaccgggtcgaccgtaagttcgagtcgacgtgcgcgcnngcgnnc

SEQ ID NO: 226106 - DNA, 847 bp, Homo sapiens
  misc_feature: GYAE6OF02GLD89.19.86.H09.1.454.CMB.1.raw
  modified_base (118)..(118): a, c, t, g, unknown or other
  misc_feature (118)..(118): n is a, c, g, or t
  modified_base (165)..(165): a, c, t, g, unknown or other
  misc_feature (165)..(165): n is a, c, g, or t
  modified_base (232)..(232): a, c, t, g, unknown or other
  misc_feature (232)..(232): n is a, c, g, or t
  modified_base (829)..(829): a, c, t, g, unknown or other
  misc_feature (829)..(829): n is a, c, g, or t
  modified_base (832)..(832): a, c, t, g, unknown or other
  misc_feature (832)..(832): n is a, c, g, or t
  modified_base (840)..(841): a, c, t, g, unknown or other
  misc_feature (840)..(841): n is a, c, g, or t
  modified_base (846)..(846): a, c, t, g, unknown or other
  misc_feature (846)..(846): n is a, c, g, or t
tcagtactctcgtgcacgaccggtgctcgatttagtgctatagactttgggtttgggggccgttcctgggcccagtctgtgctgactcaggcaccctcagcgtctcgggaccccgggnagacggtcaccatcgcttgttctgcaagcagctcgaacagtcgggancagttggtgtgatgtgtatcagaaacgtcccaggaaccgaccccaaatcgtcatctaataatcgacnctgacgtccggttccgttaacggtcccctagacccgtattttccgtcgtacgggcgaggtacggttccgttcgggcccgccttcaacggttccccttttccccgtcgggccctaacttccggaacgggtaccgggtccttaacccggtaaggtttcctaaagggtaagtacggtgggtaacggttaccgttaggttaacttttaacgttaccggttaggttaccgaacgtttaacgtcggttaaggggaactttacgggaacgttaaggggtttcggttaaaccgggggtttaacccgggtttttacccggggggtttaccggggaacgggggaaaccgggtaaacgtaacgggtaccggtttacccggttaacccggttaaccggttaaacgtcccggaaacggtaaccccggtaaccgggtcccgtaccccgggttacccccggttacggttacccgtaccgtttcccgtttaccccgttacccccttaccccgttcccttaacccggaacggttaccggtaccggttaccgtaggggaccgggtaccggtcggtaccgggaacggaaccggtcgtaaccgacggtagctacgcncgnacacacgnntacgnc

SEQ ID NO: 226107 - DNA, 776 bp, Homo sapiens
  misc_feature: GYAE6OF02JCN8Q.19.86.H09.1.454.CMB.1.raw
tcagtactctcgtgcacgaccggtgctcgatttagtgctatagacttgggtttggggagcatcacccagcaacacatctgtcctctagagaatcccctgagagctccgttcctcaccatggactggacctggaggatcctctcttggtggcagcagccaccggacgcccactcccaggtcgcagctgggtcgactacgtcgtggggcttaggagggtagaagggcgtccgtcgggggcccttgaaggtaggaacggttccgtcctaggcggtaaggtccgttttagggactaccgtaccttcgaacgttctaagttataccgtacttaactaccgttcgtggggttacggacgtaccgaccgggtaccccgtaggtaacccgtaaggggtccgttacgggtaaccgggttagggaacggtttaacggggaccggtagttaccccgaacggggttcggtttacgggtcggggttacggcgtacgtagtaccgttacgctaacgtaggtaacggtttaccgacgggtacccgtcgtaccgtacgtacgttaggacccgtaaagggccgtaccgtaccggtaaggtaaaccgtacgtacggttaacgtaacgttacggttacggtactaacggttacgacgtacgggtacctagggtaccggtcgaacggtcgtaaccggaccggtaccgtatcgttacgtttgacggttcgaacgggagtcggtaacggagggacgtaaggtaccgtaacggtacgttaccgggtaccggtacccggg

SEQ ID NO: 226108 - DNA, 845 bp, Homo sapiens
  misc_feature: GYAE6OF02GJAQH.19.86.H09.1.454.CMB.1.raw
tcagtactctcgtgcacgaccggtgctcgattagtgctatagacttgggtttgggggaaggaggaagactgacggtcccacctcccaggtgcagctggtgcagtctggggctgaggtgaaggagcctggggcctcaggtgaaggtctcctgcgaggtctttttggatacaccttcagtcattatcattagtactcgtagggtcgcgtacacggccctggacagggtcttggagtggatagggcggatcgacggttaggtagtggtcggcgtaccagtacggtcggcctaagaggtaagtttcgacgggtccgacgtcgacctagtcggaccgtaaggtccgaccgtaccgaacggtaaactaccgagtgttaactaggtacggtacttggaacgcgtaacggtcccttaggtaagtccggtttacggtaacccgggaaacgccccgggtaaccgtaagtttaacgggttaaccgttttaagttttgggacgggttaccgggaaggtaccggttaaccgggggaaccggggttaaacgttaaacgggacgttaaaacggttaaacggttaccgggttttaacgtaaccggtaacccgggttaggggtacccgggtaaaccgggttaacccgggttacggttacccggaacccgttccgttaacccgttccgtacggtaccccttacccggaaaccgaaacccgggtcccctagggtaccccgttccggtttcccccgacggtccccggtcccttacggtccacccggttacggaccgtaccccggtaccgtaacccggtacgtacggaacccacgggtacccggtacccgggtccggttacccggg

SEQ ID NO: 226109 - DNA, 826 bp, Homo sapiens
  misc_feature: GYAE6OF02I3R52.19.86.H09.1.454.CMB.1.raw
  modified_base (214)..(214): a, c, t, g, unknown or other
  misc_feature (214)..(214): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgaggtgaaggngccgtggggcctcgagtgaaggtcctccgtgcgtaggtcttttaggataccgtaccttcgagttcgtattacgtactataactacttcgtgggtcgacgtaccgacgggtccccgtaggaacgtaacgggtccttaggacggttaggggaacgtacgggggacggtaacgtacccggtaacggggttacggttaagggtcgggggttcgggaccggtacgttaaacggtaccgggtttccggaaccgtaaccgtaaacgggttaacggttttacccggaagggggttccccgaccggtacccgaacccgtaaggtccggggtaacccgtaaggggttcccgtaacccggttaccgaaaccggttaaacgtaaacggtacggttaaggttaacgtaacggttacgggtaactttcggaacgtacgaacggtaccgttacgggtaacgttcgtacggtaaccgtaccgaccgggtacctaagttacggttattttaacggttcgggtaaggtaccgggtacgggaacgggtaacgggggtaaccggggtacggtaaaacgggtacccggtaaaggttaaacggggtttccggtaacccccgggtaacccggggg

SEQ ID NO: 226110 - DNA, 661 bp, Homo sapiens
  misc_feature: GYAE6OF02H059A.19.86.H09.1.454.CMB.1.raw
  modified_base (373)..(373): a, c, t, g, unknown or other
  misc_feature (373)..(373): n is a, c, g, or t
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtctgggctgaggtggaaggagccgtggggcctcagtggaaggtctccgtgcgaggtcttttggataccaccttcgagttcattatcattactacttcgtgggtcgcgacgacggcccctgggaacaagggtcttggagtgggagtagggcgtatccgagggttggtaggttggtggcgntagtacggtcacacagtaagtttccggaggggcccgtacgtaccacgtacgtcgggaccgtaacgggtccgtaccggtacgaacgtaacttaacgtaaggttcgttaacgttggttaacggttacgttaggtacggccgtacggtcccttgggtaacggttcggacggaccggtaaccgaccggtaccctagttcgtttagtttagttggtacggcggacgggtacggacggggaccgggtaacgtaacggaccgtaaggtaacgttccgggtcccgtaaccccgggg

SEQ ID NO: 226111 - DNA, 316 bp, Homo sapiens
  misc_feature: GYAE6OF02F8HCN.19.86.H09.1.454.CMB.1.raw
  modified_base (300)..(316): a, c, t, g, unknown or other
  misc_feature (300)..(316): n is a, c, g, or t
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtccttccccctggccgccctgcctccaggagcacctccgagagcacagcggccctgggctgcctggtcaaggctacttccacgagagtactgacgcgggctggcaaggcgcatagnnnnnnnnnnnnnnnnn

SEQ ID NO: 226112 - DNA, 682 bp, Homo sapiens
  misc_feature: GYAE6OF02H3YYH.19.86.H09.1.454.CMB.1.raw
  modified_base (165)..(165): a, c, t, g, unknown or other
  misc_feature (165)..(165): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (438)..(438): a, c, t, g, unknown or other
  misc_feature (438)..(438): n is a, c, g, or t
  modified_base (669)..(669): a, c, t, g, unknown or other
  misc_feature (669)..(669): n is a, c, g, or t
  modified_base (672)..(672): a, c, t, g, unknown or other
  misc_feature (672)..(672): n is a, c, g, or t
  modified_base (674)..(675): a, c, t, g, unknown or other
  misc_feature (674)..(675): n is a, c, g, or t
  modified_base (677)..(682): a, c, t, g, unknown or other
  misc_feature (677)..(682): n is a, c, g, or t
tcagtactctcgtgcacgaccggtgctcgatttagtgctatagacttgggtttgggggccgttcctgggcccagtctgtgctgactcaggcaccctcagcgtctcggggacccccgggcagacggtcaccatcgcttgttctgcaagcagctcgaacatcgggancagtggtgtgatgtggtatcagaaacgtcccgaggaacccggacccccaaactcgtacattactaataatgaccgctaggacgtccgggttaccttaacggggttcccctacggaccgtatttccgttcgtacgggaccggagtacggtccgtcgggtccgccttcgacgtccctttcccgngaccctntacgaggacgggcctccgtagtcctaggaagtagtggacggtcttagtaagtttacttacgtgtcgaactacgtcggtaaggtntacggactaggaggttacgggtaaccgggtttccgggtttacggaccgggtacggaaccgaggtcgtcggacccgttaacgtacggcctaccgaccgacggtcccgaccgttccccgtcgttacctcttcccgtttaccgtcccgaccccttaccgacccgtacggaccttcgtccggtacggaccgggtcgggtaactcccgggagaacccggcgtacggtacagtccgnacngnncnnnnnn

SEQ ID NO: 226113 - DNA, 560 bp, Homo sapiens
  misc_feature: GYAE6OF02HA3XC.19.86.H09.1.454.CMB.1.raw
  modified_base (327)..(327): a, c, t, g, unknown or other
  misc_feature (327)..(327): n is a, c, g, or t
  modified_base (546)..(547): a, c, t, g, unknown or other
  misc_feature (546)..(547): n is a, c, g, or t
  modified_base (551)..(560): a, c, t, g, unknown or other
  misc_feature (551)..(560): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacggtcaccatcgcttgttctgcaagcagctcgaacatcggggagcagtggtgtgatgtggtatcagaaagtcccaggaaccggcccccaaatcgtcatctataatgacgctgagcggtccttaagggtccctgaccgattctcgtggcgagaggtctggcgcctcagccttcccgtggccatcgaggacggctccagtctagaagntgagctgtattattactgtgctaatcgtgggatgacgtagttgtcgtaacgggttccggtttcgggcgggtacgggaccaagtcgtcgtacccgtccgtaacgtcacgcccgaaggtccctccgtccccgtcggtcccacgttcctcgttccccgcccttccctccgacgcgtacgtcgtcggacgtcgggcgtcggacgaacgggccgcgtaagtcgnngtcnnnnnnnnnn

SEQ ID NO: 226114 - DNA, 652 bp, Homo sapiens
  misc_feature: GYAE6OF02FLLKF.19.86.H09.1.454.CMB.1.raw
  modified_base (265)..(265): a, c, t, g, unknown or other
  misc_feature (265)..(265): n is a, c, g, or t
  modified_base (457)..(457): a, c, t, g, unknown or other
  misc_feature (457)..(457): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcgttggtggcagcagccgaccggagccactcccgaggtgcagctggtgcagtcgtggggctggaggtgaaggagccgtggggcctgagtgagtctcgtgcgagttgtttgataccaccttnagtctattatcattatcgtcgtgggtcgacggacgtacggcccgtacggacgtaaggggtcttacggaggtacgggtaggtacggggacggtacgtccggtaacggggttggttagggtcggggtggaccggacgtaggtaaccggttcgaacgacgtaaggtacggtttcgacgggtccgccgtaccacgnggtacggcgtaacgggtcgaccgtaccgaacgaagtacgagttagtaatacggtacgtcgttcgaggtacacggtccgtaggtacgtcgtaggaaccgacgacgtcgacgttagttagttgttgtcgacggtacggacggacggggtacggacgtaacggacgtaacggtacggttaccggtacccgtacccggg

SEQ ID NO: 226115 - DNA, 890 bp, Homo sapiens
  misc_feature: GYAE6OF02H8OX1.19.86.H09.1.454.CMB.1.raw
  modified_base (180)..(180): a, c, t, g, unknown or other
  misc_feature (180)..(180): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggactggaggatcctcctcttggtgcagcagccaccggagccccactccaggtcncagctggtgcagtcgtgggctgaggtagaaggacgccgtcgggtcctcgtagtacggaacggttccttccgtggcggtacggttcgtttttaggaactaccgtaccgttcgacgttactaattacgttactattaacttccgttcgtagggtcgtaccgaccgtaccggcccgtaggaacgtaacgggtcgttaggaggtagggacggtacgggacggtacgtccggtaacgggttagggttacggttggggtcgggtaccggtcctaaacggttaccggacccgtacgtaaccgttaaagggttaccgtttcccgggacgggtaccccggttacccggtcccgtaaccgtacggtttaaccgggaccgttaaccggggttacccggtacccgtaacccggtaaaccgtaaacggttaccgtaacgggtttaacgggtttaacttaacgggttccggttaaacggtttcggaaaccgggttccgttaccggttaccggttagtaccgggtttacggaaccgggtaacccggtaacccgggtaaacggtccccgtttaagggttacgtttacgtttttaaccgggtttcggccggggtaacccggtaaggggtaccccgggttaaggggaaaacccgggtcggttaaaacggggctttaaaacggggtttaaccgggttaccccgggtttaccccgggaacccccgggggg

SEQ ID NO: 226116 - DNA, 698 bp, Homo sapiens
  misc_feature: GYAE6OF02HP1UF.19.86.H09.1.454.CMB.1.raw
  modified_base (187)..(187): a, c, t, g, unknown or other
  misc_feature (187)..(187): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
  modified_base (638)..(638): a, c, t, g, unknown or other
  misc_feature (638)..(638): n is a, c, g, or t
  modified_base (659)..(659): a, c, t, g, unknown or other
  misc_feature (659)..(659): n is a, c, g, or t
  modified_base (667)..(667): a, c, t, g, unknown or other
  misc_feature (667)..(667): n is a, c, g, or t
  modified_base (683)..(683): a, c, t, g, unknown or other
  misc_feature (683)..(683): n is a, c, g, or t
  modified_base (686)..(686): a, c, t, g, unknown or other
  misc_feature (686)..(686): n is a, c, g, or t
  modified_base (690)..(690): a, c, t, g, unknown or other
  misc_feature (690)..(690): n is a, c, g, or t
  modified_base (693)..(694): a, c, t, g, unknown or other
  misc_feature (693)..(694): n is a, c, g, or t
  modified_base (696)..(698): a, c, t, g, unknown or other
  misc_feature (696)..(698): n is a, c, g, or t
tcagtactctcgtgcacgaccggtgctcgatttagtgctatagacttgggtttgggggccgttccgtgggcccagtctgtgctgactcaggcaccctcagcgtctcgggacccccgggcagacggtcaccatcgcttgttctgcaagcagctcgaacagtcgggagcaggtggtgtgatgtaggtanacaagaaacgtcccagggaaacccgaccccctaaaagtccgtcaatctaataaacgtgaacgcttaggacgtcggttaacccgttaaggggttcccctaggaccgttaacttcgtcgtcggacggaggtaacggtcgtggccgcctcgacgtcccttcccgtcggaccganaccgaggacggggtacctccgtacggnttaacggaaagtagtggaaggcttagtaactttaagttaacgttggacgactaatccggttaaggagttaacgactaaggtgtacgtaccggggttaccgggtttcggacgggacgggtaaccaaaggtcgtacggtaacctccgtaaagtgaaccgacccggtaacgcccggtccttccccggtacggtacctacgtccttacccggtttcccaaccccgtcccgtaaccgtaccggaagaccgttaacggngacgggtggaccgttgggaancccggagngtaaacgtccgagcgngangacncgnnannn

SEQ ID NO: 226117 - DNA, 634 bp, Homo sapiens
  misc_feature: GYAE6OF02FFWU2.19.86.H09.1.454.CMB.1.raw
  modified_base (321)..(321): a, c, t, g, unknown or other
  misc_feature (321)..(321): n is a, c, g, or t
  modified_base (355)..(355): a, c, t, g, unknown or other
  misc_feature (355)..(355): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctggaggtgaaggagccgtggggcctcagtgaaggtctcctgcgaggtcttttggatacaccttcagtcattatcatatactgtggtgcgacacggccctggacaaggtctgagtggngtaggggcgagtccgacggtggtagtggtggcgnatacgtcgacacgagtaggtttcgacgggccgtcgtcaccgtatcgggaccaagggtccgccgttacccgaacgaacgttaacgagttacgtaagtacgtcgggtaactttcggaacgtcgtaacgtccgtacggggtaacggttccgtacgtaaccggaaccgtaccggggaccctaagttgttaacttagttttcggaggtcccgggtaaggaccgaaggggtaacccgggtacggtaaaccgggtctaacggttaaggttccggtttaaccccggg

SEQ ID NO: 226118 - DNA, 652 bp, Homo sapiens
  misc_feature: GYAE6OF02H3MDA.19.86.H09.1.454.CMB.1.raw
  modified_base (245)..(245): a, c, t, g, unknown or other
  misc_feature (245)..(245): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctgagggtgaaggagccgtggggcctcgagtgaacggtctccgngcggtggtcttttggactactaccttcagttactaattactctaattactacgttcgttcgggtcgaccgaccgacgggtccccgttaggaacgtaggtcgttggacggtggacgtagggcgactccggagggttcggtaggtgggtggcacgacgtcgcacagtagtacgttcgcggccgtcgtacaccgtagtccggacgtaggtaccgtccgtaccgacgtaacgacgtagttagtataggtacgtacgtagacgtcacgtacgtaggtacgttacgtcggaaccgtcggaacggtcctagttagtttacgttagtggtacggtcggagggacggtaacggggaccgggtacgtaaacggtaccgtaaggtttaacgggtcgggttaccccggtaaccccgggg

SEQ ID NO: 226119 - DNA, 549 bp, Homo sapiens
  misc_feature: GYAE6OF02GUXIL.19.86.H09.1.454.CMB.1.raw
  modified_base (471)..(471): a, c, t, g, unknown or other
  misc_feature (471)..(471): n is a, c, g, or t
  modified_base (495)..(495): a, c, t, g, unknown or other
  misc_feature (495)..(495): n is a, c, g, or t
  modified_base (530)..(531): a, c, t, g, unknown or other
  misc_feature (530)..(531): n is a, c, g, or t
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (546)..(549): a, c, t, g, unknown or other
  misc_feature (546)..(549): n is a, c, g, or t
tcagtactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaccggccccaaatcgtcatctataatgacgctgagtcggttaccgttaacgggtccctagaccgtattctacgtggcgagaggtctggcgcctcagcttcctcggccatcaggacgggtcctccagtctagaagtatggacggctgtattattacgtgtgctaatcgtaggatggactaggtgtagtacggttccgggttttcgggcggtacgggacgaagtccgtagaccgtctaagtcacgccacggctccgccctcgctactcgtctcccncctcctccgagcgtacgtcgtcgnggtccggcgtacgggacgacggcgacgtagtacgnntannancgtnagtcnnnn

SEQ ID NO: 226120 - DNA, 727 bp, Homo sapiens
  misc_feature: GYAE6OF02HV34T.19.86.H09.1.454.CMB.1.raw
  modified_base (203)..(203): a, c, t, g, unknown or other
  misc_feature (203)..(203): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggactcctcctcgttggtggcagccacgcccgacggacgccccaccgtcccgaggtcgcgagcgtggtncgagtcgtgggctaggaggtcgaaggacgtccggtcggggccctgaggtacgaacggttcctccgtggcggtaacggttcgttttagggaacttaccgtacccgttttacgacggttacctaagttaccttataacgttattaccgttcggtcgggttacgccgtaaccgccggtaccccgtggaacgtaacggtctaggtaggtaggtagtacgggacgtacgtcggacgggttggtaggtggtggacgcgtacgtacggtcgaccaagtacgtaacggttcggacgggtcccgtccgtaccgaccggtacggtaccggtaacgtaccgggtacgtccgtaaccgaacggtaactacgtaggttaacgtactacggtcggtaacgtgacgtcgacgtacgtaggtaccgtcgtaccggtaacggaccgtcgacgtagtacgttagttcgtacgtcggacggtcggaacggacgggaacggtcgtaacggaccgtaaggtaacgtcgggtacccggtacccggg

SEQ ID NO: 226121 - DNA, 705 bp, Homo sapiens
  misc_feature: GYAE6OF02IV2WC.19.86.H09.1.454.CMB.1.raw
  modified_base (213)..(213): a, c, t, g, unknown or other
  misc_feature (213)..(213): n is a, c, g, or t
  modified_base (293)..(293): a, c, t, g, unknown or other
  misc_feature (293)..(293): n is a, c, g, or t
tcagtactctcgtgcacgaccggtgctcgatttagtgctatagacttgggtttggggagcatcacccagcaaccacatctgtcctctagagaatccctgagagctccgttcctcaccatggactggacctggaggatcctcctcttggtggcagcagccaccggagcccactcccaggtgcagctggtgcagtctggggctggaggtgaaggngccgtggggcctcaggtgaagggtcctcctgcgaggtctttggatactaccttcagtctattatctatatactgtgggtncgacgtacggccccgtggaccgaagggtcgttaggagtaggagtagggcggactaccgcgggttggtacggtgggtggcgctagtacgtcgacgacgtaagtagtttacgacggggtcccgtacgtccgaaccgtagtacgggaccgtaaggtccgcgtaccgaacgtaacgtacgaggttagtaagttagttacgtagtttacggagtacgaccggtcgtacgggtaggttccgttacggaaccgggtaccgaccgggtacccttaagttaggtttaacttttaggtttcgggttacgggtaaccggggaacgggttaccggaacgggggtaaccggggggtaacggttaaacggggaaacggtttaacggtaaaacgggttccgggggttacccgtaaccccccgggggg

SEQ ID NO: 226122 - DNA, 686 bp, Homo sapiens
  misc_feature: GYAE6OF02GFHD1.19.86.H09.1.454.CMB.1.raw
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (679)..(681): a, c, t, g, unknown or other
  misc_feature (679)..(681): n is a, c, g, or t
  modified_base (683)..(684): a, c, t, g, unknown or other
  misc_feature (683)..(684): n is a, c, g, or t
  modified_base (686)..(686): a, c, t, g, unknown or other
  misc_feature (686)..(686): n is a, c, g, or t
tcagtactctcgtgcacgaccggtgctcgatttagtgctatagacgttgggtttggggccgttcctggcccagttctgtgctgactcaggcaccctcagcgtcgtcgggacccccgggcagacggtcaccatcgcttgttctgcaagcagctcgaacatcgggagcagtggtgtgatgtggtatcagaaacgtccagaacggcccccaaatcgtcatctataatgacgctgagcggtaccttaagggtccctgaccgattctcgtggcgagaggtctggcgtcctcagtcctttccctggccctagtccgaggtacgggtcctccgaaggtcctaggaacgtagtggaggtcttaggtaatttacgttaactcggtgactaaagtcgtagggtattacggagtacggtgtacggtaaccgggtttcccggggttttacgggacggggtaacgggaaccgtaacggtaccgttacggtaaccccgttaccgttaaacggttccgaaacccggtacccgtaaacgggtcccgtacccggtccccccgttaggtcccttaaccgttccgttacccgttccccctacccgttcccgttacccgaacggtaccgtaaccgttacgtacggcgggtccggtacggtcggaccgtacggcgtaccgacgtacagtcgngngntcgnnncnngn

SEQ ID NO: 226123 - DNA, 738 bp, Homo sapiens
  misc_feature: GYAE6OF02GMMWB.19.86.H09.1.454.CMB.1.raw
  modified_base (145)..(145): a, c, t, g, unknown or other
  misc_feature (145)..(145): n is a, c, g, or t
  modified_base (721)..(721): a, c, t, g, unknown or other
  misc_feature (721)..(721): n is a, c, g, or t
  modified_base (728)..(728): a, c, t, g, unknown or other
  misc_feature (728)..(728): n is a, c, g, or t
  modified_base (734)..(734): a, c, t, g, unknown or other
  misc_feature (734)..(734): n is a, c, g, or t
  modified_base (736)..(736): a, c, t, g, unknown or other
  misc_feature (736)..(736): n is a, c, g, or t
tcagtactctcgtgcacgaccggtgctcgatttagtgctatagacttgggtttgggggccggttcctgggcccagtctgtgctgactcaggcaccctcagcgtctcgggacccccgggcagacggtcaccatcgcttgtctgcancagctcgaacagtcgggagcagtggtgtgatgtggtatcagaaagtcccaggaccggtaccccaaactcgtcatctataatgacgctgagtccggtaccttaagggtccctggacccgtattcctcgtcggcgaggtacggtcgtggccgtcctacgacgtccttcccgtcggccctacgttacgacggtacgggaccttccccgaagttccgtaggaaacgtagttacggaacgggtcttacggttaactttaacgtttaccgtagttcggtaactaacgtttcgggtagggtatacggtaactagggttaccgttagggggtaaacccggttttccggggttttccgggggaccgggtaacgggtacccggtaaggtacccgtaccggttaaccgggtccccgttaaacgttcccgaaacgtacccggtaaggtcccgtaccgtccccccggttagcccgtaccttccgttaccgtcccccgtacccgtcccgtaaccgtacgacggtaccgttaacgcggacgggtccggccgttacgggaccgaggccgacgtaccgaagtcggctcaccgncgtcgancgtcgngncg

SEQ ID NO: 226124 - DNA, 618 bp, Homo sapiens
  misc_feature: GYAE6OF02JHB7T.19.86.H09.1.454.CMB.1.raw
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (596)..(596): a, c, t, g, unknown or other
  misc_feature (596)..(596): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (613)..(613): a, c, t, g, unknown or other
  misc_feature (613)..(613): n is a, c, g, or t
  modified_base (616)..(616): a, c, t, g, unknown or other
  misc_feature (616)..(616): n is a, c, g, or t
tcagtactctcgtgcacgaccggtgctcgatttagtgctatagacttgggtttgggggtccgttccgtgggcccagtctgtgctgactcaggcaccctcagcgtctcgggacccccgggcagacggtcaccatcgcttgttctgcaagcagctcgaacatcgggagcagtggtgtgatgtgtatcagaagtccaggaccgccccaaatcgtcatctataatgacgctgagcggttaccttaaggtcccctgaccgtattctctggcgagaggtctggncctnacgctttcccnggccatcaggacggctaccngtctcgaaaggntagacggctggtatttattacgtgttgacgtattcggaggacttgacgtaggtgtacggtaacggttccggtttcggggagtacgggacccgaacgctacggtacccgtaccgtaagtcgaccgtaccgaacggccttaccggtcccccgtacggtccttaacccgttcgttcccgttccccacccgtcccttaccgacgttacggacttaccgtaggccggtccggggcctacgggaccgaacgggcccgaacgttaccggaaggccagngtcgctcncgngcgcgngcncg

SEQ ID NO: 226125 - DNA, 725 bp, Homo sapiens
  misc_feature: GYAE6OF02JBUFO.19.86.H09.1.454.CMB.1.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
  modified_base (511)..(511): a, c, t, g, unknown or other
  misc_feature (511)..(511): n is a, c, g, or t
  modified_base (638)..(638): a, c, t, g, unknown or other
  misc_feature (638)..(638): n is a, c, g, or t
tcagtactctcgtgcacgaccggtgctcgatttagtgctatagacttggggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgnggggctggaggtggaaggagccgtggggcctcgagtgtaacggtcctccgtggcgaggtcgttttggataccaccttcagtctatttancgtaatattaccgtcgttggggtcgaccggtacgaaccgggtccccccggtagggtaaccggaaacggggttccgtttagggtaacgggtagggtaagggttacgggggacggtaccgttaccggtacggggttagggtacggggttggggtcggcggacgtacgtaccggttccgactaacggaagttaacgggtttcgacggggtcccgtacgtaccaccgngtcgggaccgtaacgggtccggctaccggaacgtacgtaccgtagttagtacttagtacggtagttacgaggacgacgtaccgtgggtacgttccgtagacgaccgacggtctagtttatacgtttntaggtcgggtacgcgggacggtacggggtaacgggaacgtaaggtaccgttaaggttaacgggttcgggttaccccggtacccgggg

SEQ ID NO: 226126 - DNA, 724 bp, Homo sapiens
  misc_feature: GYAE6OF02FVFFJ.19.86.H09.1.454.CMB.1.raw
  modified_base (375)..(375): a, c, t, g, unknown or other
  misc_feature (375)..(375): n is a, c, g, or t
  modified_base (705)..(705): a, c, t, g, unknown or other
  misc_feature (705)..(705): n is a, c, g, or t
  modified_base (717)..(717): a, c, t, g, unknown or other
  misc_feature (717)..(717): n is a, c, g, or t
  modified_base (720)..(721): a, c, t, g, unknown or other
  misc_feature (720)..(721): n is a, c, g, or t
  modified_base (723)..(724): a, c, t, g, unknown or other
  misc_feature (723)..(724): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaagtccaggaccgccccaaatcgtcatctataatgacgctgagcggtcttaacggtcctagaccgtattctcgtggcgaggagtctcggccgtcctcgacgtcctttcccgtcgggaccctatccgacggacgggtcctccggacgtcgtagaaagtagtggacggtctagtagtttacttacgtggttnacgtaacgtcgttagggtatacggtaactacggttgttaacgggttaaccggggtttcccggggtttttaccggggaccggggtaacgggtaacccgaacggtaccgtttaccggtaacccggttaccgttaaacggttcccgaacggaaccccgtaacggtcccgtacccggtcccccgttaccggtaccttaacccgttcccgttcccggtttccccccgacccgtttccccgtacccgaaccgggacgttaaccggttacgttaccgggaccgggccgggtaccggttaacggaccggtaacggtcccgaagttaccggtaagtcgngacttgctgacncgnncnn

SEQ ID NO: 226127 - DNA, 790 bp, Homo sapiens
  misc_feature: GYAE6OF02HQZO1.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatccctcctcttggtggcagcagccaccggacgcccacctcccaggtgcagctggtgcagtcgtggggctggagggtgaagggacgccgtggggcctcgagtggaaggtcctccgtggcggtaggtcgttttggacttacctaccctttcgagttacatttactactaagtacttacgtcgtgggtcgcggacgacggccccgtaggacgaacgggtcttggaggtggaggtagggcggtactccggtacggtggtaggtgggtcggcggctagtaccggtcgacgtaacgacggttaacggtttccggacggggtcccgtaccgttaccgaacccgtaggtaccgggtaaccgtaacgggttccggtacccggttaccgaaacggtaaacgtacgtaaggttacgtttaagtaggttacggtagtttacggaaggtaccgacgggttaccgtcgggtaacggtttaccgtacgggaacccggtaaccgaaccgggtaacccttaagtttacggttaacgtttttacggttagggtacgggaccggggtaacgggtaccgggaacgggggggtaccggggtaaacggttaaacgggaaccgttaaagggtttaaaccgggtttaccggggttaccccggtaaacccccgggggg

SEQ ID NO: 226128 - DNA, 659 bp, Homo sapiens
  misc_feature: GYAE6OF02GCUE3.19.86.H09.1.454.CMB.1.raw
  modified_base (165)..(165): a, c, t, g, unknown or other
  misc_feature (165)..(165): n is a, c, g, or t
  modified_base (233)..(233): a, c, t, g, unknown or other
  misc_feature (233)..(233): n is a, c, g, or t
  modified_base (376)..(376): a, c, t, g, unknown or other
  misc_feature (376)..(376): n is a, c, g, or t
  modified_base (641)..(641): a, c, t, g, unknown or other
  misc_feature (641)..(641): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (650)..(650): a, c, t, g, unknown or other
  misc_feature (650)..(650): n is a, c, g, or t
  modified_base (652)..(653): a, c, t, g, unknown or other
  misc_feature (652)..(653): n is a, c, g, or t
  modified_base (655)..(657): a, c, t, g, unknown or other
  misc_feature (655)..(657): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacggtcaccatcgcttgttctgcaagcagcctcgaacatcgggancaggtggtgtgatggtggtatcaagaaagtcccaggaaccggcccccaaatcgtcatctataatgacnctgagcgtaccttaagggtccctgaccgtattctcgttggcgaggaggtctaggccgcctcagtccttccctggaccattcagagggctccgagtccgtagaagtactgaggctagtatttaacttactgtgactagttacgngggtaatgaactacggttgtaggtaaccggggtttccgttttcggggaccgggaacggggtaccaagacgtacgggaacccgttacccgtttaaagtacgtaacggtaccgtaaacggccttcccggtaccccccgtttcgggtaccctacccttaccgtttccgttacccccaccccgtttaccctaccgaaccggtacgtaacgttaccgtgggaccgtacggggacctgggtaccgacgggtaccgacgtaacgtcggtaangcgngncgngnntnnnta

SEQ ID NO: 226129 - DNA, 713 bp, Homo sapiens
  misc_feature: GYAE6OF02GMXAL.19.86.H09.1.454.CMB.1.raw
  modified_base (229)..(229): a, c, t, g, unknown or other
  misc_feature (229)..(229): n is a, c, g, or t
  modified_base (682)..(682): a, c, t, g, unknown or other
  misc_feature (682)..(682): n is a, c, g, or t
  modified_base (709)..(709): a, c, t, g, unknown or other
  misc_feature (709)..(709): n is a, c, g, or t
tcagtactctcgtgcacgaccggtgctcgatttagtgctatagacgttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataagtgacgntgagtccggtccttaacgggtccctagaccgtattccgtctggccgagacggttctaggcgtcctcacgtccttcccgtggcccagtcgacggagggcctaccgagtcgtaggaagagtggacggctaggtaacttttaagttaccgtggtacgtacaacttccgtaggggtatacggaacgtaggttacgggtacggtaaaccggggtttccgggttttaccggggaccgggtaaggggtaaccctaaacgggtccggttaaccggtaccccgggtttaccgtaaacgggtaccgtaccggtacccgtaaagggtcccttaccggcccccggttacggtaccgtaaccgttccgttacccgttaccctaccccttcccgtaccaacggtacggaccgttacgtagtaccgggtcgggtcgtacggggaccgacgggtcgacgtacgtaggcncgagtcgagcgtacgtccgagtcgacngtcg

SEQ ID NO: 226130 - DNA, 637 bp, Homo sapiens
  misc_feature: GYAE6OF02I3FVY.19.86.H09.1.454.CMB.1.raw
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
  modified_base (625)..(625): a, c, t, g, unknown or other
  misc_feature (625)..(625): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaccgccccaaatcgtcatctataagtgacgtctgacgcggttccttaagggtcccctgaccgattcncgtgcgagaggtctggcgtctcgagcttcccgtggccatacgaggacggctccgagtctcgaagntgacgctgattattacgtgtcgactatcgtgggactggaactagttaggtacggtaaccgggtttccgggttttacgggacgggtacgggaaccgtacgacgtaccggtaaccgttaccgtaacgtcgaaccggtacccgtaacggtcctcccgggcccccgttggtacccttaccgttcgttacccgtttcccgtccccgtaccttacccgaccggttaagtacgtacgttcggaccggtcgggtaccgtcggaccgtaaggcgtacgtacggtcgtactcgcgcgattcgcggtnacgtctactgac

SEQ ID NO: 226131 - DNA, 796 bp, Homo sapiens
  misc_feature: GYAE6OF02JHPFL.19.86.H09.1.454.CMB.1.raw
  modified_base (108)..(108): a, c, t, g, unknown or other
  misc_feature (108)..(108): n is a, c, g, or t
  modified_base (204)..(204): a, c, t, g, unknown or other
  misc_feature (204)..(204): n is a, c, g, or t
tcagtactctcgtgcacgaccggtgctcgatttagtgctatagacttggggtttgggggagagcatcacccagcaaccacatctgtcctctagagaactcccctgagngctccgttcctcaccatggactggacctgggaggctcctcctcgttgggtgcagcgacgccgaccggacgcccacctccgaggtgccagcgtgggngtaccgtaggtccggttgggggccttagggacgggtagggaaacgggtcggtcccgggtcgggggtccctacggtagggtcggaacggggttcctacccggtgggtaccgggtacggttaccgttttggaaaccttacctaccgttctagtcctaagttcactaataacgttcgtcggtgggtcgaccgtacgaccggtcccgtacggaaccgtaggtacgtggtaggtagggtacggtacggggacggtactacccggggtaggttggggtacggtggggtcggacgttgaacgttaccggcgaacgtacgggtaacgggttacgtccgggacgggttacccgtccgtaccgaccgtacgggtaccggtaccgtaagggtccggtaccgacccggtaaagtacgtacggtaaggttcgtaaagtaacggtcggtactgggacgtaacggtacggacgtacgggtaccgtcgttaaccgggacgttacggtaccgtacttacggtctttaacgttagggtcggttaaggacgtacgggtacgtaagggaccgggtaagtaccggagttaacggtacggtaccgtaacccggg

SEQ ID NO: 226132 - DNA, 660 bp, Homo sapiens
  misc_feature: GYAE6OF02JCTRX.19.86.H09.1.454.CMB.1.raw
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
tcagtactctcgtgcacgaccggtgctcgattagtgctatagacttgggtttgggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacaggccctggacaagggcttgagtggatagggcgatccgacggtggtagtggtggcgcatacgtcgcacagaagtttcaggggccgcgtcaccatggccaaggtcgcgtccagaatacagtgtatntggacttgancagcctgagtctgacgacacggcatgtaacttattggtgacgagggcgagggaccggggactaaagggctaagtaaacggttgggttaccgaccccggtcggggacccgaacggggtaacccttgggtaccgtaccggtcctacccgtccgacgcccgtacccgaaccgtaacgggacccgtacgttccggggttacccttcccccggtacggtcccggtccccttcggtacccgttacccggaacgggtaccgacccgtaacccgttccccggaaggtaccggtaccctaaccggtacggcccgggttaccccgtggggtaacccg

SEQ ID NO: 226133 - DNA, 671 bp, Homo sapiens
  misc_feature: GYAE6OF02FG2MX.19.86.H09.1.454.CMB.1.raw
  modified_base (97)..(97): a, c, t, g, unknown or other
  misc_feature (97)..(97): n is a, c, g, or t
  modified_base (117)..(117): a, c, t, g, unknown or other
  misc_feature (117)..(117): n is a, c, g, or t
  modified_base (163)..(163): a, c, t, g, unknown or other
  misc_feature (163)..(163): n is a, c, g, or t
  modified_base (231)..(231): a, c, t, g, unknown or other
  misc_feature (231)..(231): n is a, c, g, or t
  modified_base (291)..(291): a, c, t, g, unknown or other
  misc_feature (291)..(291): n is a, c, g, or t
  modified_base (649)..(649): a, c, t, g, unknown or other
  misc_feature (649)..(649): n is a, c, g, or t
  modified_base (655)..(655): a, c, t, g, unknown or other
  misc_feature (655)..(655): n is a, c, g, or t
  modified_base (658)..(658): a, c, t, g, unknown or other
  misc_feature (658)..(658): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(667): a, c, t, g, unknown or other
  misc_feature (666)..(667): n is a, c, g, or t
  modified_base (669)..(671): a, c, t, g, unknown or other
  misc_feature (669)..(671): n is a, c, g, or t
tcagtactctcgtgcacgaccggtgctcgatttagtgctatagacttgggtttgggggccgttcctgggcccagtctgtgctgactcaggcaccctnagcgtctgggacccccgggnagacggtcaccatcgcttgttctgcaagcagctcgaacatcgggancaggtggtgtgatgtggtatcagaaacgtcccaggaaccgcccccaaatcgtcatctataacgtgacnctggacgtccggttaccgttaagggtcccctaggacccgtatttccgtcgtcggcgaagnggtccgtggccgtccttcacgtccttccccgtggcccagtccgagtcgggcctaccgtagtccgtaggaacgtagtcggaggcctaggttaatttacttacgttgtcgactaagtcggtaggtatacgtacgtggttacggtacggttaaccgggtttccgggtttaccggggacgggtacgggaaccgaacggtccgtaacggtaccccgtaaccgttaacggtccgaaccggacccgtaacgggtcctacccgtccccggttacgtcctacgttcccgtccgttcccctaccttaccctaccgacgtacgtaacgtcgtacggcggtaccggacgtcggacgacgcgacgtacgtncgtacngcncgtncncnncnnn

SEQ ID NO: 226134 - DNA, 468 bp, Homo sapiens
  misc_feature: GYAE6OF02FTZIK.19.86.H09.1.454.CMB.1.raw
  modified_base (447)..(468): a, c, t, g, unknown or other
  misc_feature (447)..(468): n is a, c, g, or t
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaaggcataaagtggttccgaccccgtggggccagggaaccctggtccaccgtctcctcagcctcccaccgaacgggccccagtccggtccttcccccgtggccgccctgcctccgaggcgccaccgtccgagacgcacacggccggccctgggctgccgtggtcaacggtctacctcccgaagagacgtactgacgcgggctggcgaacggcactagtagnnnnnnnnnnnnnnnnnnnnnn

SEQ ID NO: 226135 - DNA, 862 bp, Homo sapiens
  misc_feature: GYAE6OF02JAJ35.19.86.H09.1.454.CMB.1.raw
  modified_base (263)..(263): a, c, t, g, unknown or other
  misc_feature (263)..(263): n is a, c, g, or t
tcagtactctcgtgcacgaccggtgctcgatttagtgctatagacttgggtttggggagcatcacccagcaaccacatctgtcctctagagaatcccctgagagctccgttcctcaccagtggactggacctggaggactcctcctcgttggtcggcagcacgcccgaccggacgcccacctcccaggtcgcagcgtggtgcagtcgtgggctgaggtagaaggcgtccggtgggcctacgtaggtacggaacggttctccgnggacggtacgttacgttttcggacttaaccgtaccgttacgtacgtactacttacgtacgacttaacgttccgtcggttacgggttacggaccggtacccggtaccggtaccccggtagggtaaaccggtaaccggggttaccgttagggaacgggtaggggtaacggtcggggtaaccggtaccgttaccgggtacggggttgggtaacggggtcgggttcgggaccggttacggtaaccggttcggtaccgaccgtaacggtaggtttaacggttcggaccgggtcccgtacgtaccgtacccgtaaggttacccgggtaaccgggtaacggtccccggtaccggttaaccgtaaaccgggttaacttaaaccgggttacggttaaggtttaacgtacggtttaacggttaacgttacgggaccgtacggtacgtaccgttagggtaacgttcggaaccgtaccgaccggtaccgtgttacgtacgttacgttttaggtcggttacgggacggtaccgggtaggaacggggaaccggggttacgtaacgggtacggttaaaggttaccgggttaccgggttacccggaaccccgggg

SEQ ID NO: 226136 - DNA, 899 bp, Homo sapiens
  misc_feature: GYAE6OF02IAYC1.19.86.H09.1.454.CMB.1.raw
tcagtactctcgtgcacgaccggtgctcgatttagtgctatagacttgggtttgggggagagcatcaccagcaaccacatctgtcctctagagaatccctgagagctccgttcctccaccatggactggacctggaggatcctcctctggtgcgagcgacgccaccggtacgcccacctcccgaggtcgcacgtcgtcggtcgccagtccgtcgggggtctggacggtggaacggtacgccgtcggggcctcgtacggtacggtaaacggttccgtccgtcggaccggtaacgggtttcgtttttacgggggaactttaccgtaaaccccgttttcgtaaacggttccgttaattttaaccgttacctaaggttaaacttacccgtttcgggttacggggttcggtaacccggtaccgtaaccggggtcccccggttaggtaaccggtaaacggggtccgtttacgggtaacgggttaggggtaaccggtacgggggttaccgggaacctttacccggggtaacgggttacgggtacgggttttcggggacgggtccggtacgtaaccggttaccgttacccggacgttaaaccggtacgggttaaacggttttacccgggacggggtaaccccgggtccgtacccgtaaccggtacggtccggggttaacccgaacggggtttaccggaccgggtaccctaacggtaaacgttaccggtaagggttccgtaaagttacgggttacgttacgttacgggacgtaccgagtcccgtaggtaaccggtcgttaacgaccgacgtaccgggactacggtttagtaacgtttacgtcggtaaggtccgagggtacgacgggtacggaacgtaacggtacgtaaggtacgttcggtaacccggg

SEQ ID NO: 226137 - DNA, 695 bp, Homo sapiens
  misc_feature: GYAE6OF02HQ65V.19.86.H09.1.454.CMB.1.raw
  modified_base (178)..(178): a, c, t, g, unknown or other
  misc_feature (178)..(178): n is a, c, g, or t
tcagtactctcgtgcacgaccggtgctcgattagtgctatagacttgggtttggggggaaggagggaaggacgtgacggtcccactcccaggtgcagctggtgcagtctggggctggaggtgaaggagccgtggggcctcgagtgaaggtctcctgcgaggcttttggatacaccttnagtcattatcatatactctgggtgcgacgacggtcccctaggacgaaggggtcttggaggtggagtagggcggatcgacggtggtagtggtggcgacgatcgtgcaacgaggtaagtttcgagggccgcgtcacgtagtggaccgaaggtcgacgtccgaacgaacgttacgacgtgtaactagtggaactttgggacgtcgacgtcctggacggtctacggagtaaccgcgggacctagttcgtaattttagtggtcgacggacggtcgagggacggggacgttaaacggacgaagtaaacggttagggttacggtacccggtacggggacccgtagggaacccgttggtacccgtaccggtacgtccgtaccgacgtacccgtacccgtaccgaaccggacccgtaacgttaccggtccccgttacccgtccggtcccgacccgtccgccgtaccgccggtacgacctcccgtaccgacgacggccgacgacggacccggtccggtacggtccgg

SEQ ID NO: 226138 - DNA, 659 bp, Homo sapiens
  misc_feature: GYAE6OF02IQOW5.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccgaccggacgcccacctcccaggtgcagcgtggtgcagtcgtggggctggaggtgaaggacgccgtggggcctcaggtgaacggtctccgtggcgaggttcttttggactactaccttcagtctattatctaattactactcggttgggtcgcgacgtacggtccccgtaggaacgtagggtcttaggtaggtaggaagtggggacgtacgtaccgtacgggtggtaggtgggtcggcgactagtacggtcgacacgtaagtacggttcggacgggaccgtcgtaccgaccgtacgtcggaccgtagggtccgtccgtaccaacgtatacgtaggttactaagtacgtggtacttgacgacgacggtcgtgtacggtcgacggaccgacggacgtactagttagttactttagtaggtcggacggtacggacggtaaggggaaccggtacgtaaacgggtactaaacggttaacggttaccgggttacccggaacccggg

SEQ ID NO: 226139 - DNA, 710 bp, Homo sapiens
  misc_feature: GYAE6OF02H95R9.19.86.H09.1.454.CMB.1.raw
  modified_base (226)..(226): a, c, t, g, unknown or other
  misc_feature (226)..(226): n is a, c, g, or t
  modified_base (358)..(358): a, c, t, g, unknown or other
  misc_feature (358)..(358): n is a, c, g, or t
tcagtactctcgtgcacgaccggtgctcgatttagtgctatagacttgggtttggggagcatcacccagcaaccacatctgtcctctagagaactcccctgagagctccgttcctcaccatggactggacctggaggctcctcctcgttgggtggcagcagccgaccggacgcccacctcccgaggtcgcagcgtcggtgcaggtcgtggggctagaggtgaaggngcgtgggcctgagtgacgtctccgtgccggtagtcgtttggacttaccacctttcgtagtacattactcctagttactctcggtggtacgccgacacggtcccgtagaccggtaggtcctggtagtacgggngtacgggccgtactccgggaggttggaggttgggtcggcgtacgtacgtcggtaccgactacggtaaggttaaccgttcggaccgggtcccgacgtaccgtaacgtcgtaccgggtaaccgtaacccgggtccggtaccgtaaccggtaaaccggtagttaaacccgggtgttaacgggttacgttaacggtcggtaccggtttagaacggtcgaccggttccgagggtacgtacgtcgaacgtaccgacggtacctacgttacgttagtcgtttggacggaccggtggaccggttacggggcgggtaacgttaaggacttaaggtaaccggtccggtacccggtaccgggg

SEQ ID NO: 226140 - DNA, 636 bp, Homo sapiens
  misc_feature: GYAE6OF02JDORN.19.86.H09.1.454.CMB.1.raw
  modified_base (185)..(185): a, c, t, g, unknown or other
  misc_feature (185)..(185): n is a, c, g, or t
  modified_base (221)..(221): a, c, t, g, unknown or other
  misc_feature (221)..(221): n is a, c, g, or t
  modified_base (493)..(493): a, c, t, g, unknown or other
  misc_feature (493)..(493): n is a, c, g, or t
tcagtactctcgtgcacgaccggtgctcgatttagtgctatagacttgggtttggggagcatcacccagcaaccacatctgtcctctagagaactcccctgacgagctccgttcctcaccatggactcggacctggaggactcctcctcgttggtcggcagcagccacggagcccactccaggtncagctggtgcagtcgtgggcctggacggtgaacggnccgtggggcctcgagtggacggtctccgtgcgaggtccgttttggataccgtccttcgagtctacttatctaacttctacgtcgtggtcgacgactcggccctaggacgtacggtcttaggcgtacggagtcgggcgagtccggacggtggtagtcgggtgacgcgtagtcgcgtcagtaagagttcgacgggtccgtcgtacacgagtcggacaggtccgtacgtccaacgtagtaccgagttagacgtagtacggtcctagaacggtacncgggttactcggggagttccggtagtaaccggcgtaacccggtctaacgttcggttattaggtcggttacggcggtaacggaccggtagggtaaccggtacggaacggtacgtaaggttaccggtacggtttccggacccggg

SEQ ID NO: 226141 - DNA, 889 bp, Homo sapiens
  misc_feature: GYAE6OF02FSKYF.19.86.H09.1.454.CMB.1.raw
  modified_base (162)..(162): a, c, t, g, unknown or other
  misc_feature (162)..(162): n is a, c, g, or t
  modified_base (874)..(874): a, c, t, g, unknown or other
  misc_feature (874)..(874): n is a, c, g, or t
  modified_base (880)..(880): a, c, t, g, unknown or other
  misc_feature (880)..(880): n is a, c, g, or t
  modified_base (884)..(884): a, c, t, g, unknown or other
  misc_feature (884)..(884): n is a, c, g, or t
  modified_base (886)..(886): a, c, t, g, unknown or other
  misc_feature (886)..(886): n is a, c, g, or t
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgttctgcaagcagctcgaacatcgggancagtggtgtgatgtggtatcagaaagtccaggaaccggcccccaaatcgcatactataactgacgctagagtccggttaccgttaacgggtccctgtaccgatttccgtcgtggcgaggtacggtcgtgggccgtcctcgagtccctttcccgtcggtacccagttaccgagggaacgggtcccttacccgtacggtttaccgtaggaaaaccgtagttggaacgggttaccgttaggtaaacctttttaagttaacccttggggttaccgtaacgttaaacgtttccggttagggggtaacgtttggaaaccgttagggttaagggtttaaccgggggttaaacccgggggtttttccccgggggttttttaccggggaaccggggggtaacccgggggtaaaaccccgtaacgggttaacccgttacccggggtaaacccccgggttttaccggtaaaaccgtttccggaaacccgggttaacccccggtaaaacgggtcccggttaaccccccggttcccccgggtttaacccggggttacccctttaacccggtttccgtttccccggttacccccgtacccccggttaccccgtacccggaaaccgttaacgggttaacccgttaacgtaacgggtccggggtaccgggttaccggtccgggaacccggtaagggggtcctcccgtaaggtacgtccgagtacgcgnactcgngtcntngcg

SEQ ID NO: 226142 - DNA, 651 bp, Homo sapiens
  misc_feature: GYAE6OF02GHR6L.19.86.H09.1.454.CMB.1.raw
  modified_base (216)..(216): a, c, t, g, unknown or other
  misc_feature (216)..(216): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtggggctggaggtgaagggngccgtggggcctcgagtgaaggtcctccgtggcgtaggtcttttggataccaccttcagttcattatcatatactcgtggtgcgacacggccccgtaggacgaaggtctaggaggtcggagtacgggcggtactccgacggttggtagtggtcggcgacagtcgtcgacacgagtacgttcgacgggtccgcgtacaccgagtcggaccgaacggtccgacgtaccaagaactacgagttacgtagtagtggtacttggacgcgacgtccgttaggaacggttcgtacggtaaccgaccgtaccggacctaagttaccggtttatttacgttacggtacggtaccggaggaaccgggtacggggaaccgggggttaacgtaaacgggtacgtaaaggtttaaaccgggttaccgggttacccgtaaccccggggg

SEQ ID NO: 226143 - DNA, 581 bp, Homo sapiens
  misc_feature: GYAE6OF02FTLO6.19.86.H09.1.454.CMB.1.raw
  modified_base (400)..(400): a, c, t, g, unknown or other
  misc_feature (400)..(400): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
  modified_base (530)..(530): a, c, t, g, unknown or other
  misc_feature (530)..(530): n is a, c, g, or t
  modified_base (556)..(556): a, c, t, g, unknown or other
  misc_feature (556)..(556): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagcccaccggagcccactcccaggtgcagctggtgcagtcgtggggctggagggtgaagggagtccgtggggccctcgagttggaaggttctccgtgccggaggtcgttttggattacaccctttcgagtcatttactactattactacgtcgttggggtcgccgtacgacggtccccgtggaacgagggtcttggagtgggagtaggggcgtacgtccgaggttaggtagtgggtggcgntacgtacgtcgcacgagtagtttcgagggcgcgtcaccgagtcgaccgaggtcgccgtcaacgagtacagtntatagngactgngcngcgtgtagtctgaacacgcgcagttgtagtgttgtagtacggnggtacgacgggacggtacgtaaaggntaacggttaaggttcggtacccggg

SEQ ID NO: 226144 - DNA, 840 bp, Homo sapiens
  misc_feature: GYAE6OF02IVWQ8.19.86.H09.1.454.CMB.1.raw
tcagtactctcgtgcacgaccggtgctcgatttagtgctatagacttgggtttggggggaagaggaagactgacggtcccactcccaggtgcagctggtgcagtctggggctgaggtgaaggagcctggggcctcagtgaaggtctcctgcgaggtcttttggatacaccttcagtcatttatcatatactctgggtgcgacacggcccctggaacagggtcttgagtggagtagggcggactccgacgggtaggtagtggagtggcgactaagttaccggtcgacgacgacggtaacgttttcggaccgggggcccgtcggtcctaaccgacgttccgggaacccgtaaggggttcccgaccggttacccgaaccggtaaacgtaaccgtacggtttagtaaagttacggttacggtaccgtttaggacgtcgtaaccgtccggttaggacggttcttacggaaccggtacgaccgggtacctaagttacgttaagttttaagttggtacggacggtagggacggtaacggggtacggggtaacgtaaacggacgtaaaggttaaacgggttcggttaacccggtaccccgggtacgggggtaacccgaacggggtaaccccgttcgggtacccgtaacccggttacccgtacctaccggaccgtaccccgttaccgaaaccggtaccgggtaccctaacggttccccggttaccccgttttcccggccgggttacccctccccggttaccgtacccgtacccgggacgggtacccgtaacccgtacccggtacggtacgacccggtaccgaaccggtccggcccggtacccgtccggg

SEQ ID NO: 226145 - DNA, 611 bp, Homo sapiens
  misc_feature: GYAE6OF02I0RW4.19.86.H09.1.454.CMB.1.raw
  modified_base (164)..(164): a, c, t, g, unknown or other
  misc_feature (164)..(164): n is a, c, g, or t
  modified_base (213)..(213): a, c, t, g, unknown or other
  misc_feature (213)..(213): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (604)..(605): a, c, t, g, unknown or other
  misc_feature (604)..(605): n is a, c, g, or t
  modified_base (609)..(610): a, c, t, g, unknown or other
  misc_feature (609)..(610): n is a, c, g, or t
tcagtactctcgtgcacgaccggtgctcgatttagtgctatagacttgggtttgggggccgttcctgggcccagtctgtgctgactcaggcacccttcagcgtctgggaccccgggcagacggtcaccatcgcttgttctgcaagctagctcgaacatcgggancagtggtgtgatgtggtatcagaaagtccaggaacggccccaaatcgtnatctataatgacgctgagcggttaccttaagggtccctgaccgtattctctggcgagaggtctacggcgctcacgcttccctggccatcgacgagggtcctccagtctaggaagtatggacggtcgtgtaatttatacgtgtagtaccaagtcgtagggattcgaacgtgtggtacgtaacgggtttccgggtttacggacgggtacggtaaccgtaacgcgtacggaccgttaccgtaagtccgacgacccgaaggtcccgtcgtacccccgttggtaccctacttaccgttcgttcccctacccgtccctaccgaccgtacggtacgtacgtcggacgcggacggtcggacgtacggcgtcgaacgtcggcaganggtanacgtctagnngtcnng

SEQ ID NO: 226146 - DNA, 703 bp, Homo sapiens
  misc_feature: GYAE6OF02H50CM.19.86.H09.1.454.CMB.1.raw
  modified_base (605)..(605): a, c, t, g, unknown or other
  misc_feature (605)..(605): n is a, c, g, or t
  modified_base (614)..(614): a, c, t, g, unknown or other
  misc_feature (614)..(614): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatccctcctcttggtggcagcacgcccaccggacgcccactcccaggtgcagctggtgctagtcgtggggctggaggtagaaggacgtccggtggggcctcgaggtggaacggttcctaccgtggccggaggtttccttttaggacttaccacccgtttactacgttctaattacttacaatttaacgtacttcggtacgggtcgaccggtacgacccgggtccccgtaggaaccggtaaggtccgttagagggtacggagtacgggaccggcttaccggagggttggtaacgtggggtgggaccgtcgtataccggtacgctaacgagtaacggtttcgcgggtcccgtcgtcaaccacggtcggacgtaacggtcgccgtaccgacgtaactcgaagtgttaatacgtagtacgttgacgacgtcaccgtgaccggttcgacggtaccaccgaccggtctaacgttntaacgtttntggtcggaacggacgggtacggaacgggtaccgggtaacggtaacggacgttaaacggtaacggttacgggtacccggtaaccccgggg

SEQ ID NO: 226147 - DNA, 662 bp, Homo sapiens
  misc_feature: GYAE6OF02JI2WN.19.86.H09.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtcgtgggctggaggtgaaggcgccgtgggcctcgagtgaggtctccgngcgaggttctttggactacgtaccttcagtctattactctattactacttcgtggggtcgacgacgccggtcccgtaggaacgtaacgggtcttaggaggtaggagtacggggcgtagtaccggtacgggttagggtacggtagggtcggaccgacgtaacgtacgtccgacaacgtaggtaacgtttcgacgggtcccgcgtaccacgagtaccggacgtaacggtccgaccgtaccgaaacgtaactacggtagtgtaacgtagtacggtctaggacgcgtacgccgtaggtacggtcgtacgacgaccgaccggctaagttcgttaagtttagtcgggtacgacgggacggaccgggtaaggggacggggtaactaaacgggacgttaacggttaagggtttacggtaccccggg

SEQ ID NO: 226148 - DNA, 595 bp, Homo sapiens
  misc_feature: GYAE6OF02GWZ9K.19.86.H09.1.454.CMB.1.raw
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (358)..(358): a, c, t, g, unknown or other
  misc_feature (358)..(358): n is a, c, g, or t
  modified_base (549)..(549): a, c, t, g, unknown or other
  misc_feature (549)..(549): n is a, c, g, or t
  modified_base (560)..(560): a, c, t, g, unknown or other
  misc_feature (560)..(560): n is a, c, g, or t
  modified_base (575)..(575): a, c, t, g, unknown or other
  misc_feature (575)..(575): n is a, c, g, or t
  modified_base (586)..(586): a, c, t, g, unknown or other
  misc_feature (586)..(586): n is a, c, g, or t
  modified_base (589)..(594): a, c, t, g, unknown or other
  misc_feature (589)..(594): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcagtctataatgacgctgagcggtcttaagggtccctagaccgtattcctcgtggcgagaggtctggcncctcacgccttccgngcctagtacgaggcggcctcgagtctagaagtntggacggactagtattattacgtgtancgtaactcggagggtattacggaacgtaggtaggtacggtaacgggttttccgggttacgggacgggtaacggacgtaacgtcgtacggacccgtactaacgtcacggtacccgaagtcccgcgtccccggttgacctactcgtccctccctaccctcgtacccacgacgtacgtacgtgaccggcggtcncgggtaaccgnggaccgactaggacncgtcagtgacngcnnnnnnc

SEQ ID NO: 226149 - DNA, 660 bp, Homo sapiens
  misc_feature: GYAE6OF02FHE1I.19.86.H09.1.454.CMB.1.raw
  modified_base (298)..(298): a, c, t, g, unknown or other
  misc_feature (298)..(298): n is a, c, g, or t
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
  modified_base (659)..(660): a, c, t, g, unknown or other
  misc_feature (659)..(660): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgtctgcaagcagctcgaacatcgggagcaggtggtgtgatgtaggtatcagaaagtcccgaggaaccggcccccaaatccgtcatacgtataatcgaccgcgtagacggccggttccttaacgggtcccctgacccgtattcctcgtgcgagaggtctggccncctcgagtccttcccgtggccctagtcaacggcgggctaccgagttcgtacgaagactggaagtccgtagtaactttattacgttgtgactaagtcgtagggtactaggacgtaggttacggtacggtaccggggtttcccgggttttcgggacgggaacgggaaccgaacggtctacggtaccgtaccgtaagtccgacgtcccgtaagggccctacccggccccttcggtccctacgttccgttcccttcccccgtacccttccgtaccgaacgtacggtaaccgttcgtacgacgggtaccggcgtacgggacgtaacgggtcaccgtacgaaggccagtacgnagcacgcntcgtann

SEQ ID NO: 226150 - DNA, 531 bp, Homo sapiens
  misc_feature: GYAE6OF02I5MFC.19.86.H09.1.454.CMB.1.raw
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
  modified_base (517)..(519): a, c, t, g, unknown or other
  misc_feature (517)..(519): n is a, c, g, or t
  modified_base (521)..(531): a, c, t, g, unknown or other
  misc_feature (521)..(531): n is a, c, g, or t
tcagtactctcgtgcacgaccggtgctcgatttagtgctatagacttgggtttgggggccgttcctgggcccagtctgtactgactcaggcacccctcagcgtctgggacccccgggcagacggtcaccatcgcttgttctgcaagcagctcgaacatcgggagcagtggtgtgatgtggtatcagaaagtcccaggacggcccccaaatcgtcatctataatgacgctgagcggtccttaagggtcccctagaccgattctctggcgngaggtctggcgcctcagcttcccnggccatcagagggctccagtctgaacgatgaggctgatttatactgtgcaactctgggactgactagtcggtagaacggttccggtttacgggcggagggacctacggctacgaccgttcctaagtcgacgccaacggctacgtccccncggtccgtactccgttgttccccnccctccctccncgacgagtactgagcgggtctacggcgaagcgcagtacgnnngnnnnnnnnnnn

SEQ ID NO: 226151 - DNA, 601 bp, Homo sapiens
  misc_feature: GYAE6OF02FY1R8.19.86.H09.1.454.CMB.1.raw
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
tcagtactctcgtgcacgaccggtgctcgatttagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactcgtgggtgcgacaggcccctggacaagggcttgagtggatagggcggatccgacggttggtaggtggtggcgacatacgtcgcacagtaagttcaggccgcgtcacatggccaaggtcgcgtccacgaatacagtgtatagtggacgttgacgtacagccgtggagtctaggaccgacacggctatagtttattattggtacgacgtaggacgtacgggacgggtacgtaaacggactaagttaaaggtcggttacccgacccggtcgggacccgtacgggtaccctggtcacccgtctccncgcnccgtccacgacgcctacgtcgttccctcccggtcgtcccgcccgtcgcctacggacgcgacctacccgacgacgacgtaccacgaccggcccggccgtacggtccg

SEQ ID NO: 226152 - DNA, 769 bp, Homo sapiens
  misc_feature: GYAE6OF02I7KED.19.86.H09.1.454.CMB.1.raw
tcagtactctcgtgcacgaccggtgctcgattagtgctatagacttgggtttgggggaagaggaagactgacggtcccactcccaggtgcagctggtgcagtctggggctgaggtgaaggagccgtggggcctcagtgaaggtctcctggcgaggtcttttggatacaccttcgatcattatcatatactcgtgggtcgacgacgacggccccgtaggaccgaaagggtctttaggagtggacgtagggcgatccgaggtggtaggtggcggcgctaagtacgtcgcacgagtagttcgaggccgaccgtcaccgagtcggcctaacgggtcgacgtacccgaagaactacgacgttgtaacttagtacggtaacgttggactaccgagtccgttaggaacgtcgtacggacgaccgtaggcctaagttacgtaattacttcggacggacgtacggacgtacggggaccgggtaactaaacggaccgtaaagttaaaggttccgggttaacccggtacccccgtacgggggtacccgaacggggtaacccgtcggtaccgacccggttccctacccgtacgtaccggtcccgttaacccgaacccgggttaaaccggcccctaacgggtttccccgggtaacccttttccccccggcgtaacccccttacccgtccgtaaccgtaaccggacgtaccctaaccggttccgggaccgggtacgaacccggttacggcccggtaccccggttcggaccgttcgtaccccgg

SEQ ID NO: 226153 - DNA, 712 bp, Homo sapiens
  misc_feature: GYAE6OF02GQNWX.19.86.H09.1.454.CMB.1.raw
  modified_base (118)..(118): a, c, t, g, unknown or other
  misc_feature (118)..(118): n is a, c, g, or t
  modified_base (141)..(141): a, c, t, g, unknown or other
  misc_feature (141)..(141): n is a, c, g, or t
  modified_base (450)..(450): a, c, t, g, unknown or other
  misc_feature (450)..(450): n is a, c, g, or t
  modified_base (689)..(689): a, c, t, g, unknown or other
  misc_feature (689)..(689): n is a, c, g, or t
  modified_base (692)..(692): a, c, t, g, unknown or other
  misc_feature (692)..(692): n is a, c, g, or t
  modified_base (698)..(700): a, c, t, g, unknown or other
  misc_feature (698)..(700): n is a, c, g, or t
  modified_base (702)..(703): a, c, t, g, unknown or other
  misc_feature (702)..(703): n is a, c, g, or t
  modified_base (707)..(707): a, c, t, g, unknown or other
  misc_feature (707)..(707): n is a, c, g, or t
  modified_base (709)..(711): a, c, t, g, unknown or other
  misc_feature (709)..(711): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttcngcaagcagctcgaacagtcgggagcaggtggtgtgatggtggtatcgaagaaacgtcccgaaggaacccgacccccaaactcgtctatactaataagtgaccgcgtaggacgtccgggttaccgtttaaacggggtcccctaggaacccgttatttcctcggtggacggtaggacgggttcgtcgggcccgtacctcgacgttccttccccggtcggcccacgtcgaacgggaaccggggttcccttaccggtagttaccggtaggaaagttcggtaggtacggtcgttagtaatttaacgtttacggnggttacgacttacgttggtaacgggtactagtaaccggtgggttacggttacgggttaacccgggttttccgggttacgggacgggacgtagaacgtcgtacgtaccgtacgtacgtacgaccgtacgacgtcctcccgcccgttacgtctaccgttccgtcccgtccctccgttacctacggaccgtaggtacgtacggtcggacggccgggtgacggaccgtacggacgtagtacgngtnacgtcnnngnngacncnnnc

SEQ ID NO: 226154 - DNA, 668 bp, Homo sapiens
  misc_feature: GYAE6OF02IUQXF.19.86.H09.1.454.CMB.1.raw
  modified_base (163)..(163): a, c, t, g, unknown or other
  misc_feature (163)..(163): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtccaggaacgcccccaaatcgtcatctataatgacgctgacgcggttaccttaagggtccctagaccgtattctcgtggcgagaggtctggcgcctcagtcttccctggcctatcgaggacggctccagtctgaagatgagtctagtattattactgtgacaatcgtggatgacgtagttggtaggtaaccgggtttccggttttacgggacgggtacgggaacctaacggaccttacggaccgttaaccgttaacgtaccgaacgacccgtaagggtccctaccggtcccccgttacggttaccctaccgttaccgttccccgtttaccccctaccccgtttaccccgtacccgaacccggtaaggtaaccgttaccgtacgggtaccgggtaccgggtaccgtagggacccgtaacgggaccgtaaccgtaacggttaacggcgactagaccgtaggacacgtacgcaacgtgacta

SEQ ID NO: 226155 - DNA, 750 bp, Homo sapiens
  misc_feature: GYAE6OF02IQICW.19.86.H09.1.454.CMB.1.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
tcagtactctcgtgcacgaccggtgctcgatttagtgctatagacttggggtttgggggagagcatcacccagcaaccacatctgtcctctagagaactcccctgagagctccgttcctcaccatggactggacctggaggatcctcctctggtggcagcagccaccggacgcccacctcccgaggtgcagctggngcagtcgnggggtctggaggtagaagggacgccggtcggggtcctcggaaggtaggaacggtcctacgtcggacgtaggtcgttttagggaactaacctaccttacgagtacctaatttaactacgtaacttacttaaccgtcggtagggtacggaccgtaacggaaccggtccccggtacgggaacgaacgggtcgtttacggaggtacgggaacggttacggggcggtactaccggtaacgggtgggtaagggtcgggttcggacgtcgtaacgtacggtacgtaccgtaagaaggttaacgtttacgggacgggtccggtaccgtacgaaccgtaggtaccggtaccgggaacggttccggtacggtaacccgaagtaaacgaacgttaacggttagttaacgtaacgtaggtacgtaggaacgtacggaccgtacgtagtacggtactaacgaaccggacaccgtacgtagtagttattacggtgtaacggtggaacggccggtaagggacgggtaagaaaccggaataagttaacgggtctacccgggg

SEQ ID NO: 226156 - DNA, 647 bp, Homo sapiens
  misc_feature: GYAE6OF02HAHI9.19.86.H09.1.454.CMB.1.raw
  modified_base (236)..(236): a, c, t, g, unknown or other
  misc_feature (236)..(236): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
  modified_base (638)..(639): a, c, t, g, unknown or other
  misc_feature (638)..(639): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcgaagaaacgtcccgaaggaaccggcccccaaatcgtcattctataatgacgntgaggtcggttaccttaacgggtccctgaccgtattcgtcgtggcgaagtggtcgtggccgtacctcgacgcctttccccgtggaccctatccgaagggacggtcctccaggtccttaggaacgagtggacggtcttaggttaattacgttaacgtggtacgtactaacgttcggtaggaattggactacggttagtaccggtaaacgggtttccgggtttcgggacgggacggtaaccacgtcgtacgtaccgtacgtaagccgtaacgcccgagtaccgtcccgtccccgttcggtacctactcgttcccgtaccctacccgtcctaccgacgtacgtacgtacgtcggacgacgggtcacggagaccggacgtcgtaaagtccgagcgtacgntagncnngngntntn

SEQ ID NO: 226157 - DNA, 698 bp, Homo sapiens
  misc_feature: GYAE6OF02GUADI.19.86.H09.1.454.CMB.1.raw
  modified_base (311)..(311): a, c, t, g, unknown or other
  misc_feature (311)..(311): n is a, c, g, or t
  modified_base (404)..(404): a, c, t, g, unknown or other
  misc_feature (404)..(404): n is a, c, g, or t
  modified_base (442)..(442): a, c, t, g, unknown or other
  misc_feature (442)..(442): n is a, c, g, or t
tcagtactctcgtgcacgaccggtgctcgatttagtgctatagacttggggtttggggagcatcacccagcaaccacatctgtcctctagagaatcccctgagagctccgttcctcaccatggactgacgtggaggatcctcctcttggtggcagcagccaccggagccactcccaggtcgcagctggtgcagtcgtgggctggaggtgaaggagccgtcggggacctcgaggtacgtaacgggtccttaccgtcggacgtacgggtctttttcgggaacttaccgtacctttcgaagttctaactttacnctaacgtattaccgtaggttcgggtcgaccgaacgaccgggtccccgtagggtaacgaacgggtcttaggacggtggtaacgtgggacgtacnccggagtcggtagtgggtcgcgtctaacgtcgacgtanacgtaacgttacgtttacggacgggcccgtagttaccgaccgaaggtttccggaacctacggggtcccgtccgtacgaacgtacgtacgacgttaacgttattagtacgtacgttggacgtagaccggtctaaggtcggttcacgggacctacggacccggtactagttacgttacgttgtcggttgacggttaacggcgacggggtcggtaacgagggtacctaaagggtacggttcggttacccgaacccgggg

SEQ ID NO: 226158 - DNA, 872 bp, Homo sapiens
  misc_feature: GYAE6OF02IL1C1.19.86.H09.1.454.CMB.1.raw
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcgttggtggcagcagccacggacgcccactcccaggtgcagctggtgacagtcgtggggctggaggtgaaggacgtccggtaggggtccctcgtaggtcggtaaggtcctcccgtggcggtaggttcgttttaggacgttaacctaccttacgtacggttactaacttaactactaacttaagttaaccgtcggttacggggttcggaccggtaacggtacccgggtaccccggtacggtaacggtaacgggtcgttacgggtaggtacgggtaaggttacggggacgggtaacgttccgggtaacggggttcgggttaaggggttacggggtacgggtaccggtaccgtaacggtaccgtaccggtaccgtaaccgaacgggttaaacggttttcgggaacggggttcccgaaccggttacccgtaaccgtaacgggtccgggtaaccggaaaccgggtccggtaccggtaacccgtaaacggtaacgttaacgtaaccgttagttaacgtaaggttcggtaacgttgacgtacgaccggttactagggtacgtagtaccggtaaaccgaccgggtacggtaaccgttacggttacgttaacgtttaggttacggtaggtaccgggtacggaacgggtacgggggtaacccgggttaaggtaaaccgggtaaccgttaaacggggtttaaaccggttccggggtaaccccggttaacccccgggggg

SEQ ID NO: 226159 - DNA, 619 bp, Homo sapiens
  misc_feature: GYAE6OF02IO0T2.19.86.H09.1.454.CMB.1.raw
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
  modified_base (617)..(618): a, c, t, g, unknown or other
  misc_feature (617)..(618): n is a, c, g, or t
tcagtactctcgtgcacgaccggtgctcgatttagtgctatagacttgggtttgggggccgttcctgggcccagtctgtgctgactcaggcaccctcagcgtctggggacccccgggcagacggtcaccatcgcttgttctgcaagcagctcgaacatcgggagcagtggtgtgatgtggtatcagaaagtcccaggaaccggcccccaaactcgtcatctataatgacgctgagcggtaccttaagggtccctgaccgattctctggcgagaggtctggccgcctcagtccttccctggccatcgagacgggctaccgagtctggaagatggacggtctagtatttacttactgtgcaatcgtgggataggactaggtcgtaggtaaccgggttccgggtttcggacggggtagggaaccaaggtcgtacggtacccgtacgttaacgtcgaacgtaccccgaaaggtccgtacccggcccccgttcgggtaccctacccgttccgttccgttacccccacccgttcccgtacccgtaaccggacgtacgtaaccgtcggaacgggccgggtcgacggcgaacgggccacgacgtcgctgctnancgncgtancgnnc

SEQ ID NO: 226160 - DNA, 614 bp, Homo sapiens
  misc_feature: GYAE6OF02F2P45.19.86.H09.1.454.CMB.1.raw
  modified_base (268)..(268): a, c, t, g, unknown or other
  misc_feature (268)..(268): n is a, c, g, or t
  modified_base (600)..(601): a, c, t, g, unknown or other
  misc_feature (600)..(601): n is a, c, g, or t
  modified_base (603)..(604): a, c, t, g, unknown or other
  misc_feature (603)..(604): n is a, c, g, or t
  modified_base (606)..(614): a, c, t, g, unknown or other
  misc_feature (606)..(614): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgacgcggttaccgttaacgggtccctgaccgtattccncgtggcgagaggtcctggccgtcctcgagtcctttccccgtggccctagtccgaggacgggcctacccgagtcctaggaagtagtaggacggtcttagtaattttaacttacgtggtcgactaagttcgtagggaatcggacgtagtcggtacggtaaccgggtttccgggtttcgggacgggtaacggtaccgaacgcgtacgtaccgtacgtacgtacgaccgacccgtaggccgtcccgtaccccgtcgtcctaccttccgttccgttccccgtcccttcccgaccgacgacgtacgtcgtcgacgcggtctcggacgacgcgacagtnngnngnnnnnnnnn

SEQ ID NO: 226161 - DNA, 866 bp, Homo sapiens
  misc_feature: GYAE6OF02F49DP.19.86.H09.1.454.CMB.1.raw
  modified_base (118)..(118): a, c, t, g, unknown or other
  misc_feature (118)..(118): n is a, c, g, or t
  modified_base (164)..(164): a, c, t, g, unknown or other
  misc_feature (164)..(164): n is a, c, g, or t
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
  modified_base (279)..(279): a, c, t, g, unknown or other
  misc_feature (279)..(279): n is a, c, g, or t
  modified_base (855)..(855): a, c, t, g, unknown or other
  misc_feature (855)..(855): n is a, c, g, or t
  modified_base (859)..(859): a, c, t, g, unknown or other
  misc_feature (859)..(859): n is a, c, g, or t
  modified_base (861)..(861): a, c, t, g, unknown or other
  misc_feature (861)..(861): n is a, c, g, or t
  modified_base (863)..(863): a, c, t, g, unknown or other
  misc_feature (863)..(863): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttctgcaagcagctcgaacatcgggancagtggtgtgatgtgtatcgagaaagtcccagaccgccccaatcgtcatctataatcgacncgtgacgtcggtccttaaggtccctgaccgtatttccnctggcgagtaggtcgnggcgcctcacgtccttcccgtcggccatacgaggacgggtcctccgtaggttcgtaggaaacgtcgtaggtacgggtccttaggttaacttttacgttttaccgttacggttacgtaaccgttaaacgtttacgggttcggggtaaacttcggtaaccgttagggtttacggttacgggtttaaacccgggggttttacccggggttttttacgggggaacccggggttaacggggaaccgttaaaccgggtacccggtttaaccgggttaacccccgggtttaacggttaaccggtttaacccggtaacccgggtacccccgggttaaacggggtccccggttacccccgggtttaccccccgttacccgggttaccccgtttaacccgtttccccgggtttccccgtttccccccggtttacccccgtttacccccggtcccgttaaacccggggtaccgtaaacccgtttaaccgggtaccgggtaccggggtaccccggggtacggtttaccgggaaccgggttaacccggccgggttaaccgtacggtaacggacgtcgccgagcgtgccncgcncngngcg

SEQ ID NO: 226162 - DNA, 719 bp, Homo sapiens
  misc_feature: GYAE6OF02IF7VK.19.86.H09.1.454.CMB.1.raw
  modified_base (287)..(287): a, c, t, g, unknown or other
  misc_feature (287)..(287): n is a, c, g, or t
  modified_base (666)..(666): a, c, t, g, unknown or other
  misc_feature (666)..(666): n is a, c, g, or t
  modified_base (694)..(694): a, c, t, g, unknown or other
  misc_feature (694)..(694): n is a, c, g, or t
  modified_base (699)..(699): a, c, t, g, unknown or other
  misc_feature (699)..(699): n is a, c, g, or t
  modified_base (705)..(705): a, c, t, g, unknown or other
  misc_feature (705)..(705): n is a, c, g, or t
  modified_base (711)..(711): a, c, t, g, unknown or other
  misc_feature (711)..(711): n is a, c, g, or t
  modified_base (718)..(718): a, c, t, g, unknown or other
  misc_feature (718)..(718): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctacgaacagtcgggagcagtggtgtgatggtggtatacaaggaaaacgtcccaggaaccggacccccaaactcgtcatactataagtgacgactggacggtcggttacgttaacgggtcctacgaccgtaatttccncgtcggacgaggtacggtcgtgggcctccgttcacgtcccgtttcccgcggtccaacgtacgtacggacggtccctaccgtaagttccgagaacgtagtgacggtactagtacttttaagttcgtacggtacaccgtaagttcggtagggtactacggaacgtagggttcgtaacgggtttaaccggggttccgggtttacgggacgggttacggaaccgtaacggtccgtacggttaaccggtaaccgtttaacgaccgaccggtaccgtaacgggtccgtccggtccccggttacgtccgttaccgtttcccgtacccgttccccgccccttaccgtcccgtaacgtacgtaccgttacgcggtacggccggtacgnggaccgacggcgtacgtacgagtcgacnctcgngtacgngaccgncgagtcng

SEQ ID NO: 226163 - DNA, 792 bp, Homo sapiens
  misc_feature: GYAE6OF02F80FT.19.86.H09.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
tcagtactctcgtgcacgaccggtgctcgattagtgctatagacttgggtttggggggaagaggaagactgacggtcccactcccaggtgcagctggtgcagtctggggctggaggtgaaggagcctggggcctcagtgaaggtctcctgcgaggcttttggatacaccttcagtcattatcatatactcgtgggtncgacacggccctggacaagggcttgagtgatagggcgatccgagggtggtagtggtggcnctatacgtcgcacagtagttcgagggccncgtcacgagtcggacccgtaagggtccgacggtaccaacggtaatacgaggttgtacttagtggtaacttggatcgacgtccgttggacggttcacgaccgtaccgacgggctagttcgttaatttagttaggtggtacgggagggacgaggggaaccggggtaacgtaaacgggactaaaggttaaacggttccgggtttacccggaccccgggttacggggacccgtaaccgggggttaaccctcgggtaacccgtaccggtcctacccgttacgaacccggttcccctacccggtaaacccgggacccgggtaccccgttaagggtttcccccgggttcccctttccccccgggtacggggtcccccgttcccgttaccggtaaccccggtccggtaaaccggggtacccgaacccccgttacccggtaaccgggaaccggacccggttaccgaacccggggtacccgggtccccggggtttaccccgggccgggttcccggg

SEQ ID NO: 226164 - DNA, 765 bp, Homo sapiens
  misc_feature: GYAE6OF02HFICI.19.86.H09.1.454.CMB.1.raw
  modified_base (296)..(296): a, c, t, g, unknown or other
  misc_feature (296)..(296): n is a, c, g, or t
  modified_base (541)..(541): a, c, t, g, unknown or other
  misc_feature (541)..(541): n is a, c, g, or t
tcagtactctcgtgcacgaccggtgctcgatttagtgctatagacttgggtttgggggagcatcacccagcaaccacatctgtcctctagagaatcccctgagagctccgttcctcaccatggactggacctggaggatcctcctcgttggtggcagcagccaccggacgcccacctcccgaggtgcagctggtgcaggtccgtggggctggagggtgaagggacgccggtggggccctcgaggtgaacgggtctccgtggcgaggtcgttttggataccaccttcagtcattaancattatacgtcgttgggtcgacggacgacggccccgagggacgtaacgggtccttggacgggttggaacggtaggggaccggtatccggaggttagggtaggtcggggtgggcgacgtagtacgtcggacaaccgaggttaggtttccggacgggggccctacgggtccgaacgtagtcgggacccggaacgggtcccggcggtaccccaaagggtaacctaacggtagttacggttaacggttnttacgggtaacgtttggacgccgtaacgtccgggtgggtaaggggttccgtaggaaacccggtccggaaccggtacctaacgtttgtttaacgtttacggtttgggtccgggttccgggaagggtaccggggaacgggggttaaaccggggggaacggttaaaacgggtccgtaaaggggtttaaaccgggttaccggggtttaccccgggaacccccgggggg

SEQ ID NO: 226165 - DNA, 458 bp, Homo sapiens
  misc_feature: GYAE6OF02GPUG3.19.86.H09.1.454.CMB.1.raw
  modified_base (417)..(418): a, c, t, g, unknown or other
  misc_feature (417)..(418): n is a, c, g, or t
  modified_base (421)..(421): a, c, t, g, unknown or other
  misc_feature (421)..(421): n is a, c, g, or t
  modified_base (423)..(425): a, c, t, g, unknown or other
  misc_feature (423)..(425): n is a, c, g, or t
  modified_base (428)..(428): a, c, t, g, unknown or other
  misc_feature (428)..(428): n is a, c, g, or t
  modified_base (431)..(458): a, c, t, g, unknown or other
  misc_feature (431)..(458): n is a, c, g, or t
tcagtactctcgtgcacgaccggtgctcgatttagtgctatagacttgggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaaggcataaagtggttcgaccctggggccaggggaaccctggtcaccgtctcctcagcctccacaaggcccatcgtctccccctggcgccctgctccaggacgcacctccgagagcacagcgccctgggctgcctggtcaaggactacttcccacgagacgtacgtgagcgggctggcaaggcgcagtagnnagnannnacnatnnnnnnnnnnnnnnnnnnnnnnnnnnnn

SEQ ID NO: 226166 - DNA, 619 bp, Homo sapiens
  misc_feature: GYAE6OF02JHW3I.19.86.H09.1.454.CMB.1.raw
  modified_base (162)..(162): a, c, t, g, unknown or other
  misc_feature (162)..(162): n is a, c, g, or t
  modified_base (228)..(228): a, c, t, g, unknown or other
  misc_feature (228)..(228): n is a, c, g, or t
  modified_base (261)..(261): a, c, t, g, unknown or other
  misc_feature (261)..(261): n is a, c, g, or t
  modified_base (605)..(605): a, c, t, g, unknown or other
  misc_feature (605)..(605): n is a, c, g, or t
  modified_base (609)..(614): a, c, t, g, unknown or other
  misc_feature (609)..(614): n is a, c, g, or t
  modified_base (616)..(619): a, c, t, g, unknown or other
  misc_feature (616)..(619): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgtctgcaagcagctcgaacatcgggancagtggtgtgatgtggtatcaagaaacgtcccaggaaccgcccccaaatcgtcatctataatgacnctgacgtccggtccttaagggtccctgaccgtnttctcgtggcgaggaggtctggccgcctcgagccttcccgtcggccctattacgaggacggtctccgaagtcgtcggaaagtgtaggacgtcgtagttaatttagttaacgtggtcgtactattcggtagggtataggacaaggttggtacgggtaacggtttccgggtttacggcgggtaagggaccgaaacgtcgtacggaccgttacgtaacgttccgacgacccgaggtccgtccgccccgtaggtcctacctccttcgtcccctaccctcctacccgtacgacgtacgtacgcggacgccgggtcctcgggaccgtaacgggccgtaacgaggtcgacncgcnnnnnngnnnn

SEQ ID NO: 226167 - DNA, 731 bp, Homo sapiens
  misc_feature: GYAE6OF02FYOQN.19.86.H09.1.454.CMB.1.raw
  modified_base (163)..(163): a, c, t, g, unknown or other
  misc_feature (163)..(163): n is a, c, g, or t
  modified_base (224)..(224): a, c, t, g, unknown or other
  misc_feature (224)..(224): n is a, c, g, or t
  modified_base (712)..(712): a, c, t, g, unknown or other
  misc_feature (712)..(712): n is a, c, g, or t
  modified_base (718)..(718): a, c, t, g, unknown or other
  misc_feature (718)..(718): n is a, c, g, or t
  modified_base (723)..(723): a, c, t, g, unknown or other
  misc_feature (723)..(723): n is a, c, g, or t
  modified_base (727)..(727): a, c, t, g, unknown or other
  misc_feature (727)..(727): n is a, c, g, or t
  modified_base (730)..(731): a, c, t, g, unknown or other
  misc_feature (730)..(731): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaccgccccaatcgtcatctataatgacnctgagccggtaccgttaacgggtccctgaccgtattctctcggcgagaggtctggcgcctcagtccttcccgtggacctatcgaggacgggtcctaccgagtctaggaacgtataggacggcttaggtaattttagttacgttggtacgtacctaagttccggtaggggtacttacggaacgtagggttacggtaacgggttaaacccgggggttttcccggggtttttacgggggccggggtaacggggaaccgtaacgggtcgttaccgggtaaccccggttaccggttaaacggtccgtaaccggaccccgtaacgggtcccgtacccgggtacccccgttcggtacccgtaacccgttcccgttcccggttaccccccgtccccgttacccgttacccgacggtacgtaccggttaccgtcgggtaccgggtcccgggtaccgtcgggaccgtaacgggtccgaaccgtaggtacggactacgnagtccngacgnacgncgnn

SEQ ID NO: 226168 - DNA, 697 bp, Homo sapiens
  misc_feature: GYAE6OF02JKF6A.19.86.H09.1.454.CMB.1.raw
  modified_base (215)..(215): a, c, t, g, unknown or other
  misc_feature (215)..(215): n is a, c, g, or t
tcagtactctcgtgcacgaccggtgctcgatttagtgctatagacttgggtttggggagcatcacccagaaaccacatctgtcctctagagaatcccctgagagctccgttcctcaccatggactggacctggaggatcctcctcttggtggcagcagccaccggagcccactcccaggtgcagctggtgcagtcgtggggctggaggtgaaggngccgtgggcctacagtagaaggtctccgtgcgaggtctttggatacgtccttcagtctattatctatactactcgtggtcgcgacgaccggcccgtaggacgaggccgtggagtggagtacgggcgtaagccgtaggtggtaggtggcggcgctacgtcgcgcgaacgagttaacgttacgcggggtccgccgttacgaccgtagtcggaccgtaacgggtccgaccggtaccgaacgtaaacgttacgtaacggttagttaagttacggtacggtacttacgggaacgtcgtaacggcccggttaggtacgggttaccgtacggtaaccggtaccgtaaccgggtacctagtttacgtttaaggtttacgttacggtcggttaccggaacgggtcggaacgggggtaccggggtaaccgtaacggggtactaaacggttaagggtttacccggttacccggtaccccgggtaacccggggg

SEQ ID NO: 226169 - DNA, 814 bp, Homo sapiens
  misc_feature: GYAE6OF02JDOGO.19.86.H09.1.454.CMB.1.raw
  modified_base (796)..(796): a, c, t, g, unknown or other
  misc_feature (796)..(796): n is a, c, g, or t
  modified_base (804)..(804): a, c, t, g, unknown or other
  misc_feature (804)..(804): n is a, c, g, or t
  modified_base (808)..(808): a, c, t, g, unknown or other
  misc_feature (808)..(808): n is a, c, g, or t
  modified_base (811)..(811): a, c, t, g, unknown or other
  misc_feature (811)..(811): n is a, c, g, or t
tcagtactctcgtgcacgaccggtgctcgatttagtgctatagacttgggtttgggggccggttcctgggcccagtctgtgctgactcaggcaccctcagcgtcgtcgggacccccgggcagaccggtcaccatcgcttgttctgcgaagcacgctacgaacagtcgggagcaggtggtacgtgatggtgtatacgaaggtaaactcccgaacggaaccgacccccaaagttccgtacacttacctaataagtcgaccgtcgtagtacgtcgggttaccgttaaccgggttcccgtacgaaccggttatttccgtacggtacgggcgaacggtaggtccgtcgggacgtcccgtacctacgtcccgttacccggtcggacccgttaccgacgtagggtaccgggtccctaccgtacggttccgaacggtaaagttacggtcggaacggtcgttacgtttaagtttaaccgtttagttacggtacgtaaccgtacgtttacggttcgggtaaactacggtaagtacggtttcggtaaaccggggtttaccggttttacccggggtttacggggaccggggtaaaccggtacgtaaaccgtccggttaacggtaccccgttaaacggtcgttacgaccgaaccgggtaaccgtcccggtacccgttcccggtccggttacttaccggttcccttccccgggttaccccttaccccggtccttaaccggaactacggtacctacggtacgggtccgggccgttaggccgtaagcggtacctagaggccatcgactcggntgacgtcngacncgngtg

SEQ ID NO: 226170 - DNA, 765 bp, Homo sapiens
  misc_feature: GYAE6OF02HJBEY.19.86.H09.1.454.CMB.1.raw
  modified_base (672)..(672): a, c, t, g, unknown or other
  misc_feature (672)..(672): n is a, c, g, or t
tcagtactctcgtgcacgaccggtgctcgatttagtgctatagacttgggtttgggggagcatcacccagcaaccacatctgtcctctagagaactcccctgagagctccgttcctcaccatggactggacctggaggactcctcctcgttggtggcagcagccaccggagcccactcccgaggtgctagctggtgctagttcgtggggctggacggtgaaaggcgccggtgggccctcgtagtagtaaggtcctccgtagcggtaggttcgttttaggactacctaccttacgtagtactattactactaattattacgtcggtagggtcggaccgtacgtacggtccccgtaggaaccgtaacggggtcttaggaggttacgggaggttaaccgggaccggtaacgtcggtaacgggttagggttaggtacgggtcggtaccggtacgtaaccgttaacggtcgtaccgaaagtaacgggttaacgtttaccggaacgggtcccgtaacgtacccgaacgtacggtacgggtaccggtaaaccggtcccggtaccgttaaaccgaacgtaaaccgtaacggtagttagtaacgttaacggtcggtaacgtttaggaacacggacttccggtaagtacggttcaacgaccggacgaaccggcttaacgttntacgtttagttggaacgcggtaagggtccggaacgggtacggaacggttaacggacgttaaaggttaacgggttcggtaccccggtacccggg

SEQ ID NO: 226171 - DNA, 1064 bp, Homo sapiens
  misc_feature: GYAE6OF02F8FO1.19.86.H09.1.454.CMB.1.raw
tcagtactctcgtgcacgaccggtgctcgatttagtgctatagacttggggtttgggggagcatcacccagcaaccacatctgtcctctagagaactcccctgagagctccgttcctcaccatggactggaccgtggaggatccgtccttcgttgggtggcagcacggccgaccggacgcccacctcccgaggtcgcagctggtgcgagtcggtggggcgtggaggtaggaaggacggccggtcggggcctcgtaggttacggaacggttcgtaccggtcggtacggtacgggtttacgttttagggaacttaaacccgtaccgtttaccgtaggttaaccttaacgtttaacttaaccgtaatttaacttacgtttcgggttacggggttcggtaacccgggaaccgtaacccggggtaccccccggtagggtaaaacccggggtaacggggtaccgtttaggggaacgggggttagggaaacgggtttacggggggaccgggttaaccggtaccccgggggttaaggggtttacggggtttaacggggttacggggggacgggtacccgggtaaccgtttaaacgggttaacccggggttacccgggtaaaccgtaaaacgggtttaaacccgggggtttaaaggttttacccgggggaaacccggggggttacccccgggtacccgggtaaacccgtaaaccccgggttaacgggtaacccggggtaacccgggtttaaaccgggtacccggggtaccccgttaaacccccggtaaaacggttaaaccggttaacccggttaggttaaacccgggtttaaagtttcgggttaaaccgggttacccggttaaagggaccggttacgggtaaccccgggaggggtttcgggttaaacggtcgttaaccggggaaaccgaaccggtaacccggtaccttaagggttttaaccttaggtttaaccgttggtaaccgggacgggtaacggtacgggaacgggggtacggtaacggtaacggttaaggtaacggttaaccgggttccgggttaccgggaccccgggg

SEQ ID NO: 226172 - DNA, 706 bp, Homo sapiens
  misc_feature: GYAE6OF02JCPKE.19.86.H09.1.454.CMB.1.raw
  modified_base (163)..(163): a, c, t, g, unknown or other
  misc_feature (163)..(163): n is a, c, g, or t
  modified_base (690)..(690): a, c, t, g, unknown or other
  misc_feature (690)..(690): n is a, c, g, or t
  modified_base (696)..(696): a, c, t, g, unknown or other
  misc_feature (696)..(696): n is a, c, g, or t
  modified_base (699)..(699): a, c, t, g, unknown or other
  misc_feature (699)..(699): n is a, c, g, or t
  modified_base (702)..(702): a, c, t, g, unknown or other
  misc_feature (702)..(702): n is a, c, g, or t
  modified_base (705)..(706): a, c, t, g, unknown or other
  misc_feature (705)..(706): n is a, c, g, or t
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatggtggtactcagaaacgtcccgaaggaaccggacccccaaagtcgtcatactataactgacgctgagcggtaccttaacgggccctagaccgtattcctcgtaggcgaagtacggtctgggccgacctcgacgtcctttaccccgtcggccctacgtcgacggacgggcctaccgagtccgtagaaacgtgtacggaggtctgtaatttacttaccgtgttcgacgttaattcggtcgggtaatcgtaacggtggttacggtacggttaaaccggggtttcccgggttttacggggacgggtaacgggtaaccgtaagtccggttcggaacccggttaccgttaacggtacccgtaacggacccgtaacggtcccgttacccggttcccccgtacggttaccctacccgttccgtttacccgtccccgtccccgttccctacccggaacgtaaccggttacgacccgtggaccgcgggtcgtagaccgtaggaccgtgtaacgtacgcacgtacntagcancgnacncgnn

SEQ ID NO: 226173 - DNA, 878 bp, Homo sapiens
  misc_feature: GYAE6OF02IMP7I.19.86.H09.1.454.CMB.1.raw
tcagtactctcgtgcacgaccggtgctcgatttagtgctatagacttgggtttggggagcatcacccagcaaccacatctagtcctctagagaatcccctgagagctccgttcctcaccatcggatcggaccgtggaggactccctcctcgttggtggcagtcaggcccgacggcgacccctaccgtcccgaggtcgcctagtccgtggtgccgtcggtaccgtgggtctaggaggtacggaaggccggtccggtcgggccctagaacggtaggtaaccggttccttccgtgggacgtacgggtttcgttttaggaaccttaaccgtaccgttaacgtacgttaccgtaagttaactacgttaacttaaacgttccgttcgggtcgggtaccgtaccgtaaaccggttaccccgggtaccccggtaaggtaacccgtaaacggggttcgttaacgggtacggttacggggtaccgggttaaacgggacccggtaacggttaaccggtaccggggttagggttaacggttcggggccggtaaccgtacgtaacccggttccggtacgtacgaacggttaacggttaagttccgggaacgggtacccggtaccgtaaccgtacggtacgtacgggaaccgtacgggtaccgaaccgttacgaacggtaaacgttcgaacggttcgttaacgtagttacgtaccgttaaggccgttaacgtaccgtacggtacggtaaccgtcgaccgtaaacggccgtacgtaccgttaacgttcgttacttagggtccgtaacgggacgtacgggaacgtaaccgggtaacggtacccgtaaagggtcccttaaggggttaacccgttaccggtaccccggaccggggg

SEQ ID NO: 226174 - DNA, 743 bp, Homo sapiens
  misc_feature: GYAE6OF02HSL4X.19.86.H09.1.454.CMB.1.raw
  modified_base (264)..(264): a, c, t, g, unknown or other
  misc_feature (264)..(264): n is a, c, g, or t
tcagtactctcgtgcacgaccggtgctcgatttagtgctatagacttgggtttgggggagagcatcacccagcaaccacatctgtcctctagagaatcccctgagagctccgttcctcaccatggactggacctggagatcctcctcttggtggcagcagccaccggagcccactcccaggtgcagctggtgcagtctggggctgaggtgaaggagccgtgggcctgagtgaaggtctcgtgcgaggtctttggatacaccttnagtcattatctatatactcgtggtgcgacacggccctaggacaggcttgagtgagtgggcgatccgacggtggtaggtgggtcggcgacgtacgtacggtcgactaacgtacggtaacgtttacgacggggtaccgtacgttaccgaaccgtaggtcggacccgttaagggtccgaccggttaccgaaacgtaaacgtaacgtaaggttaggtaaacgttacgttaacgggtaactttagggaacggtccgtaaccgggttaccccggttaggggttaaccgggttaccgttagggaaaccccgggtaacgtaacccggggtacccttaaagggtttacgttttaaacgttttacggtttcgggttaacggggacccgggtaaggggtaccgggaaccggggttaaccgggggttaaccgttaaaaaggggtaccgttaaaagggttaaaccgggtttccggggttaaaacccccgggg

SEQ ID NO: 226175 - DNA, 578 bp, Homo sapiens
  misc_feature: GYAE6OF02GQDPH.19.86.H09.1.454.CMB.1.raw
  modified_base (96)..(96): a, c, t, g, unknown or other
  misc_feature (96)..(96): n is a, c, g, or t
  modified_base (116)..(116): a, c, t, g, unknown or other
  misc_feature (116)..(116): n is a, c, g, or t
  modified_base (162)..(162): a, c, t, g, unknown or other
  misc_feature (162)..(162): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
  modified_base (523)..(523): a, c, t, g, unknown or other
  misc_feature (523)..(523): n is a, c, g, or t
  modified_base (550)..(550): a, c, t, g, unknown or other
  misc_feature (550)..(550): n is a, c, g, or t
  modified_base (557)..(557): a, c, t, g, unknown or other
  misc_feature (557)..(557): n is a, c, g, or t
  modified_base (569)..(569): a, c, t, g, unknown or other
  misc_feature (569)..(569): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (578)..(578): a, c, t, g, unknown or other
  misc_feature (578)..(578): n is a, c, g, or t
tcagtactctcgtgcacgaccggtgctcgatttagtgctatagacttgggtttggggccgttcctgggcccagtctgtgctgactcaggcaccctnagcgtctgggacccccgggnagaccggtcaccatcgcttgttctgcaagcagctcgacagtcggancagtggtgtcgagtgtggtatcaagaacgtcccgaggaaccggccccaaatcgtcatctataagngacgcngacgccggttaccgtacggtccctgaccgtattccgtcgtggtcgagtaggtcgtcggcctcncgacgcttccgtcgccatcgagcggctcgngtacgagaagngtagngtctgtattacgtntgtanactagtcgtagngtcgacgtgtgtacggtaccggtttcgggttacggcgggtacggtaacgacgtctacggtacctccgtaagcacgaccgtacggcctcccggtcccgttacgtccacgttcctcccgtcccgtccctaccgtccgaacgtcgtacgtcgngtcggcgtcgaagcgacgcgacgtagngtgctanacgtgtagcgtnacngtncgn

SEQ ID NO: 226176 - DNA, 752 bp, Homo sapiens
  misc_feature: GYAE6OF02FG04S.19.86.H09.1.454.CMB.1.raw
  modified_base (167)..(167): a, c, t, g, unknown or other
  misc_feature (167)..(167): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
  modified_base (737)..(737): a, c, t, g, unknown or other
  misc_feature (737)..(737): n is a, c, g, or t
tcagtactctcgtgcacgaccggtgctcgatttagtgctatagacttgggtttgggggccgttcctgggcccagtctgtgctgactcaggcacccctcagcgtctgggacccccgggcagacggtcacccgatcgcttgttctagcaagcagctcgaacatcgggancagtggtgtgatgtggtatcagaaagtcccaggaaccgcccccgaaactcgtacatcgtataagtcgacgctaggagccggttccttaaggggtcccccttgtacccgagtttctcgtacggcggaggaggtcgttcggcggcctaccgacgtccgttcccccgtcggtcccgtactacgacgtacgggccgtccgtacgtccgaggtacgagtcgaggctagtagttaagttactacgtggactaagtacgtgggtacgtcggtaacgtagtacggtttacgggtacggggttacccgggtttttaccgggggaccggttacgggggtaccggtaaccggtacgtacggtaaccgttacccgttaaccggttaaccgacgtaccccgaacggaccggtccctaccccggtcccgtttacccggtacccgtacccgttccgttacccgtaccccgtacccccgtacccgaaccggtacgttaaccggtacggtaccggtaccggggtaccgcgggttacccggaacgggtaccggtaccgacccgtagggacgcgaacgtcngnttaccngcgaactgacgtcag

SEQ ID NO: 226177 - DNA, 727 bp, Homo sapiens
  misc_feature: GYAE6OF02GQTRY.19.86.H09.1.454.CMB.1.raw
  modified_base (164)..(164): a, c, t, g, unknown or other
  misc_feature (164)..(164): n is a, c, g, or t
  modified_base (195)..(195): a, c, t, g, unknown or other
  misc_feature (195)..(195): n is a, c, g, or t
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
  modified_base (317)..(317): a, c, t, g, unknown or other
  misc_feature (317)..(317): n is a, c, g, or t
  modified_base (509)..(509): a, c, t, g, unknown or other
  misc_feature (509)..(509): n is a, c, g, or t
  modified_base (646)..(646): a, c, t, g, unknown or other
  misc_feature (646)..(646): n is a, c, g, or t
  modified_base (694)..(694): a, c, t, g, unknown or other
  misc_feature (694)..(694): n is a, c, g, or t
  modified_base (698)..(698): a, c, t, g, unknown or other
  misc_feature (698)..(698): n is a, c, g, or t
  modified_base (703)..(703): a, c, t, g, unknown or other
  misc_feature (703)..(703): n is a, c, g, or t
  modified_base (706)..(706): a, c, t, g, unknown or other
  misc_feature (706)..(706): n is a, c, g, or t
  modified_base (713)..(713): a, c, t, g, unknown or other
  misc_feature (713)..(713): n is a, c, g, or t
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
  modified_base (724)..(724): a, c, t, g, unknown or other
  misc_feature (724)..(724): n is a, c, g, or t
tcagtactctcgtgcacgaccggtgctcgatttagtgctatagacttgggtttgggggccgttcctgggcccagtctgtgctgactcaggcaccctcagcgtcgtcgggaccccgggctagacggtcaccgtatcgacttgttctggcaagtcagctacgaacngtccgggagcacgtggtgtgatggtacgtancgaagtaacgtccgagtacccgccctaaagtcgtcatctataagtcgacgtgtagacgtccggttaccgttaacggtcccnggtaacccgtntttccgacgtggacgtaggaggtctaggcncctcgagtccgttccgaggtccctagtacggaacgggtcggtacctccggtaacgttcgaaggtatggtacggaggttacctgtttaaacgtttaccttaggtgtcggtaactaacggtttcaaggggtcgtacggtacgtaggtttccgaacggttaccggggggtttccggtttcggaacgggaaccggngtacggtaccgtagtacccggttacgtaacgaccgtaaccggcgtaaccgtcgtccccggtccctccgtccgtaccgttccggtaccccgttcccgtcccgttccccgtaacggtaccgtaggtacgggtttaccgnggttaaccggcggttaccggtacgggaccgacgggcctaggtccgaanacgnttacngtntacggancgtntnacgtnacg

SEQ ID NO: 226178 - DNA, 668 bp, Homo sapiens
  misc_feature: GYAE6OF02G806B.19.86.H09.1.454.CMB.1.raw
  modified_base (118)..(118): a, c, t, g, unknown or other
  misc_feature (118)..(118): n is a, c, g, or t
  modified_base (141)..(141): a, c, t, g, unknown or other
  misc_feature (141)..(141): n is a, c, g, or t
  modified_base (164)..(164): a, c, t, g, unknown or other
  misc_feature (164)..(164): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (649)..(649): a, c, t, g, unknown or other
  misc_feature (649)..(649): n is a, c, g, or t
  modified_base (661)..(661): a, c, t, g, unknown or other
  misc_feature (661)..(661): n is a, c, g, or t
  modified_base (663)..(668): a, c, t, g, unknown or other
  misc_feature (663)..(668): n is a, c, g, or t
tcagtactctcgtgcacgaccggtgctcgatttagtgctatagacttgggtttgggggccgttcctgggcccagtctgtgctgactcaggcaccctcagcgtctcgggacccccgggnagacggtcaccatcgcttgttcngcaagcagctcgaacatcgggancagtggtgtgatgtaggtatcaagaaaacgtcccagggaaccggtacccccaaaactcgtacatcctaataagtcgacgctgagcggttacctaagggccctagaccattcnctggacgagagtctggcgtcctnacgtccttaccgtggccataccgaaggacgggtcctaccgtagtaccgttacggaagtacgtacggacgggtacctaggtaatttaacgttaacgtgtacgactaaagtcggtaggtactagaacgtaggtaggtacggtaaccgggttccgggtttacgggacggtaacggaaccgagtacgtacgtaccggtaaccgttagaccgtacgacccgaacgtccgtacccgtacccgttaccggtacaaccgttccgttaacccgtaccctacccgtacctaccgaccggtaagaaccgttacgtaacgggcgggtaccggacgtcggaacgacggaccagttaacgacgnaggtcagtcgancnnnnnn

SEQ ID NO: 226179 - DNA, 299 bp, Homo sapiens
  misc_feature: GYAE6OF02HOAEB.19.86.H09.1.454.CMB.1.raw
  modified_base (122)..(122): a, c, t, g, unknown or other
  misc_feature (122)..(122): n is a, c, g, or t
  modified_base (141)..(141): a, c, t, g, unknown or other
  misc_feature (141)..(141): n is a, c, g, or t
  modified_base (167)..(167): a, c, t, g, unknown or other
  misc_feature (167)..(167): n is a, c, g, or t
  modified_base (235)..(299): a, c, t, g, unknown or other
  misc_feature (235)..(299): n is a, c, g, or t
tcagtactctcgtgcacgaccggtgctcgatttagtgctatagactttggggttttgggggcccgtttcctgggcccagtctgtgctgactcaggcaccctcagcgtctgggacccccgggnagacggtcaccatcgcttntctgcaagcagctcgaacatcgggancagttggtgtgattggtaggtatacgaaggtaaaacgtcccgaagggaacccggaccccccaaaacgnnnnnnnnnnnnnnnnnnnnnnnnnnnnnnnnnnnnnnnnnnnnnnnnnnnnnnnnnnnnnnnnn

SEQ ID NO: 226180 - DNA, 853 bp, Homo sapiens
  misc_feature: GYAE6OF02J0YTF.19.86.H09.1.454.CMB.1.raw
tcagtactctcgtgcacgaccggtgctcgatttagtgctatagacttgggtttggggagcatcacccagcaaccacatctggtcctctagagaactcccctgagagctccgttcctcaccatggactggacctggaggactcctcctcttggtggcagccagccgaccggacgcccacctcccgaggttcgcacgtcgtggttcgcgtacgtcgtcggggcttacggaggttggaaacgggcggtccggttcgggggtaccctcgaagggttaggaacggttcctccgttagggaccggttacgggtttccgtttttagggaacttacccgtaccgtttacgacggttacctaagtttaacgtacttaacgttaaccgtttaccgttccgggttcggggttacgcggtaaaccggtccggtaacccccggttagggaacccggtaggggttccttagggtagttaacgggtacggtaccggggacggtacgtaccccggttaggggtacggttacgggtacggggtccggcgtacgtacgttaaccgggtcgaaccgacgtaagggttaccggtttaccggcggggtcccgtacggtacccgacgtacggtaccgggtaccgtaaccggggttccgaccgttaaccgggaaacgttaccgttaaacgggtgtttaacggttaagtaccggtttcggtacgttacggacggtaccgacgtaccgtacgggtactccggtacggaaccaaccgtccgagttcgtaagttcgttcgttcggcggaacggtcggacggttaacgggaacggtacgtaacggtactaaggtttaccgggtaccgtcccggtacccggg

SEQ ID NO: 226181 - DNA, 674 bp, Homo sapiens
  misc_feature: GYAE6OF02ID6PK.19.86.H09.1.454.CMB.1.raw
  modified_base (252)..(252): a, c, t, g, unknown or other
  misc_feature (252)..(252): n is a, c, g, or t
tcagtactctcgtgcacgaccggtgctcgattagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggatagggcgactccgacggtggtaggnggtggcgcatacggtcgcaacagtaacgtttcgagggcccgcgtcaccagtcggccgaaggtcgcgtccgaacgaatacagtgtatagtggacttgagcagccgtgaggtctaggaccgacacggcagtagtattagtgtggacgtaggacgagggacgggtactaaacggcgtaagtaaacggtcgggttaccgaaccccgggtaggggacccgtaacgggtaaccccgttacgggtacccgaacccgtcctacccgtaccacgccctacccgaaccgaaccgggacccctagttacccggttcccgttacccccgtcggaccccgaccccgttccgtcctacccggaaccgggtaccgacccgtaccctacccggaagacggacctaccgaccggtacccgggcccggtcgggtacccgg

SEQ ID NO: 226182 - DNA, 748 bp, Homo sapiens
  misc_feature: GYAE6OF02GUE1J.19.86.H09.1.454.CMB.1.raw
  modified_base (117)..(117): a, c, t, g, unknown or other
  misc_feature (117)..(117): n is a, c, g, or t
  modified_base (719)..(719): a, c, t, g, unknown or other
  misc_feature (719)..(719): n is a, c, g, or t
  modified_base (745)..(745): a, c, t, g, unknown or other
  misc_feature (745)..(745): n is a, c, g, or t
tcagtactctcgtgcacgaccggtgctcgatttagtgctatagacttgggtttgggggccgttcctgggcccagtctgtgctgactcaggcaccctcagcgtctgggacccccgggnagacggtcaccatcgcttgttctgcaagcagctcgaacagtcgggagcaggttggtgtgagtggtggtatcaaggaaagtcccaagggaacccgacccccaaatcgtcatctatagtcgacgctaggacgtccggttaccgttaacgggtccctagaccgtattcgtcgtggcgaggtagtcgtacggccgccgtcgtacgtcccttccgtcggcctagtccgaggacgggtcctaccgagtccgtaggaacgtagtaggaaggtcttagttaagtttattacgtggtactagtaacgtgggtaggtagttcgagtaggttgttacgggtaaccgggtttccgggtttacggggacgggtacggtaccggaacggtcgttaacccggaccgttaacccgtacggtaccgaccgtaccggtaaccggtcccgtccccggtaccccgttcgggttaccctaccgttcccgtttacctttaccccccgacccttcccgtaacccggtaacggtaccggtaaaccggttccggtaacgggttaaccggggccgggttaccggaccgggtaaccgggtaccggtaccgaacgtttcggaacgtcggngcgtacgtagcgcgtcgacgctacgngtc

SEQ ID NO: 226183 - DNA, 827 bp, Homo sapiens
  misc_feature: GYAE6OF02HUC8B.19.86.H09.1.454.CMB.1.raw
  modified_base (124)..(124): a, c, t, g, unknown or other
  misc_feature (124)..(124): n is a, c, g, or t
  modified_base (287)..(287): a, c, t, g, unknown or other
  misc_feature (287)..(287): n is a, c, g, or t
  modified_base (681)..(681): a, c, t, g, unknown or other
  misc_feature (681)..(681): n is a, c, g, or t
tcagtactctcgtgcacgaccggtgctcgatttagtgctatagacttgggtttggggggagagcatcaccagcaaccacatctgtcctctagagaactcccctgagagctccgttcctcaaccntggactgggacctgggaggactcctaccttcttgggtggcagcagcccaccggacgcccctactcccagggtgcacgcgtgggtcgcctacggtcggtcgggggctaggagggtaggaagggcgtccggtggggtcctagaggtaggtaacggttcctccggnggtaccggtagggttcgttttagggaacttacctacccgttagtacgttactaactttaactcgtaactttaacttacgttcggttacggggttcgaccggtaacggaccgggtaccccgttaagggaaccggtaacggggttccgttaacggggtaggggttacgggaacgggttacgggggaccggtacggttaccgggtaacggggttcggggttaacgggtcggggtcggggtacgtactacggtaccggttaccgacggaaacgtaacggtacgtttcggggaacgggaccggtccgtaacgtaccgtacggtaccgggtacggtacggtaccggaccggttaccaacgggtaactaagtacggttataaggttacgtggttacacggngacgtacggtacggtcgtaggtcgtacggaccgaacgtccgtagtaacttggttaatacggttggtaccggtgggacgggtaacggaacgggggtacggtaacgggtaaagaaccgggtaagttacggggtcccggttaacccggg

SEQ ID NO: 226184 - DNA, 700 bp, Homo sapiens
  misc_feature: GYAE6OF02HAJUG.19.86.H09.1.454.CMB.1.raw
  modified_base (303)..(303): a, c, t, g, unknown or other
  misc_feature (303)..(303): n is a, c, g, or t
  modified_base (637)..(637): a, c, t, g, unknown or other
  misc_feature (637)..(637): n is a, c, g, or t
  modified_base (681)..(681): a, c, t, g, unknown or other
  misc_feature (681)..(681): n is a, c, g, or t
  modified_base (688)..(688): a, c, t, g, unknown or other
  misc_feature (688)..(688): n is a, c, g, or t
  modified_base (697)..(697): a, c, t, g, unknown or other
  misc_feature (697)..(697): n is a, c, g, or t
  modified_base (699)..(699): a, c, t, g, unknown or other
  misc_feature (699)..(699): n is a, c, g, or t
tcagtactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcagaaagtcccaggaaccggcccccaaatcgtcatctaataatcgacgctgagccggttaccttaaacgggtcccctaggaccgtattcgtcgttggcgagacggtctcgggcgcccttnacgtccttcccgtggcccaagtcgaacggagggcctccgagttctagaagctgaggcttagtaatttattaacgtggtacgactaaagttcgagggaacttggacgtaggttcgtacggtaaaccgggttttccggggtttcggaccggggtaagggtaccgaagtcccgtacggtaacccggttacgtaaacggttccgaacgtaccccgaaacgggtcccgtcccggtacccccgttcggttaccctacccgttccgttaccggttcccccgtcccttacccgttcccgaaccggtaccgtaacgttaccgacggtacgggcccgggttacnccgggtaacgaaccgggccgtacggaagttcggacagtaaccgngtacgtnacgcgagcngnc

SEQ ID NO: 226185 - DNA, 726 bp, Homo sapiens
  misc_feature: GYAE6OF02INH10.19.86.H09.1.454.CMB.1.raw
  modified_base (119)..(119): a, c, t, g, unknown or other
  misc_feature (119)..(119): n is a, c, g, or t
  modified_base (142)..(142): a, c, t, g, unknown or other
  misc_feature (142)..(142): n is a, c, g, or t
  modified_base (153)..(153): a, c, t, g, unknown or other
  misc_feature (153)..(153): n is a, c, g, or t
  modified_base (168)..(168): a, c, t, g, unknown or other
  misc_feature (168)..(168): n is a, c, g, or t
  modified_base (704)..(704): a, c, t, g, unknown or other
  misc_feature (704)..(704): n is a, c, g, or t
  modified_base (718)..(718): a, c, t, g, unknown or other
  misc_feature (718)..(718): n is a, c, g, or t
  modified_base (724)..(724): a, c, t, g, unknown or other
  misc_feature (724)..(724): n is a, c, g, or t
tcagtactctcgtgcacgaccggtgctcgatttagtgctatagacttgggtttgggggccgttcctgggcccagtctgtgctgactcaggcaccctcagcgtcgtcgggacccccgggnagacggtcaccatcgcttgttcngcaagcagccncgaacagtcggggancaggtggtgtgatggtcgatcgagaaacgtccgacggaaccgtaccccaagtcgtacattactaataacgtgacgctaggacggtccggttaccgtttaacgggtcccctagaaccgtctttccgtcggtaggaccggtaaggtcggtcgtacgggcccgaccgttacgaccggttcccgttcccgacggaccctagtacgtacgggaaccggtcccttaccgaaggttccgaaggaaacggttcgtacggaacggtccgttaagtaacttttaacgttacgtagttccgaaacgtagtccggttaggatacggaacgttagtcggttaacgggtaccggtttcgggtacggacgggtacgacgagtcgtacgtaccgtacgtacgaccgtagaccgtacgggctacccgccgtacgtaccttacgtccgttacccgtccctacccgccttaaccggaggttaaccaggtaccgtacgggaccgccgggttcaacgggaccgtaaccgggacctaacggtacgcgtcgaggtaccngcgacgcgacgtcncgcgancg

SEQ ID NO: 226186 - DNA, 871 bp, Homo sapiens
  misc_feature: GYAE6OF02FPWS9.19.86.H09.1.454.CMB.1.raw
  modified_base (117)..(117): a, c, t, g, unknown or other
  misc_feature (117)..(117): n is a, c, g, or t
  modified_base (164)..(164): a, c, t, g, unknown or other
  misc_feature (164)..(164): n is a, c, g, or t
tcagtactctcgtgcacgaccggtgctcgatttagtgctatagacttgggtttgggggccgttcctgggcccagtctgtgctgactcaggcaccctcagcgtctgggacccccgggnagacggtcaccgatcgcttgttctgcaagcagctcgaacatcgggancagtggtgtgtatggtggtatcgaagaaacgtcccaggaacccgtccccaaagttcgtcattctaagtaatcgacgctggtacggccggttaccgtttaacgggtccctaggtacccgtatttccgtcgtacgggacgtacggtacgggttaccttcggggacccgttccctaacgacggttcccctttacccggttacgggacccctagtttaccggaacggggtaccggggtcccttaacccggcggttttaaccgtaacgggaaaccgttggtacggggtaacgggttaccgttaggttaaacgtttttacgttttaccgggacggggtttctaaacccgtaaggttttaccgggaggggtaactttacgggaacgtttacgggttaacgggtaaccggggtttaacccggggtttaccgggggttttaccgggaacgggttaaaccgggaccctttaacgggtaccggtaccgggttaaccccggttaaccggttaaccggttaccggaaccggtaaccggaaccggttcccgtaacccggtcccggttaccgtacccgttacgttccgttacccgttaccccgtccccgttaccgtaccggaacggttacgaccggttaccgtacgggttaccggccgggtcggtacggtacgacgggtacgacgttacggatcgacgactcgagtcgagccgagctcaggc

SEQ ID NO: 226187 - DNA, 791 bp, Homo sapiens
  misc_feature: GYAE6OF02HE9C7.19.86.H09.1.454.CMB.1.raw
  modified_base (737)..(737): a, c, t, g, unknown or other
  misc_feature (737)..(737): n is a, c, g, or t
tcagtactctcgtgcacgaccggtgctcgatttagtgctatagacttgggtttggggagcatcacccagcaaccacatctgtcctctagagaatcccctgagagcttccgttcctcaccatggactggaccgtggaggtactcctcctcgttggtggcagcacgccgaccggacgccctacctcccgaggtcgcgagcgtggtcgcgtaggtcggtcgggtctaggtagggtaggaacgggcgccggtcgggcctacgacggtacggtaacggttccgtccgtcggtacgtacggttcgttttacggacttaccgtaccgttcgacgttctaattacgtctaactacgttacgtacggtggtcgtacggtaaccgtaccggtaccccgtaggtaaccggtaacggtcgtacggtaggtgggtaacggtacgggaccgtacgtaccggtaacgggtggttacggtagggtacggtcgtacgtacgtacggtacgacgtaaccgtagtacggttcggacgggtccgactaccgactggtaccgacgtaacgggtccgaccggtaaccgaaggttaaacgtctagggttattacggtagttccgggtaatcggacgacggtaccggttaccgtgggtacgtaccgtacggtaccaaccgggtaccgtacgttagtttaacgtttagttacggttaggcgtaacccgggtagaacccgggtacggggtaaacccgggttanaaacgggtaaccggtttaaagtaacgggtttcccgggaccccggtaacccgggg

SEQ ID NO: 226188 - DNA, 846 bp, Homo sapiens
  misc_feature: GYAE6OF02IPNZ5.19.86.H09.1.454.CMB.1.raw
  modified_base (188)..(188): a, c, t, g, unknown or other
  misc_feature (188)..(188): n is a, c, g, or t
tcagtactctcgtgcacgaccggtgctcgatttagtgctatagacttggggtttgggggagcatcacccagcaaccacatctgtcctctagagaatcccctgagagctccgttcctcaccatggactggactggaggatcctctactggtgcagcagccacggatcccactccaggtgcagctggtcnctagtcgtgggctggacggtgaaggacgccggtacgggcctacgaaggtcgtaacggtccttcgtggacggtacggttcgttttacggaacttaaccgtaccctttcgacggttacctacgtttaactacctaagttacttaccgtacggttggggttacgaccggtaaccggacggtaccccccgtaggggtaacctaaagggggttccgtttaagggtaccggtaggtaacggtacggggtaccgtaccgttaccgggtaccggttagggttaagggtggggtttcggaccggtactaaacggtttccggaccggtacgtaaccggaaagggtttaaccgttttaccgggaccggggtacccggtaccgttaaccgaaccgttaacggtaccgggtaaccggtacgggtacccggtacccggtaaccgtaaacgtaaaccgtacgtaacgggttgttaaacgtaacgttacggttacttacgggtaacaccggtacgtaccgtacggtaaggttccgacggaccgtaaccgaccggtaaccttagtacgttacgttaggttacggtggacccgtaagggcgtaaccgggggtaacgggtaacgtaacgggtacttaaacgggtaaccggtaccgggttacccggtaaccccggggg

SEQ ID NO: 226189 - DNA, 758 bp, Homo sapiens
  misc_feature: GYAE6OF02FRG12.19.86.H09.1.454.CMB.1.raw
tcagtactctcgtgcacgaccggtgctcgatttagtgctatagacttgggtttgggggagagcatcacccagcaaccacatctgtcctctagagaatcccctgagagctccgttcctcaccatggactggacctggaggatcctcctcgttggtggcagcagcccgaccggacgcccactcccgaggtgcagcgtggtgctaggtcgtggggctggagggtaggaacggcgtccggtggggtccctcgacggtggaacggttcctccgtggcggtaggttcgtttaggtactacctaccgttcgacgttacgtatttacgactatacttacgtcgtcggtcgacgacgaccggtcccgtaggacgaggtcgtagtaggtcggaggtcgggacgtacgtccggtacggttagggtaggtcggggtcggacgtacgtaacggtaccggtacgacgtaacggtaacggttacggtttccgggacggggtcccgtaccggttaacccaccgtacggtacgggtaacccggtaacgggtccgacccgggttaaccgtaacgaaacgttacgaagttacggttaagtacggtacgggttactacgggacgtaccgtacgtcccggttaggtacggtaccgttagaacccggaccggtaccgtacggtactttaggtaagtttacggttcggtaccggacggtaacggacggtaacgggacgggtaactaagggacctaggttaaccgggtcggttaaccccggg

SEQ ID NO: 226190 - DNA, 870 bp, Homo sapiens
  misc_feature: GYAE6OF02FG500.19.86.H09.1.454.CMB.1.raw
  modified_base (118)..(118): a, c, t, g, unknown or other
  misc_feature (118)..(118): n is a, c, g, or t
  modified_base (130)..(130): a, c, t, g, unknown or other
  misc_feature (130)..(130): n is a, c, g, or t
  modified_base (202)..(202): a, c, t, g, unknown or other
  misc_feature (202)..(202): n is a, c, g, or t
  modified_base (786)..(786): a, c, t, g, unknown or other
  misc_feature (786)..(786): n is a, c, g, or t
tcagtactctcgtgcacgaccggtgctcgattagtgctatagacttgggtttgggggaagaggaagactgacggtccactccaggtgcagctggtgcagtctggggctgagtgaaggngcctggggcctnagtgaaggtctcctgcgtaaggtcttttggacttaccaccttcagtccattatcagtactactcgtgggtcncgaccacggccctggacaagggtcttgcgtggagtacgggtccgacttccgacgggttggttaacgtcgggttcggcgtaccgtacgtaaccgtcggaccacgtacggtacgtttccgaacgggggtcccgccggttaccaaccgaggttccgaaccgtaaacgggttccgtaccggttacccaaacccggtaataaccgtaacggtttcgtaactttaacgggtacgggtaaccttttcggaacgggttaccacggacccgttaggtacggttccgtaccgggaaccgtaacgacccgggacctaagttcgtaacttttagttcgggtcggtaccggaagggtccgaaacggggtaccggggtaactaaaccgggtactaaaaccggttaaagggtttcccgggttaacccccgggtaaaccccggttggggggtacccccgaaaggggggttaaccccttcggggtaaccccgtaaccccgttccgttaccccgtttaacgacccggttaccccacccgggttaaacccggacggggtaccccttaacgggttccccgggtttacccctaccccgggttccncccggttaccccgtcgtacccgtgaaccggcacccgtcccgtaccggacctcggaccaccggtcgccccgggacgttccgggcc

SEQ ID NO: 226191 - DNA, 586 bp, Homo sapiens
  misc_feature: GYAE6OF02HMHBQ.19.86.H09.1.454.CMB.1.raw
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
tcagtactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtcgtgggctgaggtgaaggagccgtggggcctcgagtgaaggtctccgtgcgtaggtcttttggatactaccgttcagtcattatcatatactcgtggtgcgacncggccccgtggacaaggctgagtggatagggcgatccgaggtggtagtggngcgnacgtacgtcgacacagtaacgttcgacgggccgtacgtcaccgagtacggacctaaacgggtcgaccgtaccaacgtaatactaaggttctaagtagtagtacgttagacgtacagtcctaggacgtcgtacgaccgtacgacggtactacgttgtattagttgtcgaggaggcggaacgggacggggtactaacgggacgtaaggtaaacggttcggtaccggtaccccggg

SEQ ID NO: 226192 - DNA, 762 bp, Homo sapiens
  misc_feature: GYAE6OF01AS1YY.10.58.F03.1.454.CMB.1.raw
tcagcatagtagtgcacgaccggtgctcgatttagtctgatcgagaagggaaaggggctgggagacgagcccagcactggaagtcgccggtgtttccattcggtgatcatcactgaacacagaggacctcaccatggagtttggctgaccttgggttttcttcgttgctctttaagaggtgtccagtgtcaggtcgcacgtcgtggtggagtcgtgggggaggcgtggtaccaggtccgtaggggacgtccccgtgacgacctcctcgtggtacgcacgtcccttcgtacggtacttcccgaacccgttcgaacggtaacccttatacgaccgtaactagaccccgttacggttcggggtttaccgacccgtagggtccccgtacggaccgggacgggtaaacggggggtccgtagggtaaggggttcgggtcggaaccgtaaggttaaactacgtacgtagtaacggttaggaacgtaacggtaaagttacgtagtaaacttaccgtacgacgttacggactcgaacggtacggaacggtaacgtacgttacctaacgtactaccgtacgacgtaacgacgtaactaaccgaacgaacctcgtaacggtctaaccgtaccgtaactaacgtaacgaaccgtcgaccgtaccgacgtaccggtacgggacggtacgtccgggtacttagtaacgttaacgtcgtaacggtaacggtaaacgggtagggttaacggttaacggttcggttaggttttaacggg

SEQ ID NO: 226193 - DNA, 507 bp, Homo sapiens
  misc_feature: GYAE6OF02IOQT2.10.58.F03.1.454.CMB.1.raw
  modified_base (298)..(298): a, c, t, g, unknown or other
  misc_feature (298)..(298): n is a, c, g, or t
tcagcatagtagtgcacgaccggtgctcgatttagtctgatcgagaagggaaaggggctgggagacgagcccagcactggaagtcgccggtgtttccattcggtgatcatcactgaacacagaggactcaccatggagtttgggctgacctgggttttctcgttgctcttttaagaggtgtccagtgtcaggtgcagctggtggagtcgtgggggagcgtggtccagcctgggagtccctgagctctctgtgcagcctctggattcaccttcaggacctatgcaatgcactgggttcnccaggcctccaggcaaggggctggagtggctgggcagttatatctaagtttgatggaagccaattaaactctacgcagactcgtgaaggcgatcacatctacagagagactcgagacgcactcttatgtaacaatagaactactagagacgactgacgacacgcgtgtacgtactactgtgcgagagtacgagggtggggggactcggg

SEQ ID NO: 226194 - DNA, 839 bp, Homo sapiens
  misc_feature: GYAE6OF02F45XV.10.58.F03.1.454.CMB.1.raw
  modified_base (219)..(219): a, c, t, g, unknown or other
  misc_feature (219)..(219): n is a, c, g, or t
tcagcatagtagtgcacgaccggtgctcgatttagtctgatcgagaagggaaaggggacgtgggagacgagcccagcactggaagtcgccggtgtttccattcggtgatcatcactgaacacagaggactcaccatggagttgggctgacctgggttttcttcgttgtctctttaagaggtgtccagtgtcaggtgcagctggtggagtcgtagggggngcgtggtccagccgtgggacggtccctagagacctctccgtggtcgcagcctctggacttccaacctttcgaggacctagtgactaagtcgctaacgttcgggttaccgccgtaggtcctaccgaggaccgaacgggggtccgttggggaacgggttcggggtaccgttacgggtaccgtaacggttttaagtaaccgtttacccgttaggtttttacggtaaagggttaccgggtaaaacggtaccccttaaaaggttaaaaacgtttaacccggttaaaccggcccgtaaaaacggttccccggtaacccgggttaacgggtaaaccgggggaccccggttaaacgttacccgtaaacccgtaccgtttacccgtacccgtaaacgggtaacgtaaaccgtaaaccggttacccgggaaacggtaaccggtaccggttaaaccctttaccggttttaaacgttaacgggttaaaacctaaaccggtaacgttaaaccgttaacccgtaacgtaacggtacgtacgtacgaccggtaacgaccggtacgtacgttacggtacctacggtgtacggtaccgtagtaccgtaggtacggggtacgggggggctacccgggg

SEQ ID NO: 226195 - DNA, 959 bp, Homo sapiens
  misc_feature: GYAE6OF02IWNAY.10.58.F03.1.454.CMB.1.raw
tcagcatagtagtgcacgaccggtgctcgatttagtctgatcgagaagggaaaggggctgggagacgagcccagcactggaagtcgccggtgtttccattcggtgatcatcactgaacacagaggactcaccatggagtttgggctgacctgggttttcttcgttgcttcttttaagaggtgtccagtgtcaggtgcagctggtggagtcgtgggggagcgtggtccagccgtggggacgtccctggacgtacctctccgtggtcgcacgccctgtgggtacttccacccgtttcgacggtaccctagtcgactaatcgactacgtgggttacgccgaggcctaccggagggacgaagggggtctagggaggtcggcgtacggacgtaaggttatagttcgtagttttaggaagtacggggaaactaccttaaaagtaaaaccgttacctaacggtaccgtaacggtaacccggtttacccgggtaacgggtaaaccgggggtacccgttaaacgtttacccgtaaaccccgttaacttacccggttaaacccggaaggtaaaccgggtaaaccggttaaaacccggttacccgggtaaaccggtaaacggtaccccgtttaacccgttttaaccggtttttaaacgttaaaccgggtttaaaaacccgttaaaaccggtttaaacccgttaaaacccgtttaacccggttaacgggtaaaccggttaaaccggttacccggttaaaccgggtaacccggtaaccccgggtaaccggggttacccgggttttaacgggtttaaccggtttaacccggtttaaccggtttaacggggttacccgggttaaaccggggttaacccggggttaaccgggtttacccggggggggttaaacgggggggggggtttaccccggggggggggggggttaaccccgttttaacccccggggggggg

SEQ ID NO: 226196 - DNA, 185 bp, Homo sapiens
  misc_feature: GYAE6OF01C9UXI.53.14.B03.1.454.CMB.1.raw
  modified_base (181)..(185): a, c, t, g, unknown or other
  misc_feature (181)..(185): n is a, c, g, or t
tcagcgcgtatacacacgaccggtgctcgatttagtgtgagtagttccgcgggcacgaccggtgctcgatttagtgtgagtagttccgcgggcacgaccggtgctcgatttagctctacgctcagggcacgaccggtgctcgatttagcagacgtctgagcgggctggcaaggcgcatagnnnnn

SEQ ID NO: 226197 - DNA, 122 bp, Homo sapiens
  misc_feature: GYAE6OF01D0TQI.53.14.B03.1.454.CMB.1.raw
  modified_base (108)..(108): a, c, t, g, unknown or other
  misc_feature (108)..(108): n is a, c, g, or t
  modified_base (122)..(122): a, c, t, g, unknown or other
  misc_feature (122)..(122): n is a, c, g, or t
tcagcgcgtatacacacgaccggtgctcgatttagtgtgagtagttccggtgagtagttccgcgggcacgaccggtgctcgatttagtctagcgacttcgaggcgtgngagaggcatagtgn

SEQ ID NO: 226198 - DNA, 202 bp, Homo sapiens
  misc_feature: GYAE6OF01BJM9F.53.14.B03.1.454.CMB.1.raw
  modified_base (105)..(105): a, c, t, g, unknown or other
  misc_feature (105)..(105): n is a, c, g, or t
  modified_base (134)..(134): a, c, t, g, unknown or other
  misc_feature (134)..(134): n is a, c, g, or t
  modified_base (136)..(136): a, c, t, g, unknown or other
  misc_feature (136)..(136): n is a, c, g, or t
  modified_base (141)..(141): a, c, t, g, unknown or other
  misc_feature (141)..(141): n is a, c, g, or t
  modified_base (155)..(202): a, c, t, g, unknown or other
  misc_feature (155)..(202): n is a, c, g, or t
tcagcgcgtatacacacgaccggtgctcgatttagtgtgagtagttccgcgggtcgacgaccggtgctcgatttagtcgagctctctcgcgggcaccgaccggtnctcgattttagtatctgatagttgggtcngngcggntgacaggcatatgnnnnnnnnnnnnnnnnnnnnnnnnnnnnnnnnnnnnnnnnnnnnnnnn

SEQ ID NO: 226199 - DNA, 170 bp, Homo sapiens
  misc_feature: GYAE6OF01CAUVZ.53.14.B03.1.454.CMB.1.raw
  modified_base (168)..(170): a, c, t, g, unknown or other
  misc_feature (168)..(170): n is a, c, g, or t
tcagcgcgtatacacacgaccggtgctcgatttagtgtgagtagttccgcgggactactcacactaaacccaagagagatcgtgacgcagctaaatcgagcaccggtcgtggcctggtcaaggactacttcctcgtactgcgctgagcgggctggcaaggcgcatagnnn

SEQ ID NO: 226200 - DNA, 168 bp, Homo sapiens
  misc_feature: GYAE6OF01BT9DX.53.14.B03.1.454.CMB.1.raw
  modified_base (168)..(168): a, c, t, g, unknown or other
  misc_feature (168)..(168): n is a, c, g, or t
tcagcgcgtatacacacgaccggtgctcgatttagtgtgagtagttccgcgggactactcacactaaacccaagagagatcgtgacgcagctaaatcgagcaccggtcgtggcctggtcaaggactacttcctcgtactgcgctgagcgggctggcaaggcgcatagn

SEQ ID NO: 226201 - DNA, 120 bp, Homo sapiens
  misc_feature: GYAE6OF01CSSRY.53.14.B03.1.454.CMB.1.raw
  modified_base (114)..(114): a, c, t, g, unknown or other
  misc_feature (114)..(114): n is a, c, g, or t
  modified_base (120)..(120): a, c, t, g, unknown or other
  misc_feature (120)..(120): n is a, c, g, or t
tcagcgcgtatacacacgaccggtgctcgatttagtgtgagtagttccgcgggtagttccgcgggcacgaccggtgctcgatttagcagacgtctgacgcgggctggcaaggcncatagn

SEQ ID NO: 226202 - DNA, 155 bp, Homo sapiens
  misc_feature: GYAE6OF02INEGX.53.14.B03.1.454.CMB.1.raw
  modified_base (130)..(130): a, c, t, g, unknown or other
  misc_feature (130)..(130): n is a, c, g, or t
  modified_base (132)..(132): a, c, t, g, unknown or other
  misc_feature (132)..(132): n is a, c, g, or t
  modified_base (138)..(138): a, c, t, g, unknown or other
  misc_feature (138)..(138): n is a, c, g, or t
  modified_base (148)..(148): a, c, t, g, unknown or other
  misc_feature (148)..(148): n is a, c, g, or t
  modified_base (154)..(155): a, c, t, g, unknown or other
  misc_feature (154)..(155): n is a, c, g, or t
tcagcgcgtatacacacgaccggtgctcgatttagtgtgagtagttccgcgggcacgaccggtgctcgatttagtcgagctctctcgcgggcacgaccggtgctcgatttagtatctgatagttgggttngnggcggngtgagaggcntatagnn

SEQ ID NO: 226203 - DNA, 154 bp, Homo sapiens
  misc_feature: GYAE6OF02HN68S.53.14.B03.1.454.CMB.1.raw
  modified_base (127)..(128): a, c, t, g, unknown or other
  misc_feature (127)..(128): n is a, c, g, or t
  modified_base (130)..(154): a, c, t, g, unknown or other
  misc_feature (130)..(154): n is a, c, g, or t
tcagcgcgtatacacacgaccggtgctcgatttagtgtgagtagttccgcgggctggcaaggcgcatagctgcctggtcaaggctacttcctcgtactgcgctgagcgggctggcaaggcgcatagnncnnnnnnnnnnnnnnnnnnnnnnnnn

SEQ ID NO: 226204 - DNA, 106 bp, Homo sapiens
  misc_feature: GYAE6OF02HIFER.53.14.B03.1.454.CMB.1.raw
tcagcgcgtatacacacgaccggtgctcgatttagtgtgagtagttccgcgggcacgaccggtgctcgatttagcagacgtctgagcgggctggcaaggcgcatag

SEQ ID NO: 226205 - DNA, 146 bp, Homo sapiens
  misc_feature: GYAE6OF02JULX9.53.14.B03.1.454.CMB.1.raw
  modified_base (144)..(146): a, c, t, g, unknown or other
  misc_feature (144)..(146): n is a, c, g, or t
tcagcgcgtatacacacgaccggtgctcgatttagtgtgagtagttccgcgacacgaccggtgctcgatttagtgtgagtagttccgcggcacgaccggtgctcgatttagcagacgtctgagcgggctggcaaggcgcatagnnn

SEQ ID NO: 226206 - DNA, 167 bp, Homo sapiens
  misc_feature: GYAE6OF02HSGM6.53.14.B03.1.454.CMB.1.raw
tcagcgcgtatacacacgaccggtgctcgatttagtgtgagtagttccgcgggactactcacactaaacccaagagagatcgtgacgcagctaaatcgagcaccggtcgtggcctggtcaaggactacttcctcgtactgcgctgagcgggctggcaaggcgcatag

SEQ ID NO: 226207 - DNA, 106 bp, Homo sapiens; identical to SEQ ID NO: 226204
  misc_feature: GYAE6OF02HWBKL.53.14.B03.1.454.CMB.1.raw

SEQ ID NO: 226208 - DNA, 183 bp, Homo sapiens
  misc_feature: GYAE6OF02H4A8L.53.14.B03.1.454.CMB.1.raw
  modified_base (143)..(143): a, c, t, g, unknown or other
  misc_feature (143)..(143): n is a, c, g, or t
  modified_base (169)..(183): a, c, t, g, unknown or other
  misc_feature (169)..(183): n is a, c, g, or t
tcagcgcgtatacacacgaccggtgctcgatttagtgtgagtagttccgcgggactactcacactaaacccaagagagatcgtgacgcagctaaatcgagcaccggtcgtggcctggtcaaaggactacttcctcgtactgcntgagcgggctggacaaggcgcatagnnnnnnnnnnnnnnn

SEQ ID NO: 226209 - DNA, 506 bp, Homo sapiens
  misc_feature: GYAE6OF01BKK7T.53.38.D05.1.454.CMB.1.raw
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
tcagcgcgtatacacacgaccggtgctcgatttagtatctgatagttgggtttgggctgtgggtccaggaggcagaactctgggtgtctcaccatggcctggatccctctacttctccccctcctcactctctgcacaggctctgagcctcctatgaggtgacacagccaccctcggtggtcagtgtcccacggacagacggccgaggatcacctcgctctggagaggcattggcaaaacaatatggatattggtaccggcagaagcaggccaggccctcgtgttggtaatatataaagacagggagaggccccaggatccctgagcgatactctggctccagctcagggacaacagtcacattgaccatcagtggacgtccaagggcaagaaagacgagctnactattacngtcaatcngcgganagnagtgttctnatgtgtatggcgagggacagctgacccgtcgtaggtcagcccccgaaggtactcgccccccgtggtac

SEQ ID NO: 226210 - DNA, 515 bp, Homo sapiens
  misc_feature: GYAE6OF01CHFTD.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaaacatatggatattggtaccggcagaagccaggccaggcccctgtgttggtaatatataaagacagggagaggccccagggactccctgagcgatactctggctccagctcagggacaacagtcacattgaccatcagtgagtcaggcagaagacgagctagactatactgtacaatctgcgacagcagtgttctctagtgtgtacgttcggcggaggaccaagtcgtagaccggttctaggtcacgcccgaacggcctacgcccccgtggtacccg

SEQ ID NO: 226211 - DNA, 507 bp, Homo sapiens
  misc_feature: GYAE6OF01D1XQ5.53.38.D05.1.454.CMB.1.raw
  modified_base (452)..(452): a, c, t, g, unknown or other
  misc_feature (452)..(452): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaaacaatatggatattggtaccggcagaagccaggccaggcccctgtgttggtaatatataaagacagggagacggccccagggatccctgagcgatactctggctccagctcgagggacaacagtcacattgaccatcagtggagtcaggcagaagacgaggctagactattactgtacaatctgcgacagcagtgtctcatgtgtagttcggnggaggaccaagctagaccgtcgtaggtcacgcccaaggcctcgccccgtggtccc

SEQ ID NO: 226212 - DNA, 552 bp, Homo sapiens
  misc_feature: GYAE6OF01D8VSZ.53.38.D05.1.454.CMB.1.raw
  modified_base (262)..(262): a, c, t, g, unknown or other
  misc_feature (262)..(262): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtcccccaggacagacggccaggatcacctgctctggagaggcattggacaaaaacatatggatattggtaccggnagaagccaggccaggcccctgtgttggtaatataataaagacagggagacggccccagggactccctgagcgatactcgtggctccgagctacgagggacaaacagtcaacattgaccatcagtggagtccaggcaagaagacgagctagactattacngtacatctgcgangacagtgttctactagttgtaggtacgttcgggacggacgggaccgaaggtcgtacggacccggttaccgtaggtaccacgaccccgaaggcccgtcccggcccccgtcgggtacccg

SEQ ID NO: 226213 - DNA, 503 bp, Homo sapiens
  misc_feature: GYAE6OF01EWGLQ.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacatatggatattggtaccggcagaagccaggccaggcccctgtgttggtaatatataaaagacagggagaggcccccagggatccctgagcgatactctggctccagctcagggacaacagtcacattgaccatcagtggagtccaggcagaagacgagctgactattactgtacaatctgcggacagcagtgttctcatgtggtatcggcggaggaccaagctagaccgtctaggtcacgcccaaggctcgcccctgggtacc

SEQ ID NO: 226214 - DNA, 539 bp, Homo sapiens
  misc_feature: GYAE6OF01DR0CF.53.38.D05.1.454.CMB.1.raw
  modified_base (404)..(405): a, c, t, g, unknown or other
  misc_feature (404)..(405): n is a, c, g, or t
  modified_base (429)..(429): a, c, t, g, unknown or other
  misc_feature (429)..(429): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagcccaccctcggtgtcagtcgtccccaggacagacggccaggatcacctgctctggagaggcagttggacaaaacatagtggatattggtaccgcagaagcaggccaggcccctgtgttggtaatatataaagacagggagacggcccgagggactcccgtgacgcgatactcgtgctcagctcgagggacaacagtcacattagaccatcagtcgagtcgaggcagaagacgagnngactatactgtacatctgacgacngacgtgtcgttctctagttggtaggtagttcgggacgggtacggacaacggctacggacccgtcgtacggtaccacggtacccgtacggctcccgccccgtcggtacccg

SEQ ID NO: 226215 - DNA, 781 bp, Homo sapiens
  misc_feature: GYAE6OF01C67RB.53.38.D05.1.454.CMB.1.raw
  modified_base (126)..(126): a, c, t, g, unknown or other
  misc_feature (126)..(126): n is a, c, g, or t
  modified_base (128)..(128): a, c, t, g, unknown or other
  misc_feature (128)..(128): n is a, c, g, or t
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
  modified_base (414)..(414): a, c, t, g, unknown or other
  misc_feature (414)..(414): n is a, c, g, or t
tcagcgcgtatacacacgaccggtgctcgatttagtatctgatagttgggtttggggctgtgggtccaggaggcagaactctgggtgtctcaccatggcctggatccctctacttcccctccctcncnctctcnacagngtctcgtggaccgtcctactagtaggagtacgaaccaacgccgacccctacccggttcggttcgtacgtacggttccccggtaccccggaacggaaccggaaccgggacccggaccggaaggtactacccgtacgtcgtccgttggaagggaggacgtacttacggtaacgaaaacctaaaatagttagtaggtaattacggttaccgggaaccgagaagaccgacgaccggccgaccggtccgttggtaggttaagtaataagtaagaaacggnggaggacggcccggaccggaggtaccctcgaggacgtacgtaacttcgtcggcgtaccgtacgcgtacgacgggaaacgaaacgaacgtcgtactaacttacgacaacgtagacggtaggtacgccgtaacgacgtacggaaaggacggaacgtcgtaacgtacgtaacgttaacgttacgtaccgtaacgtacgttcggacggaccgtaagcggttacggtgtttacccgtagtagttacggttagggttacgtacggggtacgggaaccgggtaccgtaacggacgttaccggtacccggtaccgtcggtacggacccgtaacccgacggttccgacccgggtccccctccgggttcgtaccccg

SEQ ID NO: 226216 - DNA, 584 bp, Homo sapiens
  misc_feature: GYAE6OF01A5NZE.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtcgtccccaggacagacggccaggatcacctgctcgtggagaggcagttggacaaaaacatatggaatattggtaccggcagaagcaggccagccctgtgtgtaatatataaagacgagggagacggccccgagggactcccgtgagcgatactcgtggcctaccgagcctacgagggaacaaacgagtaccaactattacgaaccatacgaggtacggacgtaccaggacaaggaaagacggaggctaggaacttattacgtgtactaatcgtggacggacagcgtaaggtcggttacctacgtatggttaggttacgttcgggacggtacggaaccgtaggccgtacgacccggtcgtaaggcgacgacccgaacggcctccgccccgtcggtaccc

SEQ ID NO: 226217 - DNA, 708 bp, Homo sapiens
  misc_feature: GYAE6OF01DFHSH.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtcgtccccaggacagacggccaggatcacctgcctctggagaggcattggacaaaaacaatatggatattggtaccggcagaagccaggccaggcccctgtgttggtaatataataaagacgagggagacggccccgagggactcccgtgacgcgaatactcgtggcctccgacgctcgagggaacaacagtcactattacgaaccatcgaggtggacgtccgaaggcgaagaaaggacggaggactagtaactaattaccgtagtacctaatcgtaggaccgggtaacgaacgtaccgtaaggtttccgggtttactaccgtaagtttcgggttagggttaacggtttacccggggacgggtaaaccggggtaaacccgaaacgggttacccggttaaccgggttaacccccggtttcccggtttaaacggggttaccccgaaacccgggtaccccccggtaaaacgggtcccggttacccccgggtcccccccccggtttaccggggtttaaaccccccgg

SEQ ID NO: 226218 - DNA, 665 bp, Homo sapiens
  misc_feature: GYAE6OF01DDB0B.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgaggcctcctatgaggtgacacagcccaccctcggtgtcagtcgtccccaggacagacggccaggatcacctgctctggagaggcattggacaaaacaatatggatattggtaccggcagaagccaggccaggcccctgtgttggtaatataataaagacgagggagacggccccgagggactcccgtgacgcgaactactcgtcggcctaccgacgtctacgaacgggaacaaacgacgtacactattacgaccctataccgaggtagggacgtcccgaagggaccaaaggaaacggacggaagggtactacggtaacttaattaaccgttagtactaacgttacgtacggacggaacgaaggtcgtaaggtttcggttaccttacgtagttggttagggttacggtttccggggaccgggtaacggggtaaccgaacggtccgtacggtacccggttccgtacgggtaccgaccggtaccccgaacgggccttcccggccccccgttcggtaccccg

SEQ ID NO: 226219 - DNA, 596 bp, Homo sapiens
  misc_feature: GYAE6OF01BMJG6.53.38.D05.1.454.CMB.1.raw
  modified_base (345)..(345): a, c, t, g, unknown or other
  misc_feature (345)..(345): n is a, c, g, or t
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgaggcctcctatgaggtgacacagcccaccctcggtgtcagtgtccccaggacagacggccaggatcacctgctctggagaggcattggacaaaaacatatggatattggtaccggcagaagccaggccaggcccctgtgttggtaatatataaagacgagggagacggccccgagggactcccgtgacgcgatactcnggctccagctcgagggacaacgagtcacattcgaccatcagtggagtccgagcaagaagacgaggctgaacttattactgtacaatcgtgacggaacaagcgtaggttggttctacgtagttggtaggttacgttcgggacgggtacgggtaaccggaaggtccgttacgggaccccggttccgtaaccgggttccgaaccggtaccccgtaacgggcccgttcccggtcccccccggttcggtacccccg

SEQ ID NO: 226220 - DNA, 614 bp, Homo sapiens
  misc_feature: GYAE6OF01EWY8D.53.38.D05.1.454.CMB.1.raw
  modified_base (442)..(442): a, c, t, g, unknown or other
  misc_feature (442)..(442): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcagttggacaaaacaatatggatattggtaccgcagaagccaggccacggccctgtgttagtaatatataaagacgagggagacggccccgagggactccgtgagcgatactcgtggctcacgctacgagggacaacgagtcacattcgacatcgagtggacgtacgaggcaagaagacgaggctagactattactgtactaactctcggacganacgacgtaggttcggttacttcgtaagttggttagggttacgttccgggggacgggtaaccgggaaccggtaacggtaccggttacgggtaacccgttacccggtaacggttccgaaacccgggtccccggaaacggtcccgtaccccggtcccccgtacccggttaccccg

SEQ ID NO: 226221 - DNA, 586 bp, Homo sapiens
  misc_feature: GYAE6OF01CB9SS.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacaatatggatattggtaccggcagaagccaggccaggcccctgtgttggtaatatataaagacagggagaggccccgagggactccctgagcgatactctggctccagctcagggacaacagtcacattgaccatcagtggagtccaggcagaagacgaggctaggactattactcgtacaatcgtgaccggtacaacgcgtagttcgggttcctacagttggttaggttacgttcggggacgggtacggggaacccaaagggtccgttacggtacccggttcccgtacgggtccaaccgggtccccgaaacgggtcccgtacccggtccccccgtacggttccccg

SEQ ID NO: 226222 - DNA, 754 bp, Homo sapiens
  misc_feature: GYAE6OF01D0QPU.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgacggcctcctatgaggtgacacagccaccctcggtgtcagtcgtccccaggacagacggccaggatcacctgcctcgtggagacggctagttcggaacaaaaacaatacgtaggattaagttcgggtaaccggacaaggaacgccgacggccacggtccccttgggttagttacggtaaattaataaagtaaaacggacggaagggggaccggaccccggacgggacgtcccgtaggacgacgtaacgtaccgtacgtcggtacctccgacgacgtacgaacggaccaaacgacgtacaactacgtacgactaacgtactacggtaggtacgtaccgacggacgaacggtaaacggaacgacggtactacggtaaccgttacgttacgttacgttactaacgttccgtacggaccggtacgaacgtacgtacggttacggttaccgttacgtaggtttacggttagggttacggttacggggaccgggtaacgggaaccgtaacggtacggtcccggttaaacccggttccggttaaccgggtaccgtaaccggtacccgtaccgggtacccgttccccggacccccggttcggtacccgtaccccg

SEQ ID NO: 226223 - DNA, 522 bp, Homo sapiens
  misc_feature: GYAE6OF01B5CN1.53.38.D05.1.454.CMB.1.raw
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtcccccaggacagacggccaggatcacctgctctggagaggcattggacaaaaacatatggatattggtaccggcagaagccaggccaggcccctgtgttggtaatatataaagacagggagacggcccccgagggatccccgtgagcgatactctggctccagctcgagggacaacagtcacattgaccatcagtggacgtccgaggcaaggaagacgaggctagactattactgtacatctgcgacngctagtgttctnatgtggtatcgggcggagggaccagcgtcgaccgtcctaggcacggcccaggcctccgcccccgtcggtacccg

SEQ ID NO: 226224 - DNA, 511 bp, Homo sapiens
  misc_feature: GYAE6OF01A1A8C.53.38.D05.1.454.CMB.1.raw
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (451)..(451): a, c, t, g, unknown or other
  misc_feature (451)..(451): n is a, c, g, or t
  modified_base (498)..(498): a, c, t, g, unknown or other
  misc_feature (498)..(498): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcagttggacaaaaacgaatatggatattggtaccggcagaagccaggccaggcccctgtcgttggtaatatataaagacgagggagacggccccgagggactcccgtgagcgatactcgnggctccagctcgaggacaacngtcacatcgaccatcagtggagtccgaggacgagaagacgaggctagactattactcgtacatcgtgcggacagcagtgttcnagtgtgtgtggcggaggacagcgtgacgtcgtagtcacgccgagccncgccccgtggtcc

SEQ ID NO: 226225 - DNA, 776 bp, Homo sapiens
  misc_feature: GYAE6OF01B9QSP.53.38.D05.1.454.CMB.1.raw
  modified_base (246)..(246): a, c, t, g, unknown or other
  misc_feature (246)..(246): n is a, c, g, or t
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgaggcctcctatgaggtgacacagccaccctcggtgtcagtcgtccccaggacagacggccaggatcacctgctctggagaggcattggacaaaacatanggatattggtaccggcagaagccgaggccaggcccctgtgttggtaatatataaagcgagggagacggccccgagggactcccgtgacgcgatacgtcgtacggctccgagctaccgaacgggaaccaactagtaccaacgtacgtttcgaaaccctagttaccgaagggttacgggacgttacccgaacgggtaccgaagggtaaaccggaacgggacgggtaacccttagggtaaaccctttaagttttaacccgtacggttaacctaaacgtttaccggttacgggaccgggaacgtaaccgggcgttaacggggtttaccgggttttacctcccggttaaggtttacgggtttacggggttaaccggtttaccggggggaccggggttaaacccggggaacccgttaaacgggtccggttaacccgggtaacccccggttccggttaccgggtaacccgtaacccggtaccccggtaaacggggtcccgttaccccccggccccccggtttcccggggttaacccc

SEQ ID NO: 226226 - DNA, 660 bp, Homo sapiens
  misc_feature: GYAE6OF01DKXKW.53.38.D05.1.454.CMB.1.raw
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgaggcctctatgaggtgacacagccacccgtcggtgtcagtcgtcccaggacagacgccaggatcacctgctcgtggagaggctattggacaaaanaatntaggatattggtaccggcagaacgcaggcacggcccctgtgttaggtaatataagtaaagacgagggacgacggaccccgagggactcccgtagacgacgtactacgtcgtcggcctaccgagccctacggacgggaactaaacgacgtaccacgtactttacggaaccctagtacgtaaggtaggaaccgttcccgaaggggaccaaagggaaacggtaaccgggaagggtaccgtaacggtaacgttaacgtttaaacgtacggtaactaacgttacgttacggaccgggaacgtaggacctaggttcgttactcgtagttagtggttacggtcggacggacggaccgaagcgttacggaccgttccgacggtaccgacgacccgtaacggccctaccgccccgtgtacccg

SEQ ID NO: 226227 - DNA, 798 bp, Homo sapiens
  misc_feature: GYAE6OF01C2QZK.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgagcctctatgaggtgacacagcccacctggtgtcagtcgtcccaggacagacgcaggactcactgctcgtggagacggctagttcggaacaaaaacagtagtaggaattaagttacgggtaaccggacgaaggaacgaccgagggacccgacgggtcccccgttaggttcggtttaagggttaaattaagttaaagttaaaacggaacggaaggggaacggaaccgggacccccggaaggggtacctacccgtaggaacggtacgaacgttaccgtcgtacggccttccgacgtaccgtacggaacgggaaacaacgtacgtaccacgtacgtttacgaacctagtacgtaagggttacggacgtaccggaacggaacgaacggaaaggaacggaggtaccgttaaggtaacttaagtttaccgtacgtaaccgtaagtttcgtaagggacccggtaacgacggtacgttaacggtttcgttaccgtaacgtggtttaagggttacgggttaacggttccggggaacgggtaaccggggtaaccgtaacgggtaccgttaccgggtaccccggttacggtaacccgggtaccgtaacccggtacccgtaaccgggttccgtaaccccggtcccccggttacggttacccccg

SEQ ID NO: 226228 - DNA, 647 bp, Homo sapiens
  misc_feature: GYAE6OF01D6Z8X.53.38.D05.1.454.CMB.1.raw
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (371)..(371): a, c, t, g, unknown or other
  misc_feature (371)..(371): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacaatatggatattggtaccgnaganccagccagccctgtgttggtaatatataaagacgagggagacggcccccgagggactccccgtgacgcgtatacctctcggctccgagcctacgagggaacaaacgngtacactattacgacctagtaccaggtggacgtcccgaaggcaaggaaagacggaggtactacgaacttatttactgtactaacgtcgtcggacggtacaagtcgtaacggttcggttctagtaagttggttacggttaacggttccgggaccggggtaacgggtaaacccgtaacgggtcgttaaccgggtaccccggttccggttaacgggtccaacccgggaccccgtaaacgggtccccgttaccccggccccccgttcgggttaacccccg

SEQ ID NO: 226229 - DNA, 673 bp, Homo sapiens
  misc_feature: GYAE6OF01EAXUQ.53.38.D05.1.454.CMB.1.raw
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagcccaccctggtgtcagtcgtccccaggcagacggccaggatcacctgctcgtggagaggcagttggacaaaanatagtggatattggtaccgnagagccaggccaggcccctgtgttggtaatatataaagacagggagacggccccgagggactccccgtgacgcgaatacttcgtggcctccacgcctacgagggaacaaaccgagtacacgtattacggaacctatccgtaaggtggaacgttacccgaagggactaaggaaagacggacggacgtacggacttaagttacgtagtactaattcgtcggtacggacgaaggtccgtaaggtttcgggttacgttcgtaagttcggttagggtttaacgttccggggtacgggtaacggggtaaccgtaagggtacccgttaccgggttaacccggttcccgtaacgggttacccgaaccggtaccccgtaaacgggtccctaccccgggtccccccgtacgggtacccccg

SEQ ID NO: 226230 - DNA, 601 bp, Homo sapiens
  misc_feature: GYAE6OF01DPPHW.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgaggcctcctatgaggtgacacagcccaccctcggtgtcagtcgtcccaggacagacggccaggatcacctgctctggagaggcagttgacaaaacaatataggattaattggtaaccggcaagaacgccaggccaacggcccctgtgttacggttaataataataaagacgagggaggacggccccgagggactccctgagcgaatactctgctcagctcgagggacaacagcactatcgaacatcaggtggagtccgaggcaagtaaacgacggagactagacttagttactgtacaatcgtcgcgtagacgcgtagttacggttcttacgagttggttacgggttgtttcgggacgggtaacgggaccgaacgccgttcgggacccgttaccggtacggtccgaacgtacccgtaaacgggcccttaccccggtccccgtcggttaaccccg

SEQ ID NO: 226231 - DNA, 666 bp, Homo sapiens
  misc_feature: GYAE6OF01CVWY9.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtcgtccccaggacagacggcaggatcacctgctctggagaggcagttggacaaaacatatggatattggtaccggcagaagccaggccagcccctgtgttaggtaatatataaagacgagggagacggaccccgagggactccctggacgcgactactcgtcggctccagctcgacgggacaacgagtaccacattcgaaccctagtacgtaggtacggtacgtaccgtaagggaccgaaggtaaacggacggaaggtaccgtacggtaacttaactttaaccgttagtacctaacttcggtacggtaccggacgtaacgacgtaaggtttcgggttcctagttacgttgtacgggtttagtcggggtaccggaggggtaacccgaacggtccgtaccgggtacccgtaccggttacgggtacccaacggtaccccggtaaaccggtcccgttaacccggtcccccgttccgggttacccc

SEQ ID NO: 226232 - DNA, 651 bp, Homo sapiens
  misc_feature: GYAE6OF01D4R5N.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagcccaccctcggtgtcagtcgtccccaggacaggacggccaggactcacctgctcgtggagaggctattggacaaaacatatggatattggtaccggcagaagccaggccacggcccctgtgttggtaatatataaagacgagggacgacggccccgagggactcccgtagacgacgatactcgtcggctccgagtctacgaagggacaacgagtcactattcgaaccatacaggtcggacgtaccgaggacgaaggaaagacggaaggtcgtagtaacttatttaccgtagtactaattcgtaggaccggtaacgacgtacgtaggtttcggtttacttacgtagttacggttaggttaccggttacggggacgggtaaccgggaaccgtaaacggtccgtacggtaccccggttaccggtacgggtaccgaaccggtacccgtaacgggcccttccccggtcccccgttcggttaaccccg

SEQ ID NO: 226233 - DNA, 689 bp, Homo sapiens
  misc_feature: GYAE6OF01CQ0BX.53.38.D05.1.454.CMB.1.raw
  modified_base (274)..(274): a, c, t, g, unknown or other
  misc_feature (274)..(274): n is a, c, g, or t
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgaggcctcctatgaggtgacacagccacccgtcggtgtcagtcgtccccaggacagacggcaggatcactgctcgtggagaggctagttggaacaaaactaatagtggaattagttcgggtaccgganagaacgccgacgaccgacggcccctggttcgttaggtaataacgttaaagtaaagacgaagggacgaaccggaccccggtaagggacctcccgtagacgacgaacgtacgtcgtcgctcgagacctacgagggacaacgacgtacactactcgaacctagtacgagggtacgtacggtaccgaaggtacgaaaggaacggacggacgtacgtacgtaacgtacttaaccgtagtacgaacgttcgtacggaccggacgaacgtacgtacggtttaggtcctagtagtggttacgggttacggtcggggacgtaacgggaccgtagggtaacccgtaggtacccggttaccgtacggtacctaaccgggaacccggttaacggcccgttccccggtaccccggtccgttaaccccg

SEQ ID NO: 226234 - DNA, 677 bp, Homo sapiens
  misc_feature: GYAE6OF01B9Z4X.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagcccaccccgtcggtgtcagtcgtcccccaggacaggacggccaggatcacctgctcgtggagaggcagttggacaaaacaatagtggattagttacggtaccggacagaacgccgacggccacggtcccctggtgttaggtaataagtaagtaaaacgacgaggggaacgaccggacccccgaagggactcccgtggagcgacttacctacgtggctccgacgctacggaacgggaaccaacgacgtacaactagttcgaaccgtatcgtaggtcggaacgttcccgagggacgaaggtaacggacgaggtctaagtacttaattcgtgtactatcgcggacgacgcggtacgtaggttcgttcgtattagtacggttaggttacggtcgggacgggtacggaaccgtacggtccgttaccggtacccggttacccgttagggtaaccccgaccggtaacccggaaccggttcccggtacccggtcccccccgtcgggttaacccccg

SEQ ID NO: 226235 - DNA, 725 bp, Homo sapiens
  misc_feature: GYAE6OF01DJFT5.53.38.D05.1.454.CMB.1.raw
  modified_base (87)..(87): a, c, t, g, unknown or other
  misc_feature (87)..(87): n is a, c, g, or t
  modified_base (168)..(168): a, c, t, g, unknown or other
  misc_feature (168)..(168): n is a, c, g, or t
  modified_base (276)..(276): a, c, t, g, unknown or other
  misc_feature (276)..(276): n is a, c, g, or t
tcagcgcgtatacacacgaccggtgctcgatttagtatctgatagttgggtttggggctgtgggtccaggaggcagaactctgggtntctcaccatggcctggactccctcttacttcctccccctcctcactctctgcacaggctctgacggccttcctatgaggtnacacacgcccacccgttggtgttcagtgtcctccgaggaccagaccggccaggtactccgacctggccttacgtgggagaggctagttcggaaaccaaaatagttagngattagttacggtaccggacaagaacgccgacggacccgacggtccccgtagttaggtttaaggtaacttaataaagtaaggaacgaagggacgaccggaccccgtaagggacttcccggagacgtacgaacttactcgtacgtcctaccaggctacgaacgggaacaactacgtcgactacgtttacgaactacgtacagggtacgtactacccggaaggaccaaaggtaacgacggaacgggtcctacgtaacctttaaggtactcgtaacgtaagccgttagggaccgtaacgaggaccggtacgtttcgttacgtactttacggttaaggttcggttaaacggtttcggggacgggtaacggtaaccgaccggtaggtaccggtaccgttacggtacggtacggacccgtaaccggaccgttccgtccccggcccgttacccggg

SEQ ID NO: 226236 - DNA, 750 bp, Homo sapiens
  misc_feature: GYAE6OF01CWW2T.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctggacggcctcctatgaggtgacacacgcccaccctcggtgtcagtcgtcccccgaggacaggacggccaggactccacctgctcgtgggagaggacagttggaacaaaacgatagtaggattagttcggtaccggacgaaggaacgccgacggccgacggtccccgttggtggttacggtaattaagtaagaaaacgacggaaggggacggaccggaccccggaagggtaccgtcccgtaggacgcgtaacgtaccgtacgcggtcctaccgacggtacctacggaacgggaaccaaacgacgtaccacgtaacgttacgtacctagtacgtagggttacggtaccggtaccgacgggaaccgtaaggaaaccggacggtaacgggtactacggtaacgttacgttacgtacgttactaacgttccgtagggaccggtaacgacgtacggtacggttacgttcctaagttaggttggttacgggttacggttaccggggcgggaacggaccgtacggtcccggtaacgtacccggttcggttaccggtaccgaccgggtaccccgtaacgggtcccgacccccggttcccgtccggttaccccg

SEQ ID NO: 226237 - DNA, 740 bp, Homo sapiens
  misc_feature: GYAE6OF01CZXAT.53.38.D05.1.454.CMB.1.raw
  modified_base (289)..(289): a, c, t, g, unknown or other
  misc_feature (289)..(289): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (468)..(468): a, c, t, g, unknown or other
  misc_feature (468)..(468): n is a, c, g, or t
  modified_base (489)..(489): a, c, t, g, unknown or other
  misc_feature (489)..(489): n is a, c, g, or t
  modified_base (511)..(511): a, c, t, g, unknown or other
  misc_feature (511)..(511): n is a, c, g, or t
tcagcgcgtatacacacgaccggtgctcgatttagtatctgatagttgggtttggggctgtgggtccaggaggcagaactctgggtgtctcaccatggcctggatccctctacttcctcccctcctcactctctgcacaggctctgacggcctcctatggaggtgacacgacgcccacccgtggtgtcagtccgtacccgaggacacggacggccaggactccaccgtgcgttacgaggaggaggctagttacggactaaaacatagtaggtattagttacggaccggnaagacgacgacggccgaccggccttggtcgtaggtaataataagtaaacgacggtaagggacgaccggaccccgaaggtacctacccgtagaggtcgaacttctcgtacggcctcgagtaccncggaaggaacaacgtanacgtaactgttacgactagtacgaggtcgaacgtacggngacgtaagaacggacgacggnttaacgtaccttaagtacgtanacgtaacgtcgtcggtaacgacgacgtacggtaggtttacccgttagaccgttaggtttacgggttacggttacggggttcgggtaaccgggggtaccggtaaaccgttcgggtaaacccgggttaccgggtaaccccggtttacgtaacccggggttaccgaaccccgggtacccgggtaaaccggtccccgggtttccccgaaaccccgggttcccgtttacccccg

SEQ ID NO: 226238 - DNA, 785 bp, Homo sapiens
  misc_feature: GYAE6OF01DQI5O.53.38.D05.1.454.CMB.1.raw
  modified_base (163)..(163): a, c, t, g, unknown or other
  misc_feature (163)..(163): n is a, c, g, or t
  modified_base (175)..(175): a, c, t, g, unknown or other
  misc_feature (175)..(175): n is a, c, g, or t
tcagcgcgtatacacacgaccggtgctcgatttagtatctgatagttgggtttgggctgtgggtccaggaggcagaactctgggtgtctcaccatggcctggatccctctacttcctcccctcctcactctctgcacaggctcgtgaggccctctagtgaggngacacacgcccncccgtcggtgtcagtccgacccgaggacacggccggcgaggacttaccaccgttgcctcggagggacgaggcgtagttacggaaaccaaaaatagtagtacggtattaaggttcggaccggacgaagaacggccgacgggaccacggtccccgtggttaggttaaggttaaataacgtaagtaaacggacggaacggggacggaccggaccccggtaaggaccgtcccgtaggaacggacgtactaaccgtttcggacgtccgtacggtacgacgtaacggacggtaaaccaacgttacgaactaacgtacggtaccgtaacgtacgtcgtaacgggtacggacgtaacccggaggaccggtaaaggaaacgggacggacggtaaccgttactaaccggttttaaacttccggttaaagttaccgtaacgtcggtacggaccggtaacgttcggtaaccgttgggtttccgttaccttagggacgtttagggtacggtttaccgggttacgggaccggggtacaacggggtaacttccggtaccgtaacccggtacggtacgttaccgacccgttcgggaaccgtccggtcccctaccggtcggttaccc

SEQ ID NO: 226239 - DNA, 756 bp, Homo sapiens
  misc_feature: GYAE6OF01B83DV.53.38.D05.1.454.CMB.1.raw
  modified_base (183)..(183): a, c, t, g, unknown or other
  misc_feature (183)..(183): n is a, c, g, or t
  modified_base (223)..(223): a, c, t, g, unknown or other
  misc_feature (223)..(223): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgacggcctcctatgaggtgacacacgcccaccctggtntcagtcgtcccaggacagaccgcaggatcacctgcctcgnggagaggctagttacggaacaaaaacaatagtaggaatagttgggtaaccggacgaacggaacgaccgacggccgacgggtcccctaggttaggttacggtaataagtaaagtaaaagacggaaggggtaacggaccggacccccggaagggtactacccgtaggaacgtaccgaagtactcgtcggctaccgacgtccgtacgaacgggtaacaaacgtacggtacaaccgtaagttaccgaaccgtaacgttaccgaaggggttacggtaacggtaccgaacgggacgaaagggaaacggtaaccgggtaacggtacgttaacgtaaccgtttaatttaaccgttacgttaactacgttaccgtagggtaccggtactaacgtaaccgtacggttcgtttaccgtagtaacgttggtaccggtttacggtacggggaccgggtaaacgggaccgtaacggccgttaccggacccgttcgtaccggtacacccggtaccgaacggtcccgccgtcccccggtactaccccgg

SEQ ID NO: 226240 - DNA, 855 bp, Homo sapiens
  misc_feature: GYAE6OF01CH981.53.38.D05.1.454.CMB.1.raw
  modified_base (193)..(193): a, c, t, g, unknown or other
  misc_feature (193)..(193): n is a, c, g, or t
tcagcgcgtatacacacgaccggtgctcgatttagtatctgatagttgggtttggggctggtgggtccaggaggcagaactctgggtgtctcaccatggcctggatccctctacttcctccccctcctcactctctgcacgaggctctgacggtcctcctagtggaggtcgacacacgccctacccgtcggtntcgacggtccgtacccccgagggaccaacggaccggaccgaggtactccgaccgtggtccttggtagggaaggacggtacctaaggttcggaaaacaaaaactaagttagttagggaaattaggttacgggaacccggagaacggaaaccgcccggtaaccgggcccgtaaccgggtccccgtttgggtttaggttaaggttaaaattaacgttaaaacgaaaacgggacggaacggggaccggaccccgggaccccggtaagggtacccttaccgtacgggacgtacgtaacgttaccgtcgtaccggtaccgtacgacggttaccgtaacggaaacgggaaacctaaccggtacgtaaccgaaacgttcgttaaccggaacctaggtacgttacgggtacggaccgtaccggaaggaaccggaaagggaacggtaacgggacgttacgtaacgtaacgtttaaccttacggttacaacgttaaccgtcggtacggaaccgaacgttagtccgggttaatttcggttactacggttaggttcgggtaacggttaccggtaccggggaaggaaccgggtaaccacgggtccgtaccggttaacccggtccgtaggacccgaccgggacgtaacccggcccgttcccgcccggttcgtacccg

SEQ ID NO: 226241 - DNA, 689 bp, Homo sapiens
  misc_feature: GYAE6OF01BENQ7.53.38.D05.1.454.CMB.1.raw
  modified_base (592)..(592): a, c, t, g, unknown or other
  misc_feature (592)..(592): n is a, c, g, or t
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgaggcctcctatgaggtgacacacgcccacccgtcggtgtcagtcgtccccgaggacaggaccggccaggactccacctgctcgtggagacggctagttcggaacaaaaacatagtaggattaggttcggaccggacgaagaacgccgacggccgaccggtccccgttggttacggttaggtaaattaataagtaaaggacggaacggggaacggaccgggaccccgagggacctccggtacgacgcgtaactaccgtcgtcggtacctaccgacggacctacggaacggaacgaaacctacgtactaaccgtacgttacgaacctacgtacgtaggtacggtaccgaccgaacggacgaaacgggaacggaacggaacgtcgtacgtaacttaacgttacgtacgtactacgtacgtcgaacgtacgacgtcgtacgttcgttcngttagtgggtacgtaggcgggtacgacggaacgtacggtcggtacgaccgtccggtacgtccgacgaccgtacgtaccgcccgtcccgtcgtacccg

SEQ ID NO: 226242 - DNA, 752 bp, Homo sapiens
  misc_feature: GYAE6OF01A6HOI.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagcccaccctcggtgtcagtcgtccccaggacagacggccaggatcacctgctcgtggagaggcattggacaaaacaatagtggatatggtaccggcagaagccaggccacggcccctggtgttaggtaatataataaagacgagggagacggccccgagggtactcccgtgacgacgaattactacgtggcctaccgacgccgtacgaggggaaccaaacgtacgtaccacacgttacgaacctataccgaggtacgggtaacgtacccgaacgggaccgtaaaggaaacgggaacggaacgggtacgttaaccggtaacgtttaacgttttaaccggttcggttaacctaaacgttaccgtttacgggaaccgggtaaccgaaggtaccgtaggttccgggtttacctaccggttagttacgggtttagggttaccgtttccgggggaccggggtaacggggtaacccggtaaacgggtccgttaaccgggacccccggttccggttaacgggtacccgtaccgggtaaccccggaacggtaccccggttaccccggtcccccccggttacgggttaaccccg

SEQ ID NO: 226243 - DNA, 1000 bp, Homo sapiens
  misc_feature: GYAE6OF01B0VFF.53.38.D05.1.454.CMB.1.raw
  modified_base (108)..(108): a, c, t, g, unknown or other
  misc_feature (108)..(108): n is a, c, g, or t
  modified_base (170)..(170): a, c, t, g, unknown or other
  misc_feature (170)..(170): n is a, c, g, or t
  modified_base (183)..(183): a, c, t, g, unknown or other
  misc_feature (183)..(183): n is a, c, g, or t
tcagcgcgtatacacacgaccggtgctcgatttagtatctgatagttgggttgggctgtgggtccaggaggcagaactctgggtgtctcaccatggcctggatccctntacttcctccccctcctcactctctgctacaggtctctagaggcccttctatgaggtgacangcctaccgtggtntcagtcgtacccgaggtacacggaccggccagggactaccgaccgttgccgttacgtgggagacggtccgtaagttacggaactaaaaacgtataagtaggtaattaagtttacgggtaacccgacgtaaggaaccggtacccgaacggtcccggtaaccgggttcccccttagggtttacgggttttaacggttaaaagttaacggtttaaaacggtaaaaaccgggtaaccgggtaacgggggtaaccggtaacccgggtaaccccccgggtaacggggtttaacccgttaccccccggttaagggtaacccgggtacccgttaaaccggttaccccgttttaccggtaccggggttaacccgttaccccgggtaaggttaacccccgttaccggggaaaaccgggggtaaacccctaaaaacccgtaacgttaaccccggtaaaccgttaaccggttttacccgaaaacccgttacgtttaccgggtaaacgggtaccggggttaaccccggttaccggaaaccggggtaaacgttaacggggtaaaacgggtaaccggtaaccggggtacccttaaacggttaactttaaacggtttaacgttaaccggttaacctaaacggttcccgttagggaacccgggtaagtaacccggtcggttaacgggtttaccgttcgttaccgtaagggtttccgggtaggtttaccgttaccggggcgggtaaaccggtaccggtaggtccgttacggtacccggttcgacggtaacgtacccgtaaccggtaccggtacgtccccggtcccgtcggtaccc

SEQ ID NO: 226244 - DNA, 792 bp, Homo sapiens
  misc_feature: GYAE6OF01BBUL0.53.38.D05.1.454.CMB.1.raw
  modified_base (137)..(137): a, c, t, g, unknown or other
  misc_feature (137)..(137): n is a, c, g, or t
tcagcgcgtatacacacgaccggtgctcgatttagtatctgatagttgggtttggggctgtgggtccaggaggcagaactctgggtgtctcaccatggcctggatccctctacttcctccccctctcactctctgcncaggctctgacggcctctagtggaggtgaccacacgcccacccgtcggtgtcgagtccgtcccgaggacgacggaccgccgaggtatccaccgtcgtccgtacgtgggaagacggtactaagttacgggaacctaaaaactaagtacgtagggtaattaacggttcgggaaccgagaaacgacgtaccggacggacccgtaccggtcccgtaggttaggttaacgttaattaagtaaaggtaaacggacggaaggggaccgaacccggtaccccggagggacctcccgtaggacgtaccgacttaccgtccgtaggtccctacgacgtcgtacggaagggacctaacgtaaccgtacgaacttacgttaccgaacctacgttacggacgggtacgggaacctccggaagggtacgaaacgggtacggaacggtacgtcggtttaaacgactttaccggtaactttcgaacgtttacgtacggtaccgaacggtcccgtaaggtaccgtttggtacgggttccttaacgtagggttcggttacggttccgggaacgggacgggtaaccggaacgtccggttacggtacccggaccggtttcgccggtaaacctcgggaacccgcgggttaccccgcccgtcccgttacgtaccccg

SEQ ID NO: 226245 - DNA, 703 bp, Homo sapiens
  misc_feature: GYAE6OF01B619S.53.38.D05.1.454.CMB.1.raw
  modified_base (126)..(126): a, c, t, g, unknown or other
  misc_feature (126)..(126): n is a, c, g, or t
tcagcgcgtatacacacgaccggtgctcgatttagtatctgatagttgggtttgggctgtggtccaggagcagaactctgggtgtctcaccagtcggcctggactccctctacttcctccccctcnccactcctctgcacgaggcctcgtggacgccctcctatggacggtcgactacacgcccaccgtcggtgtacaggttccgtaccccgaggacgacggaccggtaccgaaggaccttcgacccgttgtcctcgtagggagacgtacgattaacggaactaaaactaagtcgtaggtatacggtacggacgaacgacgacgcgacgaccgacgccgttggtgtaagtataagtaacgtaagcgacggaccgaccggtaccgacggctaccgacgacgtacgtacgtcgtcgcgtctaccgacgtacgacgaacgaaccacgtaccgtactacgtacgtacgacgtacgtacgacggtacgacgtacggaacgacgaacgggaacgacggaacgtacggtactacgttacgtttacggtacgtaggtaggttacgtttaagttaattaacggtagttaagtacgttaggttaggttacgggttacgggacggtacggacgtacgacgtacgaccgtacgtacggtacggacgaccgaccggtacccgtcgtcctacccggttactcctcccgttccgtccc

SEQ ID NO: 226246 - DNA, 762 bp, Homo sapiens
  misc_feature: GYAE6OF01EOWQR.53.38.D05.1.454.CMB.1.raw
  modified_base (137)..(137): a, c, t, g, unknown or other
  misc_feature (137)..(137): n is a, c, g, or t
tcagcgcgtatacacacgaccggtgctcgatttagtatctgatagttgggtttggggctgtgggtccaggaggcagaactcgtgggtgtctcaccagtggcctggactccctctacttcctccccctctcactctcngcacgaggtctctgacgccttctagtggaggtgaaccacacgccctacccgttcggtcgtcgaggtccgtacccccgaaggacacggaccggaccaggtacctccgaccgtcgtcgttcggaggagacggactagtacgaaacaaaatagtagtacggtaattacggttacggtaccggacaacggaacgccgacggccgaccggtcccgttaggttaggttaacggttaactaagtaaacggaaacggtacggggaacgggacggacccgggaacccggtagggtaacctccgaggacgtacgtaacttacgtccggtcgacctaacgcgtacgtacggaacggaaccaacgtcgtaactactacgttaacgacctagtaccggaaggtaccggtactaccggaacggaacggaaggtaaccggacggaacgtcgtaacgtaacgttaacgtacgtacgtacgtagtcggtaacgaccgtacgacggtacgtagttcgttctagttacggttggtacggttacggtacgggaacggtacgtaaccgtacggtcgtaccggttaccgtacggaccgacgtaccggaccggtaccggtacccgttacccggtccgtccgttacccg

SEQ ID NO: 226247 - DNA, 813 bp, Homo sapiens
  misc_feature: GYAE6OF01CJJSP.53.38.D05.1.454.CMB.1.raw
tcagcgcgtatacacacgaccggtgctcgatttagtatctgatagttgggtttggggctgtgggtccaggaggcagaactcgtgggtgtctcaccatggcctggactccctctaccttcctccccctcctcactctctgcacgacgctctgacgtcctcctagtcgaggtcgacaccgacgtacccaccccgtcggtcgtactacgttccgtaccccgaggaccgacggaccggtaccgaggtacctccgtaccgtcggtcctcggtacgggaggtacggaccgttaggttaacggaaacaaaactaatagtaggtagttacggttaccgggtaccgacgaacggtacggccgtaacggccgaccgtcccgttaggtaggtttaacggtaattaagtaacgtaaaacggacggacgggaaccggtcccggaacccgacgggtacttaccggtagccgtacgtaacgtccgtcgccggtacctccgagcccgtaacggaacggaaccaactacgtactactaacgtcaccgtactaggtacgtacggtactacggaccgtacggaaacgacggtaacggacggtctaaggtaacctttacgttagtacgtaccgttaaggtcaccggggtaacctcgtaagggtaccggttaaggttccctttgtaaccgttggttaacgggttcgggttaccgggttggggaacggttaagggtaccctaacggccgttaaccgggtacccttgggttaaacccgcggaaacccccggggttcgtaccggttacccccgtaccggtcccccggtacgtacccg

SEQ ID NO: 226248 - DNA, 514 bp, Homo sapiens
  misc_feature: GYAE6OF02H0P14.53.38.D05.1.454.CMB.1.raw
  modified_base (436)..(436): a, c, t, g, unknown or other
  misc_feature (436)..(436): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtgttcncatgtggtattcgggcggaggaccaaggctacggaccgtccgtaggtccgagcccgaaggcctcgtcccccgtggtcc

SEQ ID NO: 226249 - DNA, 503 bp, Homo sapiens
  misc_feature: GYAE6OF02IN6AM.53.38.D05.1.454.CMB.1.raw
  modified_base (337)..(337): a, c, t, g, unknown or other
  misc_feature (337)..(337): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactcnggctccagctcagggacaacagtcacattgaccatcagtggagtccaggcagaagacgaggctagactattactgtcaatctgcgacagcagtggttctcattgtggtattcgggcggagggaccaaggctgaccgtctaggtcagccgaaggctcgcccctgtcc

SEQ ID NO: 226250 - DNA, 554 bp, Homo sapiens
  misc_feature: GYAE6OF02G0OWQ.53.38.D05.1.454.CMB.1.raw
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacaatataggatagttggtaccggcagaagcaggccaggcccctgtgttggtaatatataaagacagggagacggccccgagggactcccgtagagcgatactcgtcggctccagctcgaagggacaacagtcaactattcgaacctatacgaggtaggacgtccaggacaaggaagacgaggctaggactattactgtacaatctgcgacagntaggtcgttctnagtgtaggtgttcgggcgggacggaacgaggtctacggaccgtccgtacggtcgacgcccgaaggcccgtccgtccccgttcggtacccg

SEQ ID NO: 226251 - DNA, 504 bp, Homo sapiens
  misc_feature: GYAE6OF02IIFMC.53.38.D05.1.454.CMB.1.raw
  modified_base (366)..(366): a, c, t, g, unknown or other
  misc_feature (366)..(366): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaaacatatggatattggtaccggcagaagccaggccaggcccctgtgttggtaatatataaagacagggagaggcccccagggatcccgtgagcgatactctggctccagctacagggacaacagtcanacttgaccatcagtggagtccaggcagaagacgaggctgactattactgtcaatctgcgganagcagtgttcncatgtgtattcggnggaggaccagctgaccgtctacggtcacgccgaggctcgcccctggtcccg

SEQ ID NO: 226252 - DNA, 508 bp, Homo sapiens
  misc_feature: GYAE6OF02H2RC2.53.38.D05.1.454.CMB.1.raw
  modified_base (424)..(424): a, c, t, g, unknown or other
  misc_feature (424)..(424): n is a, c, g, or t
  modified_base (440)..(441): a, c, t, g, unknown or other
  misc_feature (440)..(441): n is a, c, g, or t
  modified_base (444)..(444): a, c, t, g, unknown or other
  misc_feature (444)..(444): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaaacatatggatattggtaccggcagaagcaggccaggccctgtgttggtaatatataaagacgagggagacggccccagggactccctgagcgatactcgtggcctccagctcgagggacaacgagtcacattgaccatcagtggagtccgaggcaggaagacgagctgactattactgtacatcngcgacagcagtgtctnntgngtagttcggcgaggacgaaggctcggaccgtcgtacgcgacgccgagtccgcgccccgtgtccg

SEQ ID NO: 226253 - DNA, 543 bp, Homo sapiens
  misc_feature: GYAE6OF02FPQMN.53.38.D05.1.454.CMB.1.raw
  modified_base (527)..(527): a, c, t, g, unknown or other
  misc_feature (527)..(527): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcagttggacaaaaacatatggatattggtaccggcagaagccaggccaggcccctgtgttggtaatatataaagacagggagacggcccccagggactcccgtgagcgatactcgtggcctccgagctcgagggacaacgagtcaactattacgaccatcgagtggtacgtccgaggcagaagacggagctgactattactgtacaatctgcggacagcagtcgttactcgtattgtaggtagttcgggacgggacggacaaggctaggacccgtcgtaggtcgacggcccgaaggtccnccgtccccgtgtcccg

SEQ ID NO: 226254 - DNA, 505 bp, Homo sapiens
  misc_feature: GYAE6OF02FFWSV.53.38.D05.1.454.CMB.1.raw
  modified_base (411)..(411): a, c, t, g, unknown or other
  misc_feature (411)..(411): n is a, c, g, or t
  modified_base (465)..(465): a, c, t, g, unknown or other
  misc_feature (465)..(465): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttgtaatatataaagacagggagaggcccccagggactcccgtgagcgatactctggctccagctcagggacaacagtcacattgaccatcagtggagtccaggcagaagacgaggctgactattacngtcaatctgcggacagcagtgttctcatgtggtattcgggcgtaggaccaggcngacccgtctaggtcacgccaaggctccgccccgtggtacc

SEQ ID NO: 226255 - DNA, 609 bp, Homo sapiens
  misc_feature: GYAE6OF02JL19A.53.38.D05.1.454.CMB.1.raw
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (360)..(360): a, c, t, g, unknown or other
  misc_feature (360)..(360): n is a, c, g, or t
tcagcgcgtatacacacgaccggtgctcgatttagtatctgatagttgggtttggggtcgtgtgggtccgaggaggcagaactctgggtgtctcaccatggcctggatccctctacttctccccctcctcactctctgcacaggctctgaggcctcctatgaggtgacacagccaccctcggtgtcagtcgtccccaggacagacggccaggatccacctgctcgtggagnggcagttggacaaaacaatatggatattggaccggnagaagccaggccgacggccctgtgttggtaatatataagacgaggagacggccccagggactaccgtgagcgatactcgtggtctaccgagcncgaggacaacgagacacatacgaccagtcaggtcgacgccgagacgaagaaggacgaggtagtacgtaattacgttacgtacgactagtaccgtggaccgacgtacgacgtaggtcgtttcacgttacttaggttcggtaagttccggggacgggtacgggtaacccgaaggtaccgttcggaaccgttccggtacggtacaaccgggtaccgtaggccccgttacccggtccccgttacccggtaccg

SEQ ID NO: 226256 - DNA, 703 bp, Homo sapiens
  misc_feature: GYAE6OF02IQBRQ.53.38.D05.1.454.CMB.1.raw
  modified_base (163)..(163): a, c, t, g, unknown or other
  misc_feature (163)..(163): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtnacacagccaccctcggtgtcagtgtccccaggacagacggccaggatcacctgctctggagaggctattggacaaaacatatggatatggtacgcagaagccaggccaggtccctgtgttacggtaatataagtaaacgtacgagggacgacggaccccgaggactcccagacgacgactactcgtcgctccgagctacgaggacaacgagtacactagttcgacctatcagtaggacgtaccgacggacgaaggaacgacggaacggtacgtacgtacttaacgttacgttacgtctaaaaacgttcgtacggtacggacgacggtacgtaacggttcggttaccgttacgttacgttacggttaggttaacgtttaccggggtaccgggtaccgggtaaccggttaacggtaaccggttaccgggtaacccgggttaacccggttaacgggttaacccgtaacccgggttaacccggtaaacccgggttaccccggttacccccgggttacccccggttacccgggtttaacccccgg

SEQ ID NO: 226257 - DNA, 617 bp, Homo sapiens
  misc_feature: GYAE6OF02HAKXD.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctggtgtcagtgtccccaggacagacggccaggatcacctgctctggagaggctagttggacaaaaacaatagtggaatagttaggtaccggcagaaacgccaaggccacggcccctgtgttaggtaatataataaagacgagggacgacggccccgaagggactcccgtagagcgatactcgtggccttccgagtcgtcgaagggaacaacgacgtacaactacttacgacctaacgtcgaggttcggacgtcccgaagggacaagggaaacggacggacggtactaggtacttacttacgtacgtactaatcgtgaccggaactagacgtagttcgtcgtctagttggtaggttcgtcgggacggacggactaaggtcctacggaccgttacgtaacgtccgacggtaccgacggtccgtacccgtacccgtcggttaccc

SEQ ID NO: 226258 - DNA, 541 bp, Homo sapiens
  misc_feature: GYAE6OF02HX5ZU.53.38.D05.1.454.CMB.1.raw
  modified_base (224)..(224): a, c, t, g, unknown or other
  misc_feature (224)..(224): n is a, c, g, or t
  modified_base (407)..(407): a, c, t, g, unknown or other
  misc_feature (407)..(407): n is a, c, g, or t
  modified_base (466)..(466): a, c, t, g, unknown or other
  misc_feature (466)..(466): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccacccctggtgtcagtcgtccccaggacagacggccaggatcacctgctctggngaggcattggacaaaacaatatggatattggtaccggcagaagccaggccaggccctgtgttggtaatataataaagacgagggagacggcccccagggactcccgtagacgcgattacgtctcggactccagctacgacggaacaacgagtacaactattcgaccatcagtaggacgtaccnggacaggaacgacgaggctagacttattacgtgacaatcgtgacgacagctagtgttanactagtgtgtagttcgaggaggaccagctgaccgtcgtaggcacgcccgaaggcctaccggtcccctggtacccg

SEQ ID NO: 226259 - DNA, 565 bp, Homo sapiens
  misc_feature: GYAE6OF02IIJ0E.53.38.D05.1.454.CMB.1.raw
  modified_base (261)..(261): a, c, t, g, unknown or other
  misc_feature (261)..(261): n is a, c, g, or t
  modified_base (338)..(338): a, c, t, g, unknown or other
  misc_feature (338)..(338): n is a, c, g, or t
  modified_base (435)..(435): a, c, t, g, unknown or other
  misc_feature (435)..(435): n is a, c, g, or t
tcagcgcgtatacacacgaccggtgctcgatttagtatctgatagttgggtttggggctgtgggtccaggaggcagaactctgggtgtctcaccatggcctggatccctctacttctccccctctcactctctgcacaggctctgaggcctcctatgaggtgacacagccaccctggtgtcagtgtccccaggacagacggccaggatcacctgctctgggagaggcagttggacaaaacatatggaatattggtaccggnagaagcaggcaggccctgtgtgtaatatataaagacgagggagacggacccccagggactcccgtgagcgatactcnggctccagctcgaggacaacagtcactattacgacctatcgagtggacgtcaggcaggacgagagctgactattactgtactatcgtggaccggtanagtcgagttggttctagtagttggttggttacgttcgggcgggacggaccgaaggtcgtaccggacccggtccgttaacggtctaccggacccgtaacgggtcctacccggtccccccgttggtaccccg

SEQ ID NO: 226260 - DNA, 572 bp, Homo sapiens
  misc_feature: GYAE6OF02HPBFG.53.38.D05.1.454.CMB.1.raw
  modified_base (262)..(262): a, c, t, g, unknown or other
  misc_feature (262)..(262): n is a, c, g, or t
  modified_base (352)..(352): a, c, t, g, unknown or other
  misc_feature (352)..(352): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacaggacggccaggatcacctgctctggagaggcagttggacaaaacaatatggatattggtaccgnagaagccaggccaggcccctgtcgttggtaataatataaagacgagggagacggcccccagggactcccgtgagcgatactctggctccngctcgagggacaacagtcacattgaccatcagtggactccgaggcaagaagacgagctagactattacgtgtactaactcaggccgacgacgacgacgtggttctgagttcggttggtagttccgggcgggacgggacgtaaacggtcgtacggacccgttaccgtacggtccgtaacggccccgtaaaggcccgttaccggtcccccgtggttaccccg

SEQ ID NO: 226261 - DNA, 557 bp, Homo sapiens
  misc_feature: GYAE6OF02HJRT3.53.38.D05.1.454.CMB.1.raw
  modified_base (519)..(519): a, c, t, g, unknown or other
  misc_feature (519)..(519): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccacccctcggtgtcagtcgtccccaggacagacggccaggatcacctgctctggagaggcattggacaaaacaatatggatattggtaccggcagaagccaggccaggcccctgtgttggtaatatataaagacaggggagacggacccccagggactccctagagcgatactctggcctccagctcgagggacaacgagtacacattgaccatcagtgagtccaggcagaagacgagcgtagactattactgtactaactctggcggacagactaggtggttctcagttcggtggttacgttcgggcggacgggacctaaggccgtacggaccgttaccgtacggtanaccggacccgacggtccgtccggcccccgtcgtacccg

SEQ ID NO: 226262 - DNA, 538 bp, Homo sapiens
  misc_feature: GYAE6OF02G3T0H.53.38.D05.1.454.CMB.1.raw
  modified_base (448)..(448): a, c, t, g, unknown or other
  misc_feature (448)..(448): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacaatatggatattggtaccggcagaagccaggccaggcccctgtgttgtaatatataaagacagggagacggcccccgagggactcctgagcgatactctggctccagctcgagggacaacgagtacactattgaccatcagtgacgtccgaggcagaacgacgaggctagactattactgtactaagtctgcggacagacagtgttcncgagttgtggtattcgggacggacggacgacggtctagtacccggtacgtacggtacgacggtcccgaaggcctcgcccccgtcgtaccg

SEQ ID NO: 226263 - DNA, 521 bp, Homo sapiens
  misc_feature: GYAE6OF02FOO2V.53.38.D05.1.454.CMB.1.raw
  modified_base (261)..(261): a, c, t, g, unknown or other
  misc_feature (261)..(261): n is a, c, g, or t
  modified_base (339)..(339): a, c, t, g, unknown or other
  misc_feature (339)..(339): n is a, c, g, or t
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
  modified_base (460)..(460): a, c, t, g, unknown or other
  misc_feature (460)..(460): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtcccccaggaccagacggccaggatcacctgctctggagaggcattggcaaaacatatggatattggtaccggnagagccaggccaggccccctgtgttggtaatatataaagacagggagaggccccccagggatccctgagcgatactcnggctccagctcagggacaacagtcacattgaccatcgagttggagtccaagggccagaaagacgaggctaggactattacngtcaatctgcgacagnagtggttctgatgtggtattcggnggtacgggccagcctgccgtaccctggaccagccctaagggcctagcccccgtacggtccc

SEQ ID NO: 226264 - DNA, 633 bp, Homo sapiens
  misc_feature: GYAE6OF02GFDBE.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctcccctcctcactctctgcacaggctctgaggcctcctatgaggtgacacagccaccctcggtgtcagtgtccccaggacagacggccaggatcacctgctcgtggagaggcattggacaaaaacatatcggatagttggtaccggcaagaagccgaggccgacggccccgtgttcggttaggtaatataagtaaagacgaagggagacggccccgagggactccgtagagcgatactcgtaggctacagtctacgacggaacaacgacgtacaactagttacgacctatcgaggtcggtaacgtccgaacggacgaaggaaaggaccggacggtacgtacgtaaccttaagttaccgtagttactaacgttacgtcggtaaccggactaggcgtaaggttcgttctacgtagttgttacggttacgttcggggacggtacggaccgtaggtccgtacggtacccgtacgtcggtacgtaccgaccgtacggtccctccgtccccgtacggtacccg

SEQ ID NO: 226265 - DNA, 555 bp, Homo sapiens
  misc_feature: GYAE6OF02JJHZ0.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggactaaaaacatatggatattggtaccggcagaagccaggccacggccctgtcgttgtaatatataaagacgagggagacggccccagggactccctgagcgatactctgctcagctacgaggacaacgagtacactacttcgaaccatacgagtaggactaccgaggcaaggaagacgaggctcgacttagtactgtacatcgacgcggacagactagtcgttcgtactacgttgtaggtacgttcgggacggacggaaccaggtcgtacgaccgttacgtacggtacacggaccgaaggtcgtccggtcccctggtacccg

SEQ ID NO: 226266 - DNA, 721 bp, Homo sapiens
  misc_feature: GYAE6OF02HKSVE.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagcccaccctcggtgtcagtccgtccccaggacagacggccgagatcacctgctcgtggagaggctagttggaacaaaacaatatggaattagttacgggtaaccgacaagaacggaccacggaccgtacggaccccctggttcggttaacggttaaattaagttaaagtaaaaggaacggtaaggggaacggaccggacccccgaagggaccttacccgtagacgtacgaacttacgtaccgtggacctaccgacgtccgtagacggtaacaacgacgtacaactacgttacgaacctagtacgaggtacggtacggttaccgaaggacgaaggtaacggaacgggacgtacgtacggtaacttaagttacgttcgtaactaacgtcgtacggtacggaactacggaccgttaggttacggttctacgttaagttcgggtacgttacgttcggggacggacgggtaacgtacggtaccggtaccgtaaccggttccggtaacggtacgtaccggtacccggacgtcccgtacccgtccccggttacggtaccg

SEQ ID NO: 226267 - DNA, 648 bp, Homo sapiens
  misc_feature: GYAE6OF02FOSL2.53.38.D05.1.454.CMB.1.raw
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacacgccaccctcggtgtcagtcgtccccaggacagacggccaggatcacctgctcgtggagagcagttggacaaaacatangatagttgaccggnagaagccaggccacgccctgtcgttggtaatataataaagacgagggagacggccccgaggctccgtgacgcatactctggctacncnctcgtaggacaacngtacactagttacacactcgacgtggtacgtaccgnggacgaacgaaggacggacggcgtacgtacttaacgttacgtacgtactaaacgtcgttacggaccgggacgtaggtaccgtaacggtcggtttcctaacgtaggttaggttcgggtttaacgttaccgggggacgggttaacggggaaccaagggttcggtaccgtacccgggtttaccgtaccgggttaccaccggacccggtaaaccggttcccgtaccccggttacccccggtcgttacccccgg

SEQ ID NO: 226268 - DNA, 660 bp, Homo sapiens
  misc_feature: GYAE6OF02ID86K.53.38.D05.1.454.CMB.1.raw
  modified_base (418)..(418): a, c, t, g, unknown or other
  misc_feature (418)..(418): n is a, c, g, or t
  modified_base (654)..(654): a, c, t, g, unknown or other
  misc_feature (654)..(654): n is a, c, g, or t
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgaggcctcctatggaggtgacacacgccacccgtcggtgtcagtcgtcccccgaggacacggaccggccaggactccgtacctgcctcgtgggagacggctagttaggaacaaaacaatagtggaattagttcggtaccggacaggtaacggccaggaccgacggtcccccgtgttggttacggttaatacgtaataaaaggacgaaggggaacggaccggacccccgagggcttacccgtggacgacgtactacgtccgtggtccgtccgngacctacggaacggaaccaaagaccgtcaactattacgaaccatcgaggtcggacgtacgacgggacaaaggtaaacggaacgggacggtcgttaacgtacgttaacttacggtagtactaacgtcgtcggacgacgacgtacgttaggtcgttcagttgttggttacggtagtcgggacggacggtaccgagtcggcgtaccggtactacggcaccgacgacgccgctccccggngtcccg

SEQ ID NO: 226269 - DNA, 764 bp, Homo sapiens
  misc_feature: GYAE6OF02HPKQK.53.38.D05.1.454.CMB.1.raw
tcagcgcgtatacacacgaccggtgctcgatttagtatctgatagttgggtttggggctgtgggtcaggaggcagaactctgggtgtctcaccatggcctggatccctctacttctccccctcctcactctctgcacaggctctgaggcctcctatggaggtgacacagcccaccctcggtgtcagtcgtccccaggacagacggccaggactcacctgctctgggacgaggctagttcggaacaaaacgaatagtaggtaattagttcgggaccggtacaaggaacgccgaacggccgacggtccccctaggttgttagggtaaacttagtaacgttaaaaggacggaggggaacggtaccggaccccggagggtacttacccgtaggtacgaccggtatacgttcgtacggccctaccgcgtcgtacgaagggaacctaagtacgtacgtaacctaacggttcctaaccacgtaccgtacggtggtacgtaccgggaaggctaacggaagggaccgaagggtcctacggtaactttaacttacgttacgtctaaacgttcgtacggaccggtacgtacgtacttagggtttaccgttagtaccggttagttcgggttaacgttaggggttaccgggtacggggacccgggttaacgtacggggtaccgtacccgggtaaccgggttccggtaaccggttaccaaccccggggacggttaaacccgggtcccgacccggttaccccccggtacgttaccccgg

SEQ ID NO: 226270 - DNA, 630 bp, Homo sapiens
  misc_feature: GYAE6OF02F0UFD.53.38.D05.1.454.CMB.1.raw
  modified_base (182)..(182): a, c, t, g, unknown or other
  misc_feature (182)..(182): n is a, c, g, or t
  modified_base (228)..(228): a, c, t, g, unknown or other
  misc_feature (228)..(228): n is a, c, g, or t
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagcccaccctcggtntcagtcgtccccaggacagacggccaggactcacctgctcgtgganaggcagttggacaaaaacatagtaggatattggtaccggacagaagccaggccaggccccctgtgttacgtaatataataaacgacgagggaagacggccccgaggactccctgagcgtaactactcgtcggctccacgctcgaggacaacacgtacacattacgacctatcgtagtcggacgtccgaggtacaaaggaacgtacggacgcgtacggaacttattaacgtcgtaactagtcgtacggaccggacaggacgtaggttcgttacgttacgtagttcggttacggttacgttcggggtaccggacgggtaaccgtacgacggttccgtaacccgttccgtaaccggtacgaccgaacccggtaggtccctcccggtaccccgtacggttaccccg

SEQ ID NO: 226271 - DNA, 732 bp, Homo sapiens
  misc_feature: GYAE6OF02FPRDV.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctggacggcctcctatgaggtgacacagcccaccctcggtgtcagtgtccccaggacagacggccaggactcacctgctcgtggagaggtcagttgacaaaacagtagtggattagttggtaccggacagaacgccgaggccacggtcccctggtgttaggtaatagtaataaagagagggagacggaccccgaggactccctggacgtacggaacttacgtcgtacggtcctaccgagtacctacggaacgggaactaacgactaccgaacgtattaccggaccaacgtcgtaacggttggaaccggtaccgaacgggacgaacgggaaggaaccggtaacggtccttaggaacctttaagttaccgttacgttacgtaaacgttcggtcggacggaacgtacggtacggttaaccgggtttcgttcctaggttacgttacggtttagggttccgttaccggggacggggaacgggtaacccggtacggccggttaacccgggtaacccgtttccggttaacggtaccgaacccgggtacccgaccgggtaacccgttccccgggtcccccgtttacgggttccccg

SEQ ID NO: 226272 - DNA, 637 bp, Homo sapiens
  misc_feature: GYAE6OF02I9S6J.53.38.D05.1.454.CMB.1.raw
tcagcgcgtatacacacgaccggtgctcgatttagtatctgatagttgggtttgggctgtgggtccaggaggcagaactctgggtgtctcaccatggcctggatccctctacttctcccctcctcactctctgcacagctctgagcctcctatgagtgacacagccaccctcggtgtcagtcgtccccaggacagacgccaggactcacctgctctggacaggcattagaacaaaactatagtggattattcggtaccgcaagaacgcgaacggcaacgccctgtcgttaggtaatattaagtaaagacgaaggacgtacggaccccgtaaggacctcccgtagagacgtactactcgtaggcctacgacgactacgaacgggactaacgagtaccaactacgttacgaccctagtaccgaggtacgacgtcgagacgacgaagacggagtacgtagacttagtacgtagtacgtaactcgtacgacgcgtaagaccgtaacggttcgttacgtacgttagtacgggttggttaacgttacgggaccgggacggtaaccaacggtcgtaaccgtaccgtaccgtacgtaccgaaccggtcccgaaggtaccctccggtaccccgttacggtacccgg

SEQ ID NO: 226273 - DNA, 806 bp, Homo sapiens
  misc_feature: GYAE6OF02FWOO3.53.38.D05.1.454.CMB.1.raw
  modified_base (280)..(280): a, c, t, g, unknown or other
  misc_feature (280)..(280): n is a, c, g, or t
tcagcgcgtatacacacgaccggtgctcgatttagtatctgatagttgggtttggggctgtgggtccaggaggcagaactctgggtgtctcaccatggcctggatccctctacttcctccccctcctcactctctgcacaggctctgacggcctctatggaggtgacacacgcccacccgtcggtgtcaggtcgtcccgaggacagaccggccaggactcgacctgctcgtggaggaggctagtcgaacaaaacagtataggattagttacggaccgganacgaacgaccgacggccacggtccctaggttacggtttaaggtaataagttaaagtaaacggtacgggaacggggaacggtacccggaccccggaagggtacccgtccgtaggaacggtacgtacttaaccgtccggtcggtacctacgtacgtaccgtacggaacggaacctaacgtaacgtacctaacgtaacgttaccgaaccgtacgtacgacgggttacggaaccggtaccggaacgggtaacgaaacgggtaacggtaaccgggtacggtaacttaacggtacgtttaacgttaaccggtttacgtaacgttaacgttacggtacggacggaaacgtacggtacggttacggttaccggttacttagttacggtttgggttaacggtttacgggtaccggggtaaccgggaacggtacctaacggttcccgggtaaccggttaaccggttaccggtaacggttccggaaccggtacccgtaccgggtcccccgtccggttacccccggtacgttacccgg

SEQ ID NO: 226274 - DNA, 1029 bp, Homo sapiens
  misc_feature: GYAE6OF02HAROM.53.38.D05.1.454.CMB.1.raw
tcagcgcgtatacacacgaccggtgctcgatttagtatctgatagttgggtttggggctgtgggtccaggacggcagaactctgggtgtctcaccatggcctggactccctctacttctcccccgtctcactctctgccacaggctctgaggcctcctagtgaggtcgacacagcccaccctcggtagtccagtcgtcccccgaggacacgaccggcccaagggacttccgaacccttggcccttcgtaggggaagacgggtcctaagttcgggacaaaaaaccgtattagtgggaacttagtttacgggtaacccggacgaaggaaacggcccgaagggtaccccgtaaccgggtcccccccgttgggttaccggtttaaggggtttaaaacgttaaacgtttaaacgttaaaaacgggaacccggtaaaaggggggaaccgggtaaccggggacccccccccggtaaggggggtaacccgtttacccccggttagggaacggtaccgggtaaaccgtttaacccgttaccggttacgggggtcccctttaccccggaacgggtacccgttacccggaaacggggggtaacccaaaaacggtaccgttaacccgaaaccgttaaacgtttaacgggtaaacccctaacgtttaacccgtaagggttaccggggtaaaccggttacccggaaacggggtaaccgtaaacgggtaaaacgggaaccgggaacgggtaccgttacgggtaaacccgtttaagtttaaccgtacggttaacctaaacgttccgtacgggaccgggtacgaacggacgtacgggttaccggtttcgtaccgttaacgtttcgggttacggttacggtttacccggggtaccgggtaacggggtaacccgtaaaccgggttcccggtaaccggttaacccgggttacccggttaaccggggttacccgaaccggggttaaccccccgtaacggggttacccccgtttacccggtaccccccccgggttccgggttaacccccgg

SEQ ID NO: 226275 - DNA, 723 bp, Homo sapiens
  misc_feature: GYAE6OF02HX1WE.53.38.D05.1.454.CMB.1.raw
  modified_base (110)..(110): a, c, t, g, unknown or other
  misc_feature (110)..(110): n is a, c, g, or t
  modified_base (145)..(145): a, c, t, g, unknown or other
  misc_feature (145)..(145): n is a, c, g, or t
  modified_base (163)..(163): a, c, t, g, unknown or other
  misc_feature (163)..(163): n is a, c, g, or t
  modified_base (261)..(261): a, c, t, g, unknown or other
  misc_feature (261)..(261): n is a, c, g, or t
  modified_base (644)..(644): a, c, t, g, unknown or other
  misc_feature (644)..(644): n is a, c, g, or t
tcagcgcgtatacacacgaccggtgctcgatttagtatctgatagttgggtttggggctgtgggtccaggaggcagaactctgggtgtctcaccatggcctggatccctntacttcctccccctctcactctctgcacaggctcngacgcctcctatgaggtnacacacgccacccgtcggtgtcagtcgccccgaggacacggaccggcaggactccactgtctcgaggaggtacgctagtacggaactaaaaacgtagngttaggtaatacgtttcggaaccggactaacggtaaggaccgaacgggtacctacggtccccgttggttagggtttaacggtaaatttacgtaaacgtaaaacggaacggacgggaaggaaccccggtcccccggaagggtaccttccgaggagtaccgtaacgttaccgtcggtcgtaccgtacctacggtacgtaaccggaacggaacctaacgtacgaaccgactattaccggactagacgtacgggacgtaacgacgaggaacctaagggaagtaccggtacggacgtcgtaaaacgttagttaccgtaccggttactaacgtcggtacgacggaaacgtccgtaagtcgtgttactacgtattcggggattaacgggngggtacggaggtaacgcggtactacggtccgtaagccgtacgaccgttcgaacccgttccgcccgtcgtaccgtcccgg

SEQ ID NO: 226276 - DNA, 613 bp, Homo sapiens
  misc_feature: GYAE6OF02GG8TP.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccacccgtcggtgtcagtcgtccccaggacagacggccaggatcacctgctcgtggagaggcagttggacaaaaacatatggaatattggaccggcagaacgccaggccacggcccctggtgttggaatataataaagacgaagggagacggaccccgagggacaccgtgacgcgaagtaccgtctcggcctccgacgctacgagggaacaacgacgtacaactatacgaccagtcgagtggacgtcgaggcgagaaagacggagcgtagaactattacgtagtacagtcgcggtacgacgagcgtaggttcgttctacgtagttggttcggttagttacgggacgggacgggtaaccgtaacggtcgtaccggtacccgttaccgtacgggtacctacggacccggtaacggtcccgtacccggtcccccgttacggtacccg

SEQ ID NO: 226277 - DNA, 755 bp, Homo sapiens
  misc_feature: GYAE6OF02IXC61.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctccccctcctcactctctgcacaggctctgaggcctcctatgaggtgacacagccctacctcggtgtcagtcgtccccaggacacggacggccgaggactcacctgctcgtgggagaggctagttacggaacaaaaaccgtaagtagtaggaattagttaccgggtaaccggacaaggtaaacgccgaacggacccgacggacccccgttggttacggttagggttaaaacttaacgtaaagtaaaaggaacggaacgggggaacgaacccgggaccccccggtaagggacccttaccccggtaggaaccggaccgtaacgttaacgttaccgtggtaccctaccgaaggtcctacggaacggaacaacgacgtacacgttaacgttacgaacctagtacgtaggtcggtagtacccgaaggaactaaaggaacgacggtacggtaccttagacgttaacgttaacgtcgtaacctaatccggtaagaccggtaacacgtacggagtttcgtactacgtagttacggtacgttcgtaccgggaacggtacggaaccggtacgtacgtccggttaacccgtacgttacggtaaccaccggaccggtaaccgtccgtacccggtccccggttgtaaccccg

SEQ ID NO: 226278 - DNA, 889 bp, Homo sapiens
  misc_feature: GYAE6OF02IOBBX.53.38.D05.1.454.CMB.1.raw
tcagcgcgtatacacacgaccggtgctcgatttagtatctgatagttgggtttgggggctgtgggtccaggaggcagaactctgggtgtctcaccatggcctggatccctctacttcctccccctcctcactctctgcacaggctctgacggccctcctatgaggtgacacacgccctacccgtcggtgtcgaggttccgtcccccgaggaccaggaccggaccgagggtactccgaacccgttcgtccgttacgtacgggaggacggctaggttacggaaacctaaaaacgtaagtagtggtaacttacgttacgggtaccggacaaggaccgaccgacggacccgacggtccccgtgttggttagtaagtactaagtaagacggacgggacggacccggaccccggtagggtacctcccgtaggaccggtacgtaacgttaccgtacgtcggtaccctaccgtacggccgttacggaacgggtaaaccaacggtacgtaccctaacgttagttaaaccgtaccgtacggttaccggtaacggggtacgggttaacccggtaacccggtacgggaaccgtaaagggtaaaccgggtaccgggaacggttaaccgtaacggttaacccgtttaacggttaacggtttacccttaccgtaacggttcccgtacggtaccggtaacgtacgggttaccgttacgggttcggtttacctacggtttcgttacgggttacgttaccgggttccggggtaacgggacccgggttaacggtaccggtaaccgttcccgggttaacccgttacccgggtttaacgggtccgtaaccccgggtaacccggtacccggttacccggtacccccgttccccggttacggttaacccccg

SEQ ID NO: 226279 - DNA, 920 bp, Homo sapiens
  misc_feature: GYAE6OF02HOFQN.53.38.D05.1.454.CMB.1.raw
tcagcgcgtatacacacgaccggtgctcgatttagtatctgatagttgggtttggggctgtgggtccaggaggcagaactctgggtgtctcaccatggcctggatccctctacttctcccccctcctcactctctgcacaggctctgaggcctcctatggaggtgacacagcccacccgtcggtgtcagtcgtaccccgaggacacggacggccaaggactccacctgccttcgtagggacgacggctagttcggaacaaaaactaagttagtaggtaattagtttcggggtaaccgacgaaggaacgccgacgggaccgaaccggtcccccgttaggtttaggttacggttaaagttaagtaaacgttaaaacggaacggtaacgggggaacggaccgggaccccccgaaggggtacccttacccggtacggaacggtccgtaacgtttaccgttccggtcgggttcccttaccgacggtaccgtaccggaaccggggaaaccctaaaacggaccgttaaccgtaaccttacggtttaacgacccttaacgtaccggtacggttacgggaacccggttaccggaaccgggtacgaaacgggaaacggtaacggtacgggaccgttaccggtaaacgtttaacggtttacgttaacggtacccgttaagttaccgacggtaacccggtaacgaccggttacggtttacgggtttcggtttaccgttacgttacgggtttacgggttacgggttaaccgggtttccggggaccggggttaaccggggaacccgtttaaccgggtccgtttaacccgggtacccggtttaacccggtaccgggttaacccgaccgggtaaccccgggtaaccggttccccggtttaacccccgggtcccccggttacccggtttacccccgg

SEQ ID NO: 226280 - DNA, 123 bp, Homo sapiens
  misc_feature: GYAE6OF01C0SVE.14.20.B09.1.454.CMB.1.raw
  modified_base (123)..(123): a, c, t, g, unknown or other
  misc_feature (123)..(123): n is a, c, g, or t
tcagcgtctagtaccacgaccggtgctcgatttagtgtagtgtgaagggcacagcggccctgggctgcctggtcaaggactacttccgtactagacgctgagcgggctggcaaggcgcatagn

SEQ ID NO: 226281 - DNA, 127 bp, Homo sapiens
  misc_feature: GYAE6OF01AWC4C.14.20.B09.1.454.CMB.1.raw
  modified_base (123)..(127): a, c, t, g, unknown or other
  misc_feature (123)..(127): n is a, c, g, or t
tcagcgtctagtaccacgaccggtgctcgatttagtgtagtgtgaaggtcacagcggccctgggctgcctggtcaaggactacttccgtactagacgctgagcgggctggcaaggcgcatagnnnnn

SEQ ID NO: 226282 - DNA, 723 bp, Homo sapiens
  misc_feature: GYAE6OF01CCFM4.14.20.B09.1.454.CMB.1.raw
tcagcgtctagtaccacgaccggtgctcgatttagtgtagtgtgaagggtaaaggggagggcagttaggtagattgcccctctgggagagatcccagggtgacagccatggaccctggaagggcctggctagggacagggaccagagccagtcctagggagaggacagagccaatggactggggtgtacgtgtaacagcctgctggcgagacgggaccagggccaccgtcctccgagggacgcccatcgctagacaacggtccgggccaggacggtcgcccctagaacctggaacggccaagtagaacgacccaagacgacggaccaaggtgggtacgtaggacgtaccccgtgacggacgccgtacgggtccctcggtacccacgggtccacggtccgcgtccggcccctgcctcgtcgtcgcgtcgggtcgtcggtcgtacgtcggtcgccgtacgtcggtcctgtcctcgccgtacccgtagtcggttacgaccgtaaccgtacggaaaccgggccgggtaaccccgacggtacccgtacggaccgtaccgtacggtacggtacggaacgtaccgtacggtacccgtactaccgacggtaccgtcggtaccggcgtaccggtacgggtcggggtaccgtacgggtacccgacccggaccccgtaaaccggaccccgtaaccccgtacgttacgacccgttaacgttcccgttaacccccg

SEQ ID NO: 226283 - DNA, 124 bp, Homo sapiens
  misc_feature: GYAE6OF02F2A9G.14.20.B09.1.454.CMB.1.raw
  modified_base (123)..(124): a, c, t, g, unknown or other
  misc_feature (123)..(124): n is a, c, g, or t
tcagcgtctagtaccacgaccggtgctcgatttagtgtagtgtgaagggcacagcggccctgggctgcctggtcaaggactacttccgtactagacgctgagcgggctggcaaggcgcatagnn

SEQ ID NO: 226284 - DNA, 150 bp, Homo sapiens
  misc_feature: GYAE6OF01DQMC4.53.47.E03.1.454.CMB.1.raw
  modified_base (150)..(150): a, c, t, g, unknown or other
  misc_feature (150)..(150): n is a, c, g, or t
tcagcgcgtatacacacgaccggtgctcgatttagactcgcgcacagagagaagggcacgaccggtgctcgatttagctctacgctcagggcacgaccggtgctcgatttagtacacgtgattagggagcgggctggcaaggcgcatagn

SEQ ID NO: 226285 - DNA, 117 bp, Homo sapiens
  misc_feature: GYAE6OF02GSHMT.53.47.E03.1.454.CMB.1.raw
tcagcgcgtatacacacgaccggtgctcgatttagactcgcgcacagagagaagggcacgaccggtgctcgatttagtgacatctcgcagttctgagcgggctggcaaggcgcatag

SEQ ID NO: 226286 - DNA, 166 bp, Homo sapiens
  misc_feature: GYAE6OF02H8DQ5.53.47.E03.1.454.CMB.1.raw
  modified_base (162)..(166): a, c, t, g, unknown or other
  misc_feature (162)..(166): n is a, c, g, or t
tcagcgcgtatacacacgaccggtgctcgatttagactcgcgcacagagagaagggcacgaccggtgctcgatttagactcgcgcacagagagaagggcacgaccggtgctcgatttagtgacatctcgcagttctttgagcgggctggcaaggcgcatagnnnnn

SEQ ID NO: 226287 - DNA, 257 bp, Homo sapiens
  misc_feature: GYAE6OF01EK5QE.2.20.B09.1.454.CMB.1.raw
  modified_base (243)..(257): a, c, t, g, unknown or other
  misc_feature (243)..(257): n is a, c, g, or t
tcagacgctcgacacacgaccggtgctcgatttagtgtagtgtgaagggtaagggccggcgcgggagcgaatgagttctgggccagggaaccctggtcaccgtctcctcagcctccaccaagggcccatcggtcttcccctggcgccctgctccaggagcacctcgagagcacagcggccctgggctgcctggtcaaggctacttcctgtcgagcgtctgagcgggctggcaaggcgcatagnnnnnnnnnnnnnnn

SEQ ID NO: 226288 - DNA, 319 bp, Homo sapiens
  misc_feature: GYAE6OF01ETUZM.2.20.B09.1.454.CMB.1.raw
  modified_base (155)..(155): a, c, t, g, unknown or other
  misc_feature (155)..(155): n is a, c, g, or t
  modified_base (169)..(169): a, c, t, g, unknown or other
  misc_feature (169)..(169): n is a, c, g, or t
  modified_base (260)..(262): a, c, t, g, unknown or other
  misc_feature (260)..(262): n is a, c, g, or t
  modified_base (264)..(264): a, c, t, g, unknown or other
  misc_feature (264)..(264): n is a, c, g, or t
  modified_base (266)..(319): a, c, t, g, unknown or other
  misc_feature (266)..(319): n is a, c, g, or t
tcagacgctcgacacacgaccggtgctcgattttagtgtagtgtgaagggtaaagggggtccgggcgcgggagcgaagtgagttctggggccaggggaaccctggtcaccggtcctcctcagcctccacgaaggcccatcggtcttcccctggcnccctgctccaggancacctccgagagcacagccggccctgggcctgccctggtcaaggctacttccgtggtcgagcgtctgagcgggctggcaagggcacatagnnntntnnnnnnnnnnnnnnnnnnnnnnnnnnnnnnnnnnnnnnnnnnnnnnnnnnnnnn

SEQ ID NO: 226289 - DNA, 305 bp, Homo sapiens
  misc_feature: GYAE6OF01D8XLY.2.20.B09.1.454.CMB.1.raw
  modified_base (258)..(259): a, c, t, g, unknown or other
  misc_feature (258)..(259): n is a, c, g, or t
  modified_base (261)..(305): a, c, t, g, unknown or other
  misc_feature (261)..(305): n is a, c, g, or t
tcagacgctcgacacacgaccggtgctcgattttagtgtagtgtgaagggtaaaggggtccgggcgcgggagcgaatgagttctgggggccagggaaccctggtcaccgtctcctcagccctccaccaagggccctatcggtcttccccctggcgccctgctccagggagccaccgtccgagagcacagccggccctgggctgcctggtcaaggtctacttcctgtcgagcgtctgagcggctggcaaggcgcatagnntnnnnnnnnnnnnnnnnnnnnnnnnnnnnnnnnnnnnnnnnnnnnn

SEQ ID NO: 226290 - DNA, 290 bp, Homo sapiens
  misc_feature: GYAE6OF01B6W6I.2.20.B09.1.454.CMB.1.raw
  modified_base (212)..(212): a, c, t, g, unknown or other
  misc_feature (212)..(212): n is a, c, g, or t
  modified_base (247)..(290): a, c, t, g, unknown or other
  misc_feature (247)..(290): n is a, c, g, or t
tcagacgctcgacacacgaccggtgctcgatttagtgtagtgtgaagggtaaaggggccgggcgcgggagcgaatgagttctggggccagggaaccctggtcaccgtctcctcagcctccaccaagggcccatcggtcttcccctggcgccctgctccaggagcacctcgagagcacagcggccctgggctgcctggtcaaggctacttccngtcgagcgtctgagcgggctggcaaggcgcatagnnnnnnnnnnnnnnnnnnnnnnnnnnnnnnnnnnnnnnnnnnnn

SEQ ID NO: 226291 - DNA, 285 bp, Homo sapiens
  misc_feature: GYAE6OF01CAE7Q.2.20.B09.1.454.CMB.1.raw
  modified_base (151)..(151): a, c, t, g, unknown or other
  misc_feature (151)..(151): n is a, c, g, or t
  modified_base (250)..(285): a, c, t, g, unknown or other
  misc_feature (250)..(285): n is a, c, g, or t
tcagacgctcgacacacgaccggtgctcgatttagtgtagtgtgaagggtaaaggggtccgggcgcgggagcgaatgagttctggggccagggaaccctggtcaccgtcctcctcagcctccaccgaaggcccatcggtcttcccctggcnccctgctccaggagcacctccgagagcacagccggcctgggctgcctggtcaaggctacttcctgtcgagcgtctgagcggctggcaaggcgacatagnnnnnnnnnnnnnnnnnnnnnnnnnnnnnnnnnnnn

SEQ ID NO: 226292 - DNA, 283 bp, Homo sapiens
  misc_feature: GYAE6OF02GVOHI.2.20.B09.1.454.CMB.1.raw
  modified_base (257)..(283): a, c, t, g, unknown or other
  misc_feature (257)..(283): n is a, c, g, or t
tcagacgctcgacacacgaccggtgctcgatttagtgtagtgtgagggaagggtcgggcgcggagcgatgagtctgggcaggaacctggtcaccgtctccgtccagcctccaccaacgggcccgatccggtcttccccctggccgccctgctcccaggacgcacctccgagagcacagtcggccctgggctgcctcggtccaaggactacgttcctgttcgagcggtctgagcgggcctggcaaggcgtcacgtagnnnnnnnnnnnnnnnnnnnnnnnnnnn

SEQ ID NO: 226293 - DNA, 338 bp, Homo sapiens
  misc_feature: GYAE6OF02I8FMJ.2.20.B09.1.454.CMB.1.raw
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (267)..(273): a, c, t, g, unknown or other
  misc_feature (267)..(273): n is a, c, g, or t
  modified_base (276)..(279): a, c, t, g, unknown or other
  misc_feature (276)..(279): n is a, c, g, or t
  modified_base (282)..(282): a, c, t, g, unknown or other
  misc_feature (282)..(282): n is a, c, g, or t
  modified_base (285)..(338): a, c, t, g, unknown or other
  misc_feature (285)..(338): n is a, c, g, or t
tcagacgctcgacacacgaccggtgctcgattttagtgtagtgtgaagggtaaagggggtccggggcgcgggagcgaatgagttctggggcccagggaaccctggtcaccgtctcctcgagcctccaccaagggcccatccggtcttcccccctggcgcccgtgctccgaggagcacctccgagacgcacagcggccctgggctgcctggtcaggactattcctgtcgagcgtctgagccgggntgggcaagggccncaataggntnnnnnnncgnnnntcnacnnnnnnnnnnnnnnnnnnnnnnnnnnnnnnnnnnnnnnnnnnnnnnnnnnnnnn

SEQ ID NO: 226294 - DNA, 330 bp, Homo sapiens
  misc_feature: GYAE6OF02GX4Z9.2.20.B09.1.454.CMB.1.raw
  modified_base (262)..(262): a, c, t, g, unknown or other
  misc_feature (262)..(262): n is a, c, g, or t
  modified_base (265)..(267): a, c, t, g, unknown or other
  misc_feature (265)..(267): n is a, c, g, or t
  modified_base (269)..(269): a, c, t, g, unknown or other
  misc_feature (269)..(269): n is a, c, g, or t
  modified_base (272)..(330): a, c, t, g, unknown or other
  misc_feature (272)..(330): n is a, c, g, or t
tcagacgctcgacacacgaccggtgctcgatttagtgtagtgtgaagggtaaagggggccggcgcgggaggcgaagtgaggttctggggccagggaaccctggtcaccgtctcctccagcctccacctaaggcccatcggtcttccccctggcgccctgctccacggaggcacctccgagagcaccagcgccctgggcctgcctggtcaaggactacttccgtgtcgaggccgtctgagcgggctggcaacggcgcataggnttnnncngannnnnnnnnnnnnnnnnnnnnnnnnnnnnnnnnnnnnnnnnnnnnnnnnnnnnnnnnnn

SEQ ID NO: 226295 - DNA, 316 bp, Homo sapiens
  misc_feature: GYAE6OF02GBISS.2.20.B09.1.454.CMB.1.raw
  modified_base (261)..(316): a, c, t, g, unknown or other
  misc_feature (261)..(316): n is a, c, g, or t
tcagacgctcgacacacgaccggtgctcgatttagtgtagtgtgaagggtaaagggggccggcgcgggagcgaatgagttctggggccagggaaccctggtcaccgtctcctcagcctccaccaagggcccatcggtcttccccctggccgccctgctccagggagcacctccgagagcacagcggccctgggctgccttggtcaaggactacttcctgtcgagtcgtcgtgagcgggctgggcaacgggccgacactagnnnnnnnnnnnnnnnnnnnnnnnnnnnnnnnnnnnnnnnnnnnnnnnnnnnnnnnn

SEQ ID NO: 226296 - DNA, 382 bp, Homo sapiens
  misc_feature: GYAE6OF02HZX9U.2.20.B09.1.454.CMB.1.raw
  modified_base (262)..(263): a, c, t, g, unknown or other
  misc_feature (262)..(263): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (308)..(382): a, c, t, g, unknown or other
  misc_feature (308)..(382): n is a, c, g, or t
tcagacgctcgacacacgaccggtgctcgatttagtgtagtgtgaaaggggaaaggggccggcgcgggagcgaatgagttctggggccagggaaccctggtcaccgtctcctcagcctccaccaagggccccatccggtcttcccccctggccgccctgctcccagggagcacctccgagagcaccagcggccctgggctgcctggtcaaaggcctacttcctgtcgagcgtctgagcgggctaggccaaggtcacagtagnncagnantancagcatnactnagcaagccatcgntacatgncngannnnnnnnnnnnnnnnnnnnnnnnnnnnnnnnnnnnnnnnnnnnnnnnnnnnnnnnnnnnnnnnnnnnnnnnnnn

SEQ ID NO: 226297 - DNA, 750 bp, Homo sapiens
  misc_feature: GYAE6OF02JH0KC.2.20.B09.1.454.CMB.1.raw
tcagacgctcgacacacgaccggtgctcgattttagtgtagtgtgaaggggtaaaggggggaagagctgctcagttaggacccagagggaaccatgggaaaccccagcgcgacgcttctcttcctcctggccttacctctggctcccagagtaccaccggagaaactcgtagttgacgcagtctcaggcaccctgtctttcgtcctccagggtaacgagccaccctcttctttgcacggccagtcagacttgttcgcgacgaacagccttctaccgtggttaccagtctacggtaaaccgttcggacctacgtccctacccggagacctacccgtacggaactccctaagtccgtaccgtactacttcgaacgtaccgacggccgtaccctaccgttgggaccctaacggttccccggaacgtacctaacggtttaccgtacgggtcggacgttagggttcggggttaccgtcgggacgaacggtagtttaccctaccttaccgtacctaacccgacctttacgaacgtacgtaacgtaccgtcggtacgtaccggtacgtacggttacgtttcgtacttaggttttcgttaaactttccttacggtttacacctttcgaggtttacggttaccgggtttagtaccgtagttccggtacttacggtttacggttcggacccggtagggtaaccgacggtcggtaggacgtaacgaccgtaaaggtcgtaggtccgctacgactacgttcg

SEQ ID NO: 226298 - DNA, 622 bp, Homo sapiens
  misc_feature: GYAE6OF01DDRXW.10.83.H06.1.454.CMB.1.raw
  modified_base (257)..(257): a, c, t, g, unknown or other
  misc_feature (257)..(257): n is a, c, g, or t
  modified_base (352)..(352): a, c, t, g, unknown or other
  misc_feature (352)..(352): n is a, c, g, or t
  modified_base (612)..(612): a, c, t, g, unknown or other
  misc_feature (612)..(612): n is a, c, g, or t
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctatttaaaggtgtcaatgtgaggtgcagttggtggagtcgtgggggagtcttggttcagccgagggccgtccctgagctcttcttgacngcctctggatttaggtttcgtgatttatgctatgagctggttccggcagggctccgaggggaagggctgggagtgggttagtttcagttaggagnatagccgtagtggtaggggctttcgagaatccgcgcgtcgtgtagaaacggtccgagttcaccgtactctactaaggagaaccgtataccccaaaagcccttacggacccttacccgtaggtaaactcgggaaccagacccgtaggaaaacgcgaacggaaccacgacggtcgttactaatttagttagttaggttaacggtaggggtaacccaggtccggacgtataacggtcctaacggtttacccgagggtaggggngttaaccggg

SEQ ID NO: 226299 - DNA, 638 bp, Homo sapiens
  misc_feature: GYAE6OF02IMON6.10.83.H06.1.454.CMB.1.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggtttccttgttgctattttaaaaggtgtccaatgtgaggtgcagttggtggagtctgggggagcttggttcagccagggcgtcctgagactctcttgtacagcctctggactttaggtttcgtgtattatgctatgagctggttccggcaggctccgaggggaaggggcgtgggagtgggttaggtttcagttagaagcagtagcctagtgggtggggctttcgagtaactccgccgcgtcgtggtgaaaacggccgtaattccaacccgtatcctacaaggacgaacgaactacccgaaaagccctccgacccttaacccgtaggaaactggaccagtaccgtaggaaaacgcgaaccgaacgaacgaagggtcccgtacgtaatttacgttgttaggtttaaggacggggtaaccctagtccggacgtaacgttaacggaccgttaagttcccgtaaggggtaggggtacccgttaacgggg

SEQ ID NO: 226300 - DNA, 564 bp, Homo sapiens
  misc_feature: GYAE6OF02I662G.10.83.H06.1.454.CMB.1.raw
  modified_base (256)..(256): a, c, t, g, unknown or other
  misc_feature (256)..(256): n is a, c, g, or t
  modified_base (348)..(348): a, c, t, g, unknown or other
  misc_feature (348)..(348): n is a, c, g, or t
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagttggtggagtcgtgggggaggcttggttcagccagggcgtccctgagactctcttgacngcctctggattttaggtttcgtgattatgctatgagcttggttccggcaggctccgaggggaagggctgggagtgggtaggtttcattagancatagcctatgggtgggcttcgagaacgtccgccgtcgtctgtaggaaacggccgatccacatctcaagagacgactacccgaaaacgccctcgaccctaccgtaggaaactcggaacacgacctaagaaacgcgaacgaacacgaggctactattagttgtagttaggaggaccagtcgacgagtacgctacgttacgtagggagggtagtacgg

SEQ ID NO: 226301 - DNA, 974 bp, Homo sapiens
  misc_feature: GYAE6OF02F8PCK.10.83.H06.1.454.CMB.1.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagcttgggttttccttgttgctattttaaaaggtgtccaatgtgaggtgcagttggtggagtcgtgggggagtcgttggttcagccgaggggccggtccctgacgacttcccttgtacgacgcctctggtagtttaggttttacggttgtattaattgtctattgtaggcgttcgggtttcccgggtcgacgggtccgtcccgacgggggaagggggcggtgggtagggtagggggttagggtttacgtagttaagtaaggactaagtacgtaccgtaacgttggggttcggggggtcgtttacgtaacggaaacgttccccggtcccggtccggttccgttacgggttaacgggtaaaacggggaacccggtaccgtttaaccgtaaccccgtaactttacccggttacctaaaacgggaaacggtaaacccgggtaaacccttaaacccccgtaaaaaaaccgggacccccgtttccccggaaccccgtttaaacccccggttaaaggggaaaaacgtttacggggaaacccgtaacggtaaccccggtaaagggtaaaaaaccgggaaccccggtacccggtaaaacccggaacgtaaccgggggttaaccgtttacccgttttaaatttttaaaccggttttcggggttttaacggtttaacggggggtaaaacccggggggtacccccgtaaacgtttcccgggggaaacccggttaaacggttaaccgggtaacccggtaaaccgggttttttaccccggtaaacggggggaacgggggggggttaacccgggtttacccgttaaaaacccccggggggg

SEQ ID NO: 226302 - DNA, 754 bp, Homo sapiens
  misc_feature: GYAE6OF02JIXT3.10.83.H06.1.454.CMB.1.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgcttattttaaaggtgtccaatgtgaggtgctagttggtggagtcgtgggggaggtcttggttcagccgaggggccgtccctggagactctcttgacagcctgtggtatttaggttcgtagtattagtgtcttagtgagtcgttcggtcccggtacgacgggtctacccggagggggtaacggggtcgtaggggtacgggttagggggttacggttttacgaaggtttaggaaacggtcgtaacgttacggtaccgttagggtttcgggggtcggggttactttacggaacggtaaccgtccccgggtacccggtacggttaccggtaggtaacgggtaaaaccggtcccggtaactttcccgaacctacttaccgtacgaaacggtacgaacgtaacctaaccccgaaaacgtccgtacccgtacccgtaaccgttacggtaaacgtcggaaccacggtaccgtaagaaacggaccgaaccaaccggagtacggtacttaacgtagtttagttcggtagttaagggacggtaactacgtacggcgtaagtcgtcgtaacgttaccggtagggtacgggtataccggg

SEQ ID NO: 226303 - DNA, 740 bp, Homo sapiens
  misc_feature: GYAE6OF02GHZP6.10.83.H06.1.454.CMB.1.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (353)..(353): a, c, t, g, unknown or other
  misc_feature (353)..(353): n is a, c, g, or t
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagcttgggtttttccttgttgcttaattttaaaaggtgtaccaatgtgaggtgnagttggtggagtgtggggngcttggtcagcgaggcgtcctgagtactctcttcgtacagtcctgtcggtattttaggttcgtgtattagtgtactatgacgtcgtcggttcccggacgaggtctaccggaaggggtacggggccgtagggnggttagggttacggtttctaaggttaaggtaacgcgtacgtacgtaccgtaggttacgggtcgggtaccttaggaacggtaaccgtcccgggtacccgtcggttccgttaacgggtaaaccggtacggtacctaacgttaaccacctaacgtacgaaaacggtacgaaaccgtaacgtaacccgttaaacgaccgttacccgttaacctacccggtaacggttaaacgtacggaaccgtaacgacccgttaagaacgaacgtaacgacctaaggacgtacgtacttagtttacttacggttagtacggttaaggaactcggtaacgtacgtaactacgttacgtacgttaaccgggttaacggtacggggtaggttacggtaaccgg

SEQ ID NO: 226304 - DNA, 145 bp, Homo sapiens
  misc_feature: GYAE6OF01C86Q9.51.62.F07.1.454.CMB.1.raw
  modified_base (108)..(108): a, c, t, g, unknown or other
  misc_feature (108)..(108): n is a, c, g, or t
  modified_base (114)..(145): a, c, t, g, unknown or other
  misc_feature (114)..(145): n is a, c, g, or t
tcagcgatcgtatacacgaccggtgctcgatttagtagtcgcataagggaagggcagcgtcactctgttcccacctctctcgtagcactctgagcggctggcaaggcncatagnnnnnnnnnnnnnnnnnnnnnnnnnnnnnnnn

SEQ ID NO: 226305 - DNA, 118 bp, Homo sapiens
  misc_feature: GYAE6OF01BNYKQ.51.62.F07.1.454.CMB.1.raw
tcagcgatcgtatacacgaccggtgctcgatttagtagtcgcataaagggaaagggcagcgtcactctgttcccgccctcctctcgtagcactctgagcgggctggcaaggcgcatag

SEQ ID NO: 226306 - DNA, 499 bp, Homo sapiens
  misc_feature: GYAE6OF01C9T4D.4.51.E07.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (406)..(406): a, c, t, g, unknown or other
  misc_feature (406)..(406): n is a, c, g, or t
  modified_base (496)..(496): a, c, t, g, unknown or other
  misc_feature (496)..(496): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaggagcaacttagcctggtaccagcataaacctggccaggcctcccaggcctcctcatctatggtncatccacagggccacgtggtactcccagccacgttcagtggcaggtcgggtctgggacacgagttccactctcaccatcagcacgcctgcagtctgaagtntttggatttatactgtcagcagtataatactgctctcacgtttcggcggagggaccaaggtggagatacgaaacgatgtcgcagcaccgntcg

SEQ ID NO: 226307 - DNA, 540 bp, Homo sapiens
  misc_feature: GYAE6OF01BGHD6.4.51.E07.1.454.CMB.1.raw
  modified_base (205)..(205): a, c, t, g, unknown or other
  misc_feature (205)..(205): n is a, c, g, or t
  modified_base (535)..(535): a, c, t, g, unknown or other
  misc_feature (535)..(535): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaggagcaacttagcctggtaccagcataaacctggccaggctcccaggctcctcatctatggtgcatccaccagggcccactggtatcccagcccacgttcagtggcaggtgggtctggggacacgagttccacttctcaccatccagcacgccctgcagtcctagaagttagttttggagttttattacgtgtcagctaagtataataacgtggtccttctctacgtttcgggcgggtacgggaccgtaagggtggagtactacgaaacgtacgtcggtacggctaggcctacgtnttccg

SEQ ID NO: 226308 - DNA, 518 bp, Homo sapiens
  misc_feature: GYAE6OF01C695T.4.51.E07.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (395)..(395): a, c, t, g, unknown or other
  misc_feature (395)..(395): n is a, c, g, or t
  modified_base (448)..(448): a, c, t, g, unknown or other
  misc_feature (448)..(448): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttaggancaacttagcctggtaccagcataacctggccaggctccaggctcctcatctatggtgcatccaccagggccacgtcggtatcccagccctacgttcaggtggctaggtgggtctggggacacagttcactctacaccatcagcagcctgcngtctagaagtattttggagttttatacgttgtcagctagtataatactgcctntctacgttcggcggacggaccgaaggtggagagtacgaaacgtacgtggtcggctacgctaccgtgtccg

SEQ ID NO: 226309 - DNA, 532 bp, Homo sapiens
  misc_feature: GYAE6OF01D9NZH.4.51.E07.1.454.CMB.1.raw
  modified_base (205)..(205): a, c, t, g, unknown or other
  misc_feature (205)..(205): n is a, c, g, or t
  modified_base (363)..(363): a, c, t, g, unknown or other
  misc_feature (363)..(363): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaggagcaacttagcctggtaccagcataaacctggccaggctcccaggctcctcatctatggtgcatccaccagggccacgtggtactcccagccacgttcagtggcagtgggtctgggacacngttcactctcaccatcagcagcctgctagtctagaagtagttttggagttttatactgtacagactaagtataagtaacctggtcccttacgtctaacgtttcgggacggtagggtaccgaagggtggagaactcgaaaacgacttggtcggactgacctccagttccg

SEQ ID NO: 226310 - DNA, 546 bp, Homo sapiens
  misc_feature: GYAE6OF01DFGPK.4.51.E07.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctntcctgcagggccagtcagagtgttaggancaacttagcctggtaccagcaataaacctggccaggcctcccgaggcctcctcattctatggtncatccacagggccacgtggtactcccagccacgttcagtggctaggtggtctgggacacgagttcactctcacatcagcagcctgcagtctagagtatttggatttattactgtcagctagtataatactgccttctcgtacgtttcggacgggtacgggaccgaagggttcggaagtaacgtaccgaaaaccgggtaacgttcggtacgggacttaggaccctaccgtagttaccg

SEQ ID NO: 226311 - DNA, 509 bp, Homo sapiens
  misc_feature: GYAE6OF01AV1A9.4.51.E07.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaggancaacttagcctggtaccagcataaacctggccaggctcccaggctcctcatctatggtgcatccaccgagggccactggtactcccagccacgttcagtggcaggtgggtctggggacacgagttcactctcaccatcagcagcctgcagtctgtaagtatttggtagtttattactgtcagctagtataatacgtgtcctctctacgttcggcggtaggaccgaagggtggagagtcgaaacgacgtgtaggctagcncgntcg

SEQ ID NO: 226312 - DNA, 545 bp, Homo sapiens
  misc_feature: GYAE6OF01CT4HN.4.51.E07.1.454.CMB.1.raw
  modified_base (207)..(207): a, c, t, g, unknown or other
  misc_feature (207)..(207): n is a, c, g, or t
  modified_base (541)..(541): a, c, t, g, unknown or other
  misc_feature (541)..(541): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagagtgttaggagcaacttagcctggtaccagcaataaacctggccaggcctccccgaggcctcctcattcctatggtgcatcccaaccgacgggccctacgtcggtactccccgagccctacgttcaggtcggcaggtcgggtctggggacacgtagttcactctcaccatcagcagccctgctagtctagtaagtatttggattttatactgtcagctagtataactactcgcctactctacgtttcggcggaacgggtaccaagggtggaatataccgaaacgtagttcggtaggctagactaccngttc

SEQ ID NO: 226313 - DNA, 503 bp, Homo sapiens
  misc_feature: GYAE6OF01BPNT5.4.51.E07.1.454.CMB.1.raw
  modified_base (207)..(207): a, c, t, g, unknown or other
  misc_feature (207)..(207): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagagtgtaggagcaattagcctggtaccagcataaacctgccaggctcccaggctcctcatctatggtgcatccaccagggccacgtcggtactcccagcctacgttcacgtggcaggtgggtctggggacacgagttcactctcaccatcagcagcctgcagtctgaagtntttggtagtttattactgtctagctagtataatactggtcctntctacgttcggcggaggaccgaggtgagatcaacgtacgtgtcgctgacncgntcg

SEQ ID NO: 226314 - DNA, 551 bp, Homo sapiens
  misc_feature: GYAE6OF01B6SHT.4.51.E07.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgtaggngcaattagcctggtaccagcataaacctggccaggctcccaggctcctcatctatggtncatccacgagggccactggtactcccagccagttcagtgcaggtgggtctgggacacgagttcacttcncaccatcagcacgcctgcacgtctagtagtattttggtatttacttagtgtcagtcaagttataacttaactcggtccttactcgtacgtttcgggacggtaacgggaccgtaagggtcggaagtacgtaaccgaaaacggtaaccgttggtacggtactacggacctaacccgtgttaccg

SEQ ID NO: 226315 - DNA, 508 bp, Homo sapiens
  misc_feature: GYAE6OF01AGN3Q.4.51.E07.1.454.CMB.1.raw
  modified_base (205)..(205): a, c, t, g, unknown or other
  misc_feature (205)..(205): n is a, c, g, or t
  modified_base (505)..(505): a, c, t, g, unknown or other
  misc_feature (505)..(505): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaggagcaacttagcctggtaccagcataacctggccaggctcccaggctcctcatctatggtgcatccaccagggccacgtggtactcccgagccctacgttcagtggcaggtgggtctgggacacgagttcactctcaccatcagcacgcctgcagtctgaagtatttggtagtttattactgtcagtcagtataatactgccttctctacgtttcggcggtacggaccgaaggtggagatacgaaacgtactgtacgctagcacntcg

SEQ ID NO: 226316 - DNA, 620 bp, Homo sapiens
  misc_feature: GYAE6OF01C14BZ.4.51.E07.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctcgaaggggaangccaccctntcctgcagggccagtcagagtgtaggancaattgcctggaccagcaagtaaaccgtggccaggcctaccgaggtcctcctcattctagtggtcncacgtcccaccgagggccaacgtggtaacctcccgacgccctacgttcgaggtggcctaggtcggggtctaggggacctacgtagttccaactctaccaccgataccgacgctacggccctagacgtacgttacgtaggtaaagtttcgtttagggtaattttagtacgttggtacaacgtacgtaagttataaacgttaacgtcggttccttacgtacgttaccggttcggacgtagggtaaccggtaacggtagggaagtacgtaccgaaacggtaacgtaggtcggtacgtacgtccgacgtacttcg

SEQ ID NO: 226317 - DNA, 521 bp, Homo sapiens
  misc_feature: GYAE6OF01EEI7Y.4.51.E07.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (404)..(404): a, c, t, g, unknown or other
  misc_feature (404)..(404): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctntcctgcagggccagtcagagtgttaggagcaacttagcctggtaccagcataaacctggccaggctcccaggctcctcatctatggtgcatccaccagggccacgtggtactcccagcccacgttcagtggcaggtgggtctggggacacgtagttcactctcaccatcagcagcctgcagtctagaagtnttttggagtttattactgtcagctagtataataactgtctctctacgttcgggacggacgggaccgtagggtgagtacgtacgaaacgtagtggtacgctaggacctacgtagtccg

SEQ ID NO: 226318 - DNA, 557 bp, Homo sapiens
  misc_feature: GYAE6OF01BD3QF.4.51.E07.1.454.CMB.1.raw
  modified_base (205)..(205): a, c, t, g, unknown or other
  misc_feature (205)..(205): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccacctctcctgcagggccagtcagagtgttaggagcaacttagcctggtaccagcataaacctggccaggctcccaggctcctcatctatggtgcactcccaccgaggggccacgtggtactcccagcccacgttcaggtggcaggtgggtctgggacacgtagttcactctcacatcagcagccctgcagtctagtaagtagttttggtatttatactgtctagctagtataataactggaccttctactaccgtttcgggacggtacgggaaccgtaagggtggtaagagttacccgaaaacggtaacgttgggtacgggtactacggaccctaccgtacgttccgg

SEQ ID NO: 226319 - DNA, 509 bp, Homo sapiens
  misc_feature: GYAE6OF01CXI29.4.51.E07.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (506)..(506): a, c, t, g, unknown or other
  misc_feature (506)..(506): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaggagcaacttagcctggtaccagcataaacctggccaggctccaggctcctcatctatggtncatccaccgagggccacgtggtactcccagcccacgtttcagtggcaggtgggctggggacacagttcactctcaccatcagcagccctgcagtctagaagtagttttggagttttattactgtacagctaagtataatactggtcctctctacgtttcggcggagggtaccaagggtggagatacaaacgatgtggctgcacntcg

SEQ ID NO: 226320 - DNA, 496 bp, Homo sapiens
  misc_feature: GYAE6OF01BWQB0.4.51.E07.1.454.CMB.1.raw
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcataaacctggccaggctcccaggctcctcatctatggtgcatccaccagggccactggtatcccagccacgttcagtggcaggtgggtctggggacacagttcactctcaccatcagcagcctgcagtctgaagtattttggatttatactgtcagcagtataataactgctctctacgtttcggcggaggaccaagggtgagatcaaacgactgtaggctagcnccgntcg

SEQ ID NO: 226321 - DNA, 545 bp, Homo sapiens
  misc_feature: GYAE6OF01AKFDR.4.51.E07.1.454.CMB.1.raw
  modified_base (206)..(206): a, c, t, g, unknown or other
  misc_feature (206)..(206): n is a, c, g, or t
  modified_base (437)..(437): a, c, t, g, unknown or other
  misc_feature (437)..(437): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttaggagcaacttagcctggtaccagcataaacctggccaggcctcccaggcctcctcatctatggtgcactcccaccgagggccacgtggtactcccagcccacgttcagtcggcaggtgggtctggggacacgtagttcacttcacacctatcagcagcctgcagtctagtaagtagtttggatttatcgtgtcagtntagtataatactgtcctctcgtacgttcgggacggtacgggtaccgaggtggaagtaacgtaccgaaaacggtaccgtgggtacggtctacggacctaccgtgttccg

SEQ ID NO: 226322 - DNA, 495 bp, Homo sapiens
  misc_feature: GYAE6OF01BXFI8.4.51.E07.1.454.CMB.1.raw
  modified_base (491)..(491): a, c, t, g, unknown or other
  misc_feature (491)..(491): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcataaacctggccaggctcccaggctcctcatctatggtgcatccaccagggccactggtatcccagccacgttcagtggcagtgggtctgggacacgagttcactctcaccatcagcagcctgcagtctgaagtatttggagtttatactgtcagcagtataatactgcctctcactttcggcggtagggaccaagggtgagatcgaaacgactgtggctagcaccngtcg

SEQ ID NO: 226323 - DNA, 551 bp, Homo sapiens
  misc_feature: GYAE6OF01EV8JI.4.51.E07.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (304)..(304): a, c, t, g, unknown or other
  misc_feature (304)..(304): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaangccaccctctcctgcagggccagtcagagtgttaggancaacttagcctggtaccagcataaacctggccaggcctcccaggctcctcatctatggtncatccacagggccactggtactcccagccacgttcagtggctaggtgggtctggggacacgtagttcactctacaccatcagcagcctgctagtctagtaagtagttttggtagtttattactgtcagtctaagtataatacgtggtccttctctacgtttcgggcgggtacgggacccgtaagggtcggaagtaacgtaccgaaaacggtacgtcggtacggactacggacctaaccgagttaccg

SEQ ID NO: 226324 - DNA, 557 bp, Homo sapiens
  misc_feature: GYAE6OF01B1XOH.4.51.E07.1.454.CMB.1.raw
  modified_base (206)..(206): a, c, t, g, unknown or other
  misc_feature (206)..(206): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttaggagcaacttagcctggtaccagcaataaacctggccaggctcccaggcctcctcatctatggtgcactccaccgagggccacgtggtactcccgacgcccacgttcaggtggcaggtgggtctagggacacgagttccactctacaccatcagcagcctgctagtctagaagtgtttaggtatttatacgtgtacagtcaagttataagttaaccgtggcccttagtcctacggtttcgggacggtacgggacctaaggggtcgaagacgtacgaaaacggtacttgggtcgactaggacctaccgtgttcccg

SEQ ID NO: 226325 - DNA, 566 bp, Homo sapiens
  misc_feature: GYAE6OF01B0AIC.4.51.E07.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
tcagagcactgtagcacgaccggtgctcgatttagcatactctacaacacacaaagggggaggaactgctcagttaggacccagacggaaccatggaagccccagcgcagcttctcttccgtcctgctactctggctcccagataccactggagaaatagtgatgacgcagtctccagccaccctgtctgtgtctccgaggggaaancgccaccctctcctgcagggccagtcagagtgttaggncaacttagcctggtaccagcataaacctggccaggcctcccgaggcctcctcactctatggtgcatccagcagggccaactggacactcccagaccaggttcagtggctaggtgggtctgggactagtacttcactctcaccatcagcagactggagccgtaggtaagtagttttgctagtagtattacgtgtacagtcctagttcggtggtacgtccgtacgacccggtacggttccggaaccgtaacggggaccctaagttacggtacggtaaactaacccgaaacggtaacgtacggtagggcctaggccctaacccg

SEQ ID NO: 226326 - DNA, 526 bp, Homo sapiens
  misc_feature: GYAE6OF01EYIZN.4.51.E07.1.454.CMB.1.raw
  modified_base (204)..(204): a, c, t, g, unknown or other
  misc_feature (204)..(204): n is a, c, g, or t
  modified_base (521)..(521): a, c, t, g, unknown or other
  misc_feature (521)..(521): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttaggagcaacttagcctggtaccagcataaacctggccaggcctcccaggctcctcatctatggtgcactccaccagggccacgtggtactcccagccacgttcagtggcagtgggtctgggacacagttcactctcaccatcagcagcctgctagtctagaagttagttttggagtttattactgtcagtcagtataatacgtgtcctctactacgtttcgggacggtagggaccgtagggtcggagacgtacgaaacgtagtcggtacggactagcctacgngtccg

SEQ ID NO: 226327 - DNA, 602 bp, Homo sapiens
  misc_feature: GYAE6OF01D7JXN.4.51.E07.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaancgccaccctctcctgcagggccagtcagagtgtagganctaacttagcctggtaccagacaactaaaccgtggaccaggcctcccgagggcctcctacattctagtcggtcgcacgtcccaccgacgggtaccacgtggtacctcccgacgcctacgttcaggtcggcgtaggttcgggtctaggggaccacgtagttcacgttccacacctactcacgcagtccctagcgtagtcctagtaacgttagtttggtattttatacgttagtactagtactaagtaataacgtacgtcgtccttatacgtacgttcgggacggtacggtaccgtaagggtcgtaagacgaacgtaaacgtaccgttagggttacgacgttaggtaccaccgtgttccg

SEQ ID NO: 226328 - DNA, 502 bp, Homo sapiens
  misc_feature: GYAE6OF01B8M3H.4.51.E07.1.454.CMB.1.raw
  modified_base (371)..(371): a, c, t, g, unknown or other
  misc_feature (371)..(371): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcataaacctggccaggctcccaggctcctcatctatggtgcatccaccagggccactggtactcccagccacgttcagtggcagtgggtctgggacacagttcactcncacatcagcagccctgcagtctgaagtattttggattttattactgtcagcagtataataactgccttctctacgtttcggacggagggaccaagggtcggagatacgaaacgaatgtggcngccacntcg

SEQ ID NO: 226329 - DNA, 522 bp, Homo sapiens
  misc_feature: GYAE6OF01CF4D8.4.51.E07.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (404)..(404): a, c, t, g, unknown or other
  misc_feature (404)..(404): n is a, c, g, or t
  modified_base (517)..(517): a, c, t, g, unknown or other
  misc_feature (517)..(517): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaggagcaacttagcctggtaccagcataaacctggccaggctcccaggctcctcatctatggtncatcccaccagggccacgtggtactcccagcccacgttcagtggcaggtgggtctgggacacgagttcactctcaccatcagcagcctgcagtctgaagtnttttggattttattactgtcagctaagtataatactggtcctctctacgtttcggcggtagggaccgtaagggtggagacgtacgaaacgtacgtggtacggctagccacgtnttccg

SEQ ID NO: 226330 - DNA, 497 bp, Homo sapiens
  misc_feature: GYAE6OF01AQ4F5.4.51.E07.1.454.CMB.1.raw
  modified_base (205)..(205): a, c, t, g, unknown or other
  misc_feature (205)..(205): n is a, c, g, or t
  modified_base (490)..(490): a, c, t, g, unknown or other
  misc_feature (490)..(490): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaggagcaacttagcctggtaccagcataaacctggccaggctcccaggctcctcatctatggtgcatccaccagggccactggtatcccagccacgttcagtgcagtggtctgggacacagttcactctcaccatcagcacgcctgcagtctgaacgtattttggatttatactgtcagcagtataataactgtcctctctacgtttcggcggacgggaccaagggtggagatcgaaacgatgtggctagcncgtatcg

SEQ ID NO: 226331 - DNA, 528 bp, Homo sapiens
  misc_feature: GYAE6OF01BYW9X.4.51.E07.1.454.CMB.1.raw
  modified_base (205)..(205): a, c, t, g, unknown or other
  misc_feature (205)..(205): n is a, c, g, or t
  modified_base (520)..(520): a, c, t, g, unknown or other
  misc_feature (520)..(520): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaggagcaacttagcctggtaccagcataaacctggccaggctcccaggctcctcatctatggtgcatcccaccgagggccactggtactcccagccacgttcagtggcaggtgggtctggggacacgtagttccacgtctcaccatcagccagccctgcagtctgaagtatttggtagtttattacttgtcagctaagtataataacgtggtccctcgtctacgtttcgggcggtagggaccgaagggtcgagacgtacgaaacgagttcgtcggactagcnccgtgtcg

SEQ ID NO: 226332 - DNA, 520 bp, Homo sapiens
  misc_feature: GYAE6OF01DOS7T.4.51.E07.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
  modified_base (408)..(408): a, c, t, g, unknown or other
  misc_feature (408)..(408): n is a, c, g, or t
  modified_base (514)..(514): a, c, t, g, unknown or other
  misc_feature (514)..(514): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgccacctctcctgcaggccagtcagagtgttaggancaattagcctggtaccagcaataaacctggccaggctccaggctcctcatctatggtncatccacgagggccacgtggtactcccgagcctacgttcagtcggctaggtgggtctgggacacgtagttcactctcacatcacgcacgcctgctagtctagtaagtnttttggagttttattactgtcagtactagtataatactcggtcctctcgtacgttcggacggacggtaccaagggtgagactacgaaacgtagcggtcgactgacnctgtcg

SEQ ID NO: 226333 - DNA, 548 bp, Homo sapiens
  misc_feature: GYAE6OF01A3QXF.4.51.E07.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagngtgttaggancaacttagcctggtaccagcataaacctggccaggcctcccaggcctcctcatctatggtgcactcccaccgagggcccacgtggtactcccagcccacgttcagtggcaggtgggtctggggacacgagttccactctaccaccatcagcacgccctgctagtctagaagttagttttggtagttttattacgtgtacagctaagttataagtaacgtcgtcctctcgtacgtttcggacggtagggaccgaagggtcggaggaactacgaaacgtctaggtggactgactccgtagttccg

SEQ ID NO: 226334 - DNA, 755 bp, Homo sapiens
  misc_feature: GYAE6OF01DBH1X.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggaagaaatagtgatgacgcagtctccagccaccctgtctgtcgtctaccgaaggggaaacacgcccaccctctccgtgaccgacgggccagtcaaggtagttggttaaggagtacctaaacgttacgccgttagggtaccaggacctaaacgtaaacccgtcgggacccaacgggccctaccccgacgggtcccttccctacacttaccgtagtcggtcgacctactcccgaaccgacgggtaccctaacgttcggtacctacccgacgtacccgtacgttaccgaggtcggacgtagggtcgggtcgtacggggacaacgtacgtccacgtcctaccaacctataccgacgcgtacgtccctgtaccgtagttacgtaggtaacgtttagttttaggtaacttttagtaccgttagtaccaacggtcgttaaagttaataaccgttaacgttccggtaccctttaccgtaccgttaaccgggtttacggggaccgggtaaacgggtaaccgtaaggggtacggttaacggaaacttaacccggaaaacggttaaccgttcgggtaccgggtacctaccggtaccctaaacccgtgtttacccgg

SEQ ID NO: 226335 - DNA, 543 bp, Homo sapiens
  misc_feature: GYAE6OF01ADYDJ.4.51.E07.1.454.CMB.1.raw
  modified_base (206)..(206): a, c, t, g, unknown or other
  misc_feature (206)..(206): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttaggagcaacttagcctggtaccagcataaacctggaccaggcctcccaggcctcctcatctatggtgcatccaccgacgggccacgtggtactcccagcccacgttcaggtggcaggtgggtctcggggacacgtagttcactctcaccatcagcacgcctgcagtctagagtatttggatttatacgtgtctagctagtataatacgtgtccttctctacgttcgggacggtacgggtaacgaagggttggaagtagtaccgaaacggtacgtacggtcgggactacggactaccgtgttccg

SEQ ID NO: 226336 - DNA, 659 bp, Homo sapiens
  misc_feature: GYAE6OF01ACP1Y.4.51.E07.1.454.CMB.1.raw
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaangccaccctctcctgcagggccagtcagagtgttaggagcaacttagcctggtaccagcaataacctggccaggcctccccgaggcctcctcatctagtggtnctatcccaccgtgggccctacgtggtactccccgaggccctacggttccaggttcggccgtaggttcgggtctaggggaccacgtagttccacttcctaccacccagtaccagccacgtccctggactaggttcctagggtaaacgtttgttttacgggagtttttacttacgtgttaccgagtacgtaagttaataaccgttaacgttccggtacctttccttaccgttaccggtttccggggaccgggtaaacggggtaacccgtaaggggttcgggtaacgtaacgttaaccggaaaaaccggtacgtttgggtaccgggtactacggaccctaaccgtgttacccgg

SEQ ID NO: 226337 - DNA, 585 bp, Homo sapiens
  misc_feature: GYAE6OF01DD92P.4.51.E07.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccaccctctcctgcagggccagtcagagtgtaggancaacttagcctggtaccagcataaacctggccaggctcccaggctcctcatctatggtgcatcccaccgagggcccacgtcggtactcccgaagccctaacgttcaggtcggctaggtgggtctggggactacgtgttcactctcacctatcagcacgcctgctagtctagtaagttagttttggagttttacttacgtgttacagtaccttaagttaacttaaataaccgtcggtacccttcgtaccgtacgtttaccgggacgggtacgggaccgtaaggggtggaacgtataaccgaaaccggtagttcggtacggacctgacctaccgtagttccg

SEQ ID NO: 226338 - DNA, 523 bp, Homo sapiens
  misc_feature: GYAE6OF01B1M9S.4.51.E07.1.454.CMB.1.raw
  modified_base (205)..(205): a, c, t, g, unknown or other
  misc_feature (205)..(205): n is a, c, g, or t
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
  modified_base (518)..(518): a, c, t, g, unknown or other
  misc_feature (518)..(518): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaggagcaacttagcctggtaccagcataaacctgccaggctcccagctcctcatctatggtgcatccaccagggccacgtggtactcccagccacgttcagtggcagtgggtctggggacacgagttcactctcaccatcagcagccctgcagtctgaagtattttggatttattactgtaccngctagtataagtactgacctntactcgtttcgggcggtagggaccgtaagggtcggaagactacgaaacgtaacgtggtcggactgacctaccgnttccg

SEQ ID NO: 226339 - DNA, 589 bp, Homo sapiens
  misc_feature: GYAE6OF01DKJA2.4.51.E07.1.454.CMB.1.raw
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
  modified_base (421)..(421): a, c, t, g, unknown or other
  misc_feature (421)..(421): n is a, c, g, or t
  modified_base (583)..(583): a, c, t, g, unknown or other
  misc_feature (583)..(583): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaanacgccacccctctccctggcagggcccagtcagagtgttaggagcaacgttagcctggtacccagcataaacctgccaggctccaggctcctcatctatggtcncatcccaccagggcctacgtggtactcccagcctacgttcagtggcaggtgggtctgggacagtacgttcactctacacatccaagtcacgcctgctagtctagaagttntttgggagttttatacgttgtctaggactaaggttataacgttaacgtcggtaccttccgtacttaccggtttacgggaccgggtacgggtaacccgtaaggggtacgtaaggacttaaaccggaaaacgtacgttaggtccgggtactaggacctaccgtnttacgg

SEQ ID NO: 226340 - DNA, 504 bp, Homo sapiens
  misc_feature: GYAE6OF01A7DOA.4.51.E07.1.454.CMB.1.raw
  modified_base (205)..(205): a, c, t, g, unknown or other
  misc_feature (205)..(205): n is a, c, g, or t
  modified_base (501)..(501): a, c, t, g, unknown or other
  misc_feature (501)..(501): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaggagcaacttagcctggtaccagcataaacctggccaggctcccaggctcctcatctatggtgcatccaccagggccactggtatcccagcccacgttcagtggcagtgggtctggggacacagttcactctcaccatcagcagccctgcagtctgaagtattttggagttttattactgtcagcagtataataactggcctctcacgtttcggcggtagggaccaagggtggagatcaaacgtactgtcggctgcaccgntcg

SEQ ID NO: 226341 - DNA, 557 bp, Homo sapiens
  misc_feature: GYAE6OF01CHOY4.4.51.E07.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (407)..(407): a, c, t, g, unknown or other
  misc_feature (407)..(407): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaancgccaccctctcctgcagggccagtcagagtgttaggngcaacttagcctggtaccagcaataaacctggccaggctcccaggcctcctcatctatggtgcatccaccagggccacgtggtactcccagccacgttcaggtggcaggtcgggtctgggacacagttcactctcaccatcagcagcctgcagtctagaagttntttggtattttattactgtccagctaagttataacttaacgtggtcccttactccgtacgtttccgggacgggtacgggtaaaccgtaggggtcggaagtacgtaaccgaaaacggtaacgttggtacggcttaggcctaccgtattccg

SEQ ID NO: 226342 - DNA, 608 bp, Homo sapiens
  misc_feature: GYAE6OF01EPR8C.4.51.E07.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagccaccctntcctgcagggccagtcagagtgttaggagcaacttagcctggtaccagcaataaacctggccaggcctccgaggtcctcctcatctatggtcgcactccaccgagggcctacgtcggtactccccgagtccctacggtttcaggttcggccgtaggtcgggtctggggacacgtagttcactctcaccactcacgcacgcctgctagtctagaagtattttgactaggttgttagttacgtgtacgagtcgtaggttcgttgggttactcgtacccgaccggtaccggttaccgggtaccgtaaacggggtaccgtaaagggttacggaaaacgttaccgaaaaccggtaacgttacgggtacggacgttacggacctaacccgtgttacccg

SEQ ID NO: 226343 - DNA, 698 bp, Homo sapiens
  misc_feature: GYAE6OF01BT7SG.4.51.E07.1.454.CMB.1.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggaagaaatgtgatgacgcagtctccagcccacctgtctgtgtctccgaggggaaacncgccaccctctccngcaggccagtcagagtgttagnctacttagctggtaccagcataaccnggacaggctcccgaggcctcgtcattcatggtgcactcccacgacgggccaacgtcggtactcccgaacgcccgtacgttcaggtcggacgtacgggttggtacgtacgggtacaccgttacggtttccacttctccactcgtacacggcacggtccctagacctaagttccgtaagtaacggtttatttttggggtaaacttttttacgttaccgttacggttagtaacgggttactaaggtttaaccttaacgttaaccgttacgggtcccttaccgttaccgtaccggttttacggggaccgggttaaacgggaaccgttaacgggggtacggtaacggtaacgttaaaccccgtaaacggggttaacccgttacgggttaccgggtaccctttaaccgggaccttaaacccgtcgttttacccgg

SEQ ID NO: 226344 - DNA, 624 bp, Homo sapiens
  misc_feature: GYAE6OF01BJ48T.4.51.E07.1.454.CMB.1.raw
  modified_base (206)..(206): a, c, t, g, unknown or other
  misc_feature (206)..(206): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagtagtgttaggagcaacgttagcctggtaccagacaataacctggccaggctcccgaggcctccgtcattccgtagtcggtcgcactccaccgacgggcctacgtgtactcccacgccctacggttcaggtcggcgtacgggtgggtcgtcggggacacgtaggttccacgttctaccacctagtcctaaggccacgtcccgtagactagttaccgtaggtaaacgttgtttttagggtaattttagttacgttgtactaagtactaagttaacttaaacgtacgttcgtacccttactccgttacgttcgggaccgggaacggtaaccggtaagggtcggtaagacgtaacgaaacgtacggtagtcggtactacgcctaacgtcgttcg

SEQ ID NO: 226345 - DNA, 568 bp, Homo sapiens
  misc_feature: GYAE6OF01BVXOY.4.51.E07.1.454.CMB.1.raw
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttaggagcaacttagcctggtaccagcaataaaccgtggccaggcctcccaggcctctcatctatggtncatcccacgagggccacgtggtactcccagccacgttcaggtggcaggttcgggtctggggacacgtagttccactcncaccntcagcacgcctgctagtctagaagttgtttggattttatctgtcagctagtataagtactcgcctgtcgtacgttcgggacggtacgggaaccgtaaggggtcggtaagtaacgttaaccgaaaaccgggttacgttcgggtacgggtaccctacggaccctaaccgtcgtttacccgg

SEQ ID NO: 226346 - DNA, 771 bp, Homo sapiens
  misc_feature: GYAE6OF01ENQPE.4.51.E07.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (311)..(311): a, c, t, g, unknown or other
  misc_feature (311)..(311): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaancgcccacctctcctgcagggccagtcagagtgtagganctaactagcctaggtaccagcaataaccgtggccaggcctcccgaggtcctcctcatctagtgggtcncactccgacgacgggcctacgtcggtactcccgagccctagttcagggtcggactagggttcgggtcgtaggggacctacgtacggttccaaccgttcctacccgaacctacgtaccgacgaccgtacgtcccgttaggacctaacggttaccgttaagggtaaacggttttacggttttttacggggttaaacgttttttaacgttacgtttacggttaccgtaacggtaacgttaaacggtttaaacttaaaaccgtttaaccggttaccgggttacccctttaccgttaacccggttaccgggtttaccgggggaaccggggttaaaccggggtaaacccggttaaagggggttaccgggtaaacggttaaaccggttaaaccggtaaaaaccgggttacggttcggggttaaccgggtaccgtaacgggtaccccttaaaccggtcgtttacccgg

SEQ ID NO: 226347 - DNA, 584 bp, Homo sapiens
  misc_feature: GYAE6OF01ET8S5.4.51.E07.1.454.CMB.1.raw
  modified_base (313)..(313): a, c, t, g, unknown or other
  misc_feature (313)..(313): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgagggggaaagacgccaccctctcctgccagggccagtcagagtgtagagcaacttagcctggtaccagcaataaaccgtggccaggcctccccgaggcctcctcattctatggtncctatcccaccgagggccacgtcggtactccccgagccctacgttcaggttcggcgtaggttcgggtcgtggggacacgtagttccacttctcaccatcagcagccctgctagtctagtaacgttagtttaggtagtttattactgttacagtactaagtaataagtactcggtcccttcgtacgtacgtttcgggacggtacgggacgtaagggtggaaggacgtaaccgaaacgtacgtcgggtcggacgtacgacctaccgtgttccg

SEQ ID NO: 226348 - DNA, 530 bp, Homo sapiens
  misc_feature: GYAE6OF01BBHAO.4.51.E07.1.454.CMB.1.raw
  modified_base (499)..(499): a, c, t, g, unknown or other
  misc_feature (499)..(499): n is a, c, g, or t
  modified_base (526)..(526): a, c, t, g, unknown or other
  misc_feature (526)..(526): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccaccctctccctgcagggccagtcagagtggttaggagcaacttagcctggtaccagacataacctggccaggcctcccgaggcctcctcatctatggtgcactccacgagggccacgtggtactcccagccacgttcagtgcgtaggtcgggtctgggacacgtaggttcactctcacatcacgcacgtcctgcacgtctagtaagtattttggatttagttactgtacagctaagttataatacgtcgtcctactcgtacgttcggcggacggtaccgaggtcgganacgtacgaacgagtgtagactgctcgngttc

SEQ ID NO: 226349 - DNA, 645 bp, Homo sapiens
  misc_feature: GYAE6OF01AULZ5.4.51.E07.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcgagggccagtcagagtgttaggancaacttagcctggtaccngacataacctggaccaggcctcccgaggcctccgtcacttctatggtcgcactcccgacgacgggccacgtggtactcccgagccctacggttcaggtcggcctagggttcgggtccgtggggacctacgtacggttaccacttcctacaccctatcgacgcacgtcccgtgcctagtacctaggtaagtttagttttaggtaagttttattacgttcgtaccagtaccgtaagttaacgttaactacgttccggtcccttacgttaccgttacggtttccgggacggggtaaacgggtacccggtaagggtacggaagttacgtaaccgaaaacggttacgttggtaccgggtacttacggaccctaacgttcgtttccg

SEQ ID NO: 226350 - DNA, 802 bp, Homo sapiens
  misc_feature: GYAE6OF01DO9G7.4.51.E07.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtgtaggancaacttagcctggtaccagcataaacctggccaggctcccaggctcctcatctatggtcgcactcccaaccgacgggccctacgtcggtactccccgaagcccgtaaccgtttcaaggttcgggacctagggttcgggtaccgttaggggaaccctacgtacggtttaccctaccgttccctaccgtaaccctacgttcccgaaaggcccgtaaaccggtcccccgttaggacccgttaaacggttcccgttaaggggtaaacgttttacggtttttttacggggtaaacgttttttttaacgtttaaccgtttacgggttaccgtaacggttaacccgttaaagggtttaaaacttttaaaccggttaaacccggtttcccggggttaacccctttacccgtttaccgttaaccgggttttacccgggggaaccggggtaaaccgggggtaaccgtaaagggggttacggaaaacggttacgttaaacccggaaaaaccgggttacgttacgggttacgggaccttaaccggacctaaacccgtcggtttaacccg

SEQ ID NO: 226351 - DNA, 564 bp, Homo sapiens
  misc_feature: GYAE6OF01CCGH2.4.51.E07.1.454.CMB.1.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (351)..(351): a, c, t, g, unknown or other
  misc_feature (351)..(351): n is a, c, g, or t
  modified_base (561)..(561): a, c, t, g, unknown or other
  misc_feature (561)..(561): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaancgccaccctctcctgcgagggccagtcagagtgttaggancaacttagcctggtaccagcaataaccgtggccaggcctccccgaggtcctccgtcacttcctagtgggtcgacactcccgaaccgacggggccctagttcggtacncccgagccctacgttcaggtggctaggtcgggtctagggacacgtagttcactctacaccatcagcacgtcctgctagtctaggtaagttgttttggtattttattacgtgtacagtctaagttataactacgtcgtccttcgtacgtcgttacgggcggtacggacgtagggtgagtactacgaacgtagtggtacggctagctacgtntcg

SEQ ID NO: 226352 - DNA, 601 bp, Homo sapiens
  misc_feature: GYAE6OF01AI980.4.51.E07.1.454.CMB.1.raw
  modified_base (206)..(206): a, c, t, g, unknown or other
  misc_feature (206)..(206): n is a, c, g, or t
  modified_base (243)..(243): a, c, t, g, unknown or other
  misc_feature (243)..(243): n is a, c, g, or t
  modified_base (303)..(303): a, c, t, g, unknown or other
  misc_feature (303)..(303): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtaggancaacttagcctggtaccagcataacctggccaggctcccaggcctcctcatctatggtcncactcccaccgagggcccacgttggtactccccgagtcccacgtttcaggtcggactagggtcgggtctggggacctacgtacgttccactcctacaccatcacgcacgccctgctagtctaggtaagttagttttggtaacgtttagttacgttgtacgtagtactaaggttacttaaagttaccgtcgtaccttacgttactaccggtttcgggacggtaacggggaaccgtaaggggtggaacgtacgtaaccgaaacgtaacgtcgggtacgacgtacgacctaccgtgttccg

SEQ ID NO: 226353 - DNA, 614 bp, Homo sapiens
  misc_feature: GYAE6OF01D8ZAS.4.51.E07.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (311)..(311): a, c, t, g, unknown or other
  misc_feature (311)..(311): n is a, c, g, or t
  modified_base (560)..(560): a, c, t, g, unknown or other
  misc_feature (560)..(560): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactgganaaatgtgatgacgcagtctccagccacctgtctgtgtctccaggggaaancgcccaccctntcctgcgagggccagtcagagtgttaggagcaacttagcctggtaccagcaataaaccgtggccaggcctcccgaggcctcctcattctagtggtcncactccaaccgagggccacgtggtactcccgagaccctacgttcgaggttggacgtaggtcggggtctcgggactacgtgttcacctcaccacctatccgagtccacgtccgtcgactaggtccagttaagttgtttcggtaagttttacttacgtgtcaggtactaagttaataacgtacgttcggtaccttcgttacgtaccggtttgggacccgggtaacgggtaaccggtaagggtacgggtaanacggttaacgaaacggtaccgttgggtacgtcgtacgaccctaacgcttaccgg

SEQ ID NO: 226354 - DNA, 617 bp, Homo sapiens
  misc_feature: GYAE6OF01BRJWF.4.51.E07.1.454.CMB.1.raw
  modified_base (614)..(614): a, c, t, g, unknown or other
  misc_feature (614)..(614): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggaagaaatagtgatgacgcagtctccagcccaccctgtctgtgtctccgaaggggaaagcgccaccctctcctgcgaggccagtcagagtgtaggagacaacgttgcctggtaccagcaactaaccgtggaccacggcctcccgaggtcctcctctattcgtagtcggtcgcacgtcccacgacgggcctacgtcggtacctcccgagtcccgtacgttcgaggtcggcgtagggttcgggtcgtcgggactacgtacgttccaccttctaccacctacgtaccgacgccacgtcctgacgtagtcgttagtaagtttgttttaggtatttacttacgtgtacgtagtactaagttaacttaacgttaaccgtggttacccttcgtacgtacggttccgggacgggtaacggacgtaagggtgacgtaacgacgaacgtacgtggtacgactacgacctacgtntcg

SEQ ID NO: 226355 - DNA, 629 bp, Homo sapiens
  misc_feature: GYAE6OF01EOJTW.4.51.E07.1.454.CMB.1.raw
  modified_base (625)..(625): a, c, t, g, unknown or other
  misc_feature (625)..(625): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccaccctctcctgcagggccagtcagagtgttaggagcaacttagcctggtaccagcaacgtaacctggccaggcctcccgaggcctcctcactctagtggtgcacgtcccaccgacgggcctacgtcggtactcccgagccaggttcaggtggctagggtcgggctgggacctagtacgttccacttcctaccacctagtccagctacgtccctagcctacggttctaggtaaggtttacgtttttacggtagtttttactacggttgtaccgtagtcgttaagttaacttaaacgtaacgttccggtacccttcgttacgttaccggtttccgggacgggtaacgggtaacccgtaaagggggtcgtaagtactaacgaaacgggttactgggtacgtactacgacctaccgtnttcg

SEQ ID NO: 226356 - DNA, 804 bp, Homo sapiens
  misc_feature: GYAE6OF01BBJR5.4.51.E07.1.454.CMB.1.raw
  modified_base (206)..(206): a, c, t, g, unknown or other
  misc_feature (206)..(206): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatgtgatgacgcagtctccagcccacctgtctgtcgtctccgaaggggaancgcccaccctctcctgcgagggccagtcagagtgttaggagctaacgttagccgtaggtaccagactaacgtaaaccgtcggaccctacgggcccttaccccgaggtcccttcccgtacctacgtttaccgtaggttcgggttcgacctaaccgttacccccgaaaccgggtaccggggaccccttaccggttacgggttaacccctacccccgacggtaccctacggtttaccgagggttcggacgtagggttcgggtccgtacggggacctacggtacgtttacccaccgttaccacccgtaacctctaccgagcccgacgtcccgtagccgtaacgttcgtaagttaacggttttacggttttaggttaactttttactacggttcgtacgtaacgtacgttaaatttaacgtaacgttaacccggttccggttacccttaccgttacccggttacggggtttaccggggaaccggggttaaaccgggaaccgggttaaagggtacgggtaaacgtaaccggttaaaccgaaaaccggtttaccgggttcgtacggggttaccctaccgggtaacccttaccgttcgttacccgg

SEQ ID NO: 226357 - DNA, 696 bp, Homo sapiens
  misc_feature: GYAE6OF01ALEEV.4.51.E07.1.454.CMB.1.raw
  modified_base (210)..(210): a, c, t, g, unknown or other
  misc_feature (210)..(210): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggaagaaatagtgatgacgcagtctccagcccaccctgtctgtgtcctccgaaggggaaancgcccaccctctcctgcgagggccagtcagagtgttaggagctaacttgcctggtaccagcaataaaccgtggccaggcctccccaggcctcctcatctagtggtgctactcccacgacgggccacgtggtacctcccgagccctacgttcgaggtcggcgtagggttcgggtcgtacggggacacgttacggttcccaccgttcctacgtacccattcgaacgcctaacgtccctggactacggttactagggtaaagtttacggttttagggtaactttttaacgttcgttcgtacgtagtaacctaagttaacgtaaacttaaccggttcgtacccctttacggttaccgttaacggttttaccggggaccggggtaaaccgggtaacccggtaaagggggttcggaaacgtacggttaaacccggaaaaacggtttacgttacgggtcgggtacctacggtacccgtaaccgttcttaccgg

SEQ ID NO: 226358 - DNA, 569 bp, Homo sapiens
  misc_feature: GYAE6OF01A2XUV.4.51.E07.1.454.CMB.1.raw
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcccaccctctcctgcagggccagtcaggagtgttaggancaacttagcctggtaccagcaataaaccgtggccaggcctcccgaggcctcctnatctatcggtncactccacgagggccacgtggtactcccagcctacgttnagtcggctaggtcggtcngggacacgtagtcactcacactatcagcacgctgcagtctagtaagttgtttggtagtttacttactgtacagtactaagtactaacgtacgtgtaccctcgtacttacgttcgggacggtacgggaaccgtagggtcggtaagtacgtaaccggaaacgttacgtacgggtacggtacgtagacctaccgtgttaccg

SEQ ID NO: 226359 - DNA, 600 bp, Homo sapiens
  misc_feature: GYAE6OF01E2UYT.4.51.E07.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtntctccaggggaaanacgccaccctctcctgcagggccagtcagagtgttaggagcaacttagcctggtaccagcataaacctggccaggcctcccgaggcctcctcatctatggtgcatcccacgacgggccactggtactcccgacgtccacgttcagtcggcaggttcgggtctggggacacgtagttccaccgttctaccaccgattccgagcacgtccctagcctagttcgtagtaagttagtttttggaacgttttattacgtgtacgagtcgtaagttaataactaacgttcggacccttacgttcgtaccgtttccgggacgggtaacgggtacccgtaaggggtcggaagtacgtaaccgaaacgtaccgttgtacgtactacggccctaacgtcttacgg

SEQ ID NO: 226360 - DNA, 732 bp, Homo sapiens
  misc_feature: GYAE6OF01C1UHX.4.51.E07.1.454.CMB.1.raw
  modified_base (248)..(248): a, c, t, g, unknown or other
  misc_feature (248)..(248): n is a, c, g, or t
  modified_base (329)..(329): a, c, t, g, unknown or other
  misc_feature (329)..(329): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatgtgatgacgcagtctccagccaccctgtctgtcgtcctaccgaaggggaacacgcccacctctcctgcgaggccagtcagtagtgtagganactaagttcgccgtaggtaccagacctaagtaaccgcggaccaggcctcccgaggtcctacctcattacgtagtcgggtcncaaccgttcccgaaccggtacgggaccctacgtcgggttaaccaccccgacgtacccgtacggtttacgaggttcggcgtaaggggttcgggtaccgtacggggaacctaccgttaggttccctaaccggtccttaacccgaaccctagtacccgaacggccgacgttcccgtacggtacgttacggtaacttagggttaaacggttttaggttttacgggttaatttttaactaacggttgtacgtaacgtaacggtaactttaacgttaaacgttccggttacggcccctttaagtaccgttaaccgggttacggggacggaaacgggtacgtaagggtacgtaagaaccgttaacggaaaccgtcgttggtacggtactacggacctaggtcgtttaccg

SEQ ID NO: 226361 - DNA, 600 bp, Homo sapiens
  misc_feature: GYAE6OF01ELWMI.4.51.E07.1.454.CMB.1.raw
  modified_base (211)..(211): a, c, t, g, unknown or other
  misc_feature (211)..(211): n is a, c, g, or t
tcagagcactgtagcacgaccggtgctcgatttagcatactctacaacacacaaagggggaggaactgctcagttaggacccagacggaaccatggaacgccccagcgcagcttctcttcctcctgctactctggcctcccagataccactggaagaaatagtgatgacgcagtctccagcccaccctgtctgtgtctccgaaggggaaancgcccaccctctcctgcgagggccagtcagagtgttaggagactaacttagcctggtaccagacaataaaccgtggaccaggcctcccgaggtcctcctcactctagtggtcgcactcccaccgacgggccacgtggtactcccgagcccgtacgttcgaggtcggacgtaggttcggggtctaggggaacctacgtacgttccactctaccaccactcgacgcacgtcctagctagtctagtaagttgtttaggtagtttatacgtgtacagtactaagttaactaagtacgtcgtccttactacgtacgtttcgggacgggtacgggaaccgtagggtcggaagtacgtaacgaaacgtacgtggtacggtctacgactacctgtcg

SEQ ID NO: 226362 - DNA, 640 bp, Homo sapiens
  misc_feature: GYAE6OF01CPCXX.4.51.E07.1.454.CMB.1.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (596)..(596): a, c, t, g, unknown or other
  misc_feature (596)..(596): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatgtgatgacgcagtctccagcccaccctgtctgtcgtctccgaggggaaancgcccaccctctccgtgcgacgggccagtcagngtgtaggagcaacttgccgtgtaccagcaataacctggccaggcctccgagctccncatctagtggcncactcccaccgagggtcccagtggtacctacccagtccctacgttcgaggtcggctagggtcggcgtagggactacgtacgttcactctaccaaccgtatccgacgacacgtccctaggacctacggttaccgttagggtaaacggttttagttttaacgggtaacgttttttaacttaccggtagtttaccgaaggttaccgtaaagtttaacgttaaaccgttcgtccggttcccttaccgtcgttaccggttcgggacgggtaacgggaccgaagggttcggaanaacgtaaccgaaagtcgtggtacggtccagccctacgtgttccg

SEQ ID NO: 226363 - DNA, 725 bp, Homo sapiens
  misc_feature: GYAE6OF01BDEB0.4.51.E07.1.454.CMB.1.raw
  modified_base (218)..(218): a, c, t, g, unknown or other
  misc_feature (218)..(218): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccacgccaccctgtctgtcgtctccgagggaagacgccaccctcnccttgcacgggccagtcagagtgttaggagcaacttagcctggtaccagcaataaacctggccaggcctccgacggcctcctcatctatggtgactactccaccgacgggccacgtcggtactcccaggcccacgttcaggtcggcgtaggtcgggtcgtacggggacacgtaggttccaacttccgtaccaccctattaccaacgtcaacgtccgttacgacgtacgttccgtaaggtaacgtttacgtttttacgggtaacgtttttaactttacggttacggttacctaagggttaacctaaagggttaaacttaaacggtttaaacccggtttccgggtaacccttaccgtttaccgttaaaccgggttttccggggaaccggggttaaaccgggtaaacccgttaaagggggtacggtaaacggtaacggttaaacccgaaaaccgggttacgttacgggtacggtaccggttaaccggaccttaaacccgtcgtttacccg

SEQ ID NO: 226364 - DNA, 563 bp, Homo sapiens
  misc_feature: GYAE6OF01E18L1.4.51.E07.1.454.CMB.1.raw
  modified_base (206)..(206): a, c, t, g, unknown or other
  misc_feature (206)..(206): n is a, c, g, or t
  modified_base (316)..(316): a, c, t, g, unknown or other
  misc_feature (316)..(316): n is a, c, g, or t
  modified_base (432)..(432): a, c, t, g, unknown or other
  misc_feature (432)..(432): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttaggacgctaacgttagcctggtaccagcaataaacccgtggaccaggcctccccgaggtcctcctcatctatggtncactccgaccgagggcccacgtggtactcccgagcctacgttcaggtggctaggtgggtctgggactacgtagttcacgttcacaccatcagcacgccctgctagtctagtagttntttagatttatctgtcagctaagtatactacgtcgtcctcgtactacgttcgggacggtacggtaccgtaagggtcgaagtaacgtaccggaaaacggtacgtaggtcggactaggaccctacctgttccg

SEQ ID NO: 226365 - DNA, 807 bp, Homo sapiens
  misc_feature: GYAE6OF01BQG2A.4.51.E07.1.454.CMB.1.raw
  modified_base (210)..(210): a, c, t, g, unknown or other
  misc_feature (210)..(210): n is a, c, g, or t
tcagagcactgtagcacgaccggtgctcgatttagcatactctacaacacacaaagggggagaactgctcagttaggacccagacggaaccatggaacgccccagcgcagcttctcttcctcctgctactctggctcccagataccatggagaaatgtgatgacgcagtctccagcccacctgtctgtcgtctaccggaaggggaaaacncgcccacccttctcctcgcgagggcccaagtccgaaggtacgtggtaagggatacgtaacgttacgccgtaggtaaccaggacctaacgttaaacccgtggacccgacggtcccgtaccgaagggtccctccgtacgcttacgtacgtcggtacgccaacctcccgaaccgacggggtaccctacggttacgtacctacccgaaggtccctacggttacgtaacgggtcggtacgtacggggttcggtacggtacgggaacctaacggtttacggttacccgacgttaccgttaacccaacccgttaacgttaccgaacgtccgtaacgtccccgttaaggccttaacggttacgtaacgttaaaggtttacgttttacgggttattttaacgttacgtagttaccgtagtaccttaagtaaactaaacggttaccgtcggttacccttaccggttacgttacccgggtttcggggaacgggttaaccgggtaacggttaaaggggtacggtaacgtaaaccggttaaccaaaaaccgggtttcgttacggggtaaccggttaccctaagggccctaaacccgttgtttaacccggg

SEQ ID NO: 226366 - DNA, 797 bp, Homo sapiens
  misc_feature: GYAE6OF01CXOSS.4.51.E07.1.454.CMB.1.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagatacccactggagaaatgtgatgacgcagtctccagcccacctgtctggtgtctccgaggggaaacncgcccaccctctcctgcagggccagtcagngtgtaggngcaattagcctggtaccagcaataaaccgnggccaggcctccgaggctccgtanactcgtatgggtncctacgtcccgaaccgcgggcccacgtcggtactcccgagcccgtaacgtttccgaggttcggacgacgggttcggggtaccgttaggggaaccttacgtacggttttacccacgtttacccgtaccaaacccgtacgttccgaacggtccgtaaacccgggtcccgttaccgggtaccgtaacggtttaccgttacggggtaaacggttttacggtttttaagggttaacgttttttaacgttaccgtttacggtttaccgaacgttacgtaaacgtttaacgtttaaacgttaaccggtttccggtacccgttttaccttaccggttaacggtttacccggggtaccgggggtaaaacgggtaacccggggttaaaggggtaaccgggtaaacggttaaaccggttaaaccgggtaaaaaccggtaaccggtttacgggtacgggttacccgtacggtaaccctaaccgtaccgtttaccgg

SEQ ID NO: 226367 - DNA, 800 bp, Homo sapiens
  misc_feature: GYAE6OF01C84FM.4.51.E07.1.454.CMB.1.raw
  modified_base (206)..(206): a, c, t, g, unknown or other
  misc_feature (206)..(206): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggaagaaatgtgatgacgcagtctccagccaccctgtctgtgtcctcgaggggaaancgcccaccctctcctgcgaggccagtccaggagttgttaggagctaacgttagccgtacggtaaccagaccaactaaaccgtggacccacgggcctccccgaggtcctcctcattcgtagtcggtcgctactcccgaaccgcggtacctacgtcggtacctcccgacgtcctacggttcgaggtcggacgtagggtcgggtcgtacgggacctacgtacgttaccaccttcctaccgaaccctacgtacccgaacgcccgtaacggtcccgttacggaccgtacggtttacccgttaagggttaacggtttttacggtttttacgggttaaattttttaccggtttacgttacggtacgtaacggttaacttaaacggtttaaacttaaacgggtttaacccgttcccgggttaaccctttaccggttaccggtttaaccggggttttccgggggaaaccggggtaaccggggtaaaccggtaacgggggttacgggaaaacgttaaccggttaaaccggaaaaacccggttcgggttacgggttaacgggttacccgtacgggttaaacccctcggtttaacgttaccccggg

SEQ ID NO: 226368 - DNA, 731 bp, Homo sapiens
  misc_feature: GYAE6OF01DN5P2.4.51.E07.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (248)..(248): a, c, t, g, unknown or other
  misc_feature (248)..(248): n is a, c, g, or t
tcagagcactgtagcacgaccggtgctcgatttagcatactctacaacacacaaagggggagaactgctcagttaggacccagacggaccatggaacgccccagcgcagcttctcttcctcctgctactctggctcccagactaccactggaagtaaatgtgatgacgcagtctccagccacctgtctgtcgtctacggaagggaancgccctacctntccgtgcaggccagtcgagtagtgtagganctaacgttcgaccgtggtaccagactaacgtaaccgcggtaccgaggtccctaccgacggtcccttacctactaacgttccgtaagttcgggctacctaaccgtacccgaaccggacgggtaccctaacggttcggtaacccttccccgacgtacccgttaccgttagacgggttccggacgtacgggttcggggtctaaggggacctaacgttcggttacctaccgttccaacaccgtataccgacggtactaccgtccgtacgacgttacgttcgtaacgggtttagttacgttttagggtactttttacgtacgttggtactagtacgttaaagttataaccgtttaccggtcgtacctttgttacccggttacgggttaccgggaccggtaaacgggtaccgtaaggggtccgtaagtaaccgtaaccgaaaccggttgttacgggaccgttagaccgtacccggtacttcggttaccg

SEQ ID NO: 226369 - DNA, 750 bp, Homo sapiens
  misc_feature: GYAE6OF01BEE42.4.51.E07.1.454.CMB.1.raw
  modified_base (154)..(154): a, c, t, g, unknown or other
  misc_feature (154)..(154): n is a, c, g, or t
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggaanaaatgtgatgacgcagtctccagcccacctgtctgtctctccgaagggaancgccaccctctctgcgacggccagtcagtagtgtaganactaagttcgctaggaccagactaagtaaccnggaccacggcctccgacgtcctcctnacttcgtagtcggtacgactaccgtacccgacgtacgggtaccctacgtacggtacccacccgacgtacccgttaacgttcgaggtcggtacgtacgggttcggtacgtacgggacctacgtacgtttaccaccgttcctaacccgacgtactaccgaacgtccgaaccgtcccgtacgaccgttaaggttccgttaagggttaaagttttacggtttttagggttaacttttaccttacggttacggtaaccgttaagtacccgttaaaggtttaaacttaaccgttaaccggttccgttacccgttaccgtttaaccggttacccgggttacgggggaccgggtaaaccgggtaaacggttaaaggggtcgttaaacgtaacggttaaaacccggaaaccggttggtaacggttcggaccgtaacgaaccctaacgttcgttacccg

SEQ ID NO: 226370 - DNA, 591 bp, Homo sapiens
  misc_feature: GYAE6OF01ERIHC.4.51.E07.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (405)..(405): a, c, t, g, unknown or other
  misc_feature (405)..(405): n is a, c, g, or t
  modified_base (586)..(586): a, c, t, g, unknown or other
  misc_feature (586)..(586): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatgtgatgacgcagtctccagcccaccctgtctgtgtctccgaggggaaancgcccaccctctcctgcagggccagtcagngtgtaggancaacttgcctggtaccagcaataaacctggccaggcctcccaggcctcctcatctagtggtgcactccaccacgggccacgtcggtactcccgagaccctacgttcaggtcggacgtaggtgggtcgtgggaccacgtacgttccaactcgtaccaaccnctcacgcacgcctgctagtccgtagtaagtagttttggtagttttactacgtgtcagtcgtaagttaattaactacgttcgtaccttacctacgttccggttacgggccgggtacgggtaacgtaggggtacggagaacgtaacgaaacggtacgtaggtaccggtctacggcctaccgtntccgg

SEQ ID NO: 226371 - DNA, 667 bp, Homo sapiens
  misc_feature: GYAE6OF01B12HZ.4.51.E07.1.454.CMB.1.raw
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
tcagagcactgtagcacgaccggtgctcgatttagcatactctacaacacacaaagggggaggaactgctcagttaggacccagacggaaccatggaagccccagcgcagcttctcttcctctgctactctggctcccagataccactggagaaatgtgatgacgcagtctccagccacctgtctgtntctccgaggggaaancgccacctntcctgcagggccagtcagagtgtaggnctaacgttnccgtggtaccagcaactaaccgtgccaggcctcccgaggcctccgtcattcgtatgggcactactccaaccgcgggcctaacgtcggtactcccgacggtccctagttaccgagggtggtaccctaggggttcgggtacctggggaaccctcgtacggttacctaccgtcttacccaacctacgtccgtaacgccgtacggtcccttcggaccgtagtttcgtagtaaacggtttgttttagggaactttttacgtaccgtttgaacgtacttaccgtaaggttaacgttaacttaaccgggtcgtaccctttacgttactacccgggttcggacgggtaaacccggtagtaacggggttggtaactaacgtaaccggtaaacgtacgttaggtcgtacgtacgcctacgtaacgttcg

SEQ ID NO: 226372 - DNA, 680 bp, Homo sapiens
  misc_feature: GYAE6OF01BI1SN.4.51.E07.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (323)..(323): a, c, t, g, unknown or other
  misc_feature (323)..(323): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtcgtctaccgaggggaaancgcccaccctntcctgcgagggccagtcagagtggttaggagacaacttagccgtggtaccagactaactaaccgtcggccgaggcctcccgaggtcctcctcatctatgggtcnctactccgaccgacgggcctacgtcggtactccccacgtcccgtacgtttacacgggtcggaccgtacgggttcgggtacggtacggggacctacgtacggtttacctaccttcctaccgtaaccctacgtaccgtacggacgtaccgtcccgtagaccgtacgttccgtaggtaacggtttagttttacggtaacgttttagtttaacgttcggttacacggttacgtaacgttaataacgttaccgttcggtacccttcgttaccgttacgttccgggacgggtacgggaccgtaagggtacggagtacgtaaccgaaacggtactcgggtacgtacgtagcctacgtgttaccg

SEQ ID NO: 226373 - DNA, 839 bp, Homo sapiens
  misc_feature: GYAE6OF01AL9LT.4.51.E07.1.454.CMB.1.raw
tcagagcactgtagcacgaccggtgctcgatttagcatactctacaacacacaaagggggagaactgctcagttaggacccagacggaaccatggaagccccagcgcagcttctcttcctcctgctactctggcctcccagataccactgggaagaaatgtgatgacgcagtctccagccaccctgtctgtcgtcctacgaaggggaaacgacgccctaccctctccgtcggacgacggggcctaggtccgaggtacggttggttaacgggagtacctaaaccgtttacggcccgttagggtaacccaacggtaccaaaacgttaaaacccggttcggggaccccacggggtcccctaccccggaacgggtccccttacctacgtaatcccttaaggttcggggttacgaccctaccgttaccccgaaccggtaccggggaccccttaacggtacgggttaccctaccccgtaacggttaccccgtaacggtttaccggagggttcggaccgtaggggtttcggggaccgttaggggaacctaccggttaggtttcccacgttcctaccaaccgactaccgacggaccacggtcccttacggactacggtttaccgtaagggttaacgttttaggttttacgggttaatttttaaccgttagttcgtacgttacgtaaccgttaattaaacttaacgttaaccgttcggttaccctacgttccgttaccggtttacggggtacggaaaccgggttacggtaacgggtacgggtaagtaacgtaaccggaaaacggttgttaccggggtgacccggttagacccaacgtttcggttaccg

SEQ ID NO: 226374 - DNA, 909 bp, Homo sapiens
  misc_feature: GYAE6OF01EV5BA.4.51.E07.1.454.CMB.1.raw
  modified_base (228)..(228): a, c, t, g, unknown or other
  misc_feature (228)..(228): n is a, c, g, or t
tcagagcactgtagcacgaccggtgctcgatttagcatactctacaacacacaaagggggaggaactgctcagttaggacccagacggaaccatggaacgccccagcgcagcttctccttcctcctgctactctggctcccagataccactggagaaatgtgatgacgcagtcctccagcccacctgtctgtcgtcctaccgaaggggaacacgccctaccctctccngcgacggccagtcgagtaggtgttaggacgactaacgtcgccgtaggtaaccacgctaaacgtaaccgtcggacccgacggtccctacccgacgggtcccttccgtacctacgttaccgttaacggtcggggtttaccaaccgtaacccggtaccccgaaccccgggtaccggggtaccccttaaccggtaccgggtttaaccccgtaccccgaacccggttaccccggttaacccggtttaccggacggggttacggggtacccgttaaaggggggtttcccggggttacccggtaccgggggtaaaccctaacccgggtttaacggtttaccccctaaccgttacccgtaaccccggtaaaccctacccgttacccgaacgggtccctaaacccggtccccgttacggaccgttacggttacccggttaaacggttaacgggttttaacgtttttaacgggtttaaacgttttttaaccgttacgtttacgtaacgttaacggtaacttaaagttaaccgttaagttaacccgttcggttacccttaccgttacgggtttcccggttaacgggggtaccgggtaaacgggaaccgggtagggtaaccgggtaagtaaaccggtaaccggtaaaacggttcgggttacgtacgtaccgtacgaacctacgtgtttaccgg

SEQ ID NO: 226375 - DNA, 705 bp, Homo sapiens
  misc_feature: GYAE6OF01BQ0NE.4.51.E07.1.454.CMB.1.raw
  modified_base (155)..(155): a, c, t, g, unknown or other
  misc_feature (155)..(155): n is a, c, g, or t
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctcggctcccagactaccactgganaaatagtgatgacgcagtcctccagcccacctgtctgtgtcctccgaaggggaacacgcccacccctctcctgccagggccagtcagagtgtagganctaacttgcctaggtaccagcataaacctggacctaggcctccaggtcctcctcnctcgtagtggtcnccactccaccgngggccctacgtcggtactccccgagtacccctaggttcaggtcggaccgtgggttcgggtccgtgggaaccacgtacggttcccaccgttcctaccgaacctataccgacgactacgcccgtagaccgtagttaccgtaggtaaacgtttacggtttttaggtaacgttttaacgtttacgtaggttaccgtacggtaacgttaaacggtttaactaaacgtttaacccgttccgggtaccccttacgttacccgttaaccgggtttccggggaacgggtaaaccgggtaccgtaacggggtacgtaacggtaactaaccggaaacgtacgttacggtcggtacctaggtaaccctaaccgttacttacccgg

SEQ ID NO: 226376 - DNA, 705 bp, Homo sapiens
  misc_feature: GYAE6OF01DSK30.4.51.E07.1.454.CMB.1.raw
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccatggagaaatagtgatgacgcagtctccagccacctgtctgtntctcgagggaancgccacctctcctgcagggccagtcagagtgtaggcgtacaagttacgccgtaggtaccagactaagtaaccgtggccacggtcctacccgaggtcctcctacgtactcgtagtggctacactcccgacgacggcctacgtacgtactacccgacgtcctacgttcgacggtcggcgtgggtcggtcgtacggggactacgtacgttctacctaccgtaccaacctacttaccgacgtccgtaaccggtcccgttacgacgttaccggttacgtaacgggtaagttttacggtttttagggtttaacgttttaaactttcggtacgtttacgaaccgttaacgttaagttaaacttaaacgttaccggtccggttaacccttccgttacgttaccggtttacgggacgggtaaaccgggtaccggtaagggtacggtaagtaaccgtaaccgaaaaccggttcgtaggtacggtaccgtacgtacccgtaacgtacggttcccg

SEQ ID NO: 226377 - DNA, 587 bp, Homo sapiens
  misc_feature: GYAE6OF01AMJ2R.4.51.E07.1.454.CMB.1.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtcctccgaggggaaanacgcccacccctctcctgcagggccagtcagngtgttagganctaattgcctggtaccngacataaacctggaccaggcctccccgaggcctcctcatctatggtcgcatcccaccgaggggccctacgtcggtacctcccgagtccctacgttcaggtcggcacgggtgggtcgtaggggaccacgtacgttcacctctacctacccatccagccacgcccgtgcctagtctagtaagtagttttgtacgtttattacgtgtacagtcaagttactaagttaccgtcgtccttaccttccgtacgtttcgggacggtacgggtacgtaagggtgagtaacgtaccgaaacgtaacgtgtcggtacacgccagtcgtac

SEQ ID NO: 226378 - DNA, 750 bp, Homo sapiens
  misc_feature: GYAE6OF01BGZO0.4.51.E07.1.454.CMB.1.raw
  modified_base (611)..(611): a, c, t, g, unknown or other
  misc_feature (611)..(611): n is a, c, g, or t
  modified_base (646)..(646): a, c, t, g, unknown or other
  misc_feature (646)..(646): n is a, c, g, or t
tcagagcactgtagcacgaccggtgctcgatttagcatactctacaacacacaaagggggagaactgctcagttaggatccagacggaaccatggaagcccagcgcagcttctcttcctcctgctatctggcctccagactaccactggaagtaaatagtgatgacgctagtcctccagcccaccttgtctagtcgtcctaccgaagggggaaactcgccctaccctctcctgcgaacgggccaggtcgaaggtggttaggttaaggacaccgtaaacgtttacggcccgtttagggtaacccacgtaaccgtaaacgttaaacccgtcgggacccgtaaccggtccccgtaccccgtacgggtcccctttaccgtacctaactttccggttaaggtcgggttaccgacccgtaacctccccggaaacggccggggtcccttaacgggttacggtacccgtacccgaacggtcccgttaaccggttcgtaagggttccgggaacgttacgggggtttcgggtacccggtacggggaaccctacggttaccggttaccacccgtttacaacccgtacacgtacgaccgtctcccgtacgtcgacgtaacgtntaacggtaagtttgtttacgttatttacgtacgtntacgtacgtataaggttactaacgttgtccgtcctgttaccggtacgttcgggaagtaccggagaggtcgaatcgaaacgtagcggtgacgctacgctacgtcg

SEQ ID NO: 226379 - DNA, 798 bp, Homo sapiens
  misc_feature: GYAE6OF01BVL1A.4.51.E07.1.454.CMB.1.raw
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgcccaccctctcctgcagggccagtcagagtgttagganctaacttagcctggtaccagcaataaccgtggccaggcctcccgaggcctcctcgatcctatggtcgacatcccgaccgacgggcctacgtcggtactccccgagaccccgtacgttcgaggttcgggccgtagggttcgggggtaccgtcgggggaacctaaccggtacgtttaccgaaccttcccgtaccgtaacccacgttccgaacggtaccaaccggtccccgttaggcccgtaacggtttacccgttagggttaaaggtttacggttttttacggggttaacgttttttaaccgttaaccgtttcggtaccgtaacggttaccgttaaaggttaaactttaaaaccggttaacccggttaccgggtttaccccttaaccggtttacccggtttaaaccggttttccggggggaaccgggggttaaaaccggggaaccccggttaaaggggggtccgggtaaacgtaacggttaaacccggtaaaaccggtaaccggtttcgggtacggtaccgtacggtaccctaaccgttaccgtttacccgg

SEQ ID NO: 226380 - DNA, 705 bp, Homo sapiens
  misc_feature: GYAE6OF01D6Z3B.4.51.E07.1.454.CMB.1.raw
  modified_base (206)..(206): a, c, t, g, unknown or other
  misc_feature (206)..(206): n is a, c, g, or t
  modified_base (696)..(696): a, c, t, g, unknown or other
  misc_feature (696)..(696): n is a, c, g, or t
tcagagcactgtagcacgaccggtgctcgatttagcatactctacaacacacaaagggggaggaactgctcagttaggacccagacggaaccatggaagcccagcgcagcttctcttcctcctgctactctggctcccagataccactggagaaatgtgatgacgcagtctccagcccacctgtctgtcgtctaccgaggggaaancgcccacctctccgtgcagggcctagtcaggtagtgttaaggacgctaaagttacgccgtaggtacccagcctaaacgttaaacccgtggacccaacgggccttaccccgaggtccctcctacaactttccgtagttgggtacacctacgttcccgaaccggacgggcccttaacgttcggtacctaccccgacgtaccctaacggtttccaagggttcggacgtaggttcgggtcgtacgggaacctacgtacggttacaacctttcccgaccaaccgtatcccgaagtccgtaacgtcctagaccgttagttccgtaaggtttaagtttacgttttacggtaatttttacgttacgttcgtaacgaggtacttaaggttaataacgttacctcggttccttacgtcgttacgttcgggaacggtacgtacgtacgggtacgaacgtataaaccgaaaccggtgttaccggtcgtacgagtaacccgtntgttacccg

SEQ ID NO: 226381 - DNA, 808 bp, Homo sapiens
  misc_feature: GYAE6OF01BFM8F.4.51.E07.1.454.CMB.1.raw
  modified_base (314)..(314): a, c, t, g, unknown or other
  misc_feature (314)..(314): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggaagaaatagtgatgacgcagtcctccagcccaccctgtctgtcgtctaccgaaggggaaacgcgcccaccctctccgtggacgacgggccaggtcgaaggtaggttaggttaggacactaacgttacggtccgtaggtaaccagacctaaacgttaaacccgnggacccgacggtccctacccgaaggtcccttaccgtactaacgttccgtaagttcggtacgtacctaaccgtcccgaaccggacggggtaccctaaccggtacggttaaccctaccccgacggtacccgttaaccgttcggacgggttcggaccgtagggttcgggtaccggttacgggacctaaccggttcgtttaccaaccgttacctaccaaccgtaacgtacaacggtaccacggtccctaggacgttaacgttccgtaagtaacgttttagttttacggttaacttttaacgttcgtataccgtaattacgttaattaaacgttaacgttaaccgttccggtaccttacggttaccgtaaccgggtttaccggggaaccggtaaacgggtaaaccgtaacggggttacggtaaacgtacgtaaaaccggtaaaacggtcgggttaacgttcggtaaccttaccggaccctttaacggtctttacccggg

SEQ ID NO: 226382 - DNA, 699 bp, Homo sapiens
  misc_feature: GYAE6OF01ERCN9.4.51.E07.1.454.CMB.1.raw
  modified_base (204)..(204): a, c, t, g, unknown or other
  misc_feature (204)..(204): n is a, c, g, or t
  modified_base (686)..(686): a, c, t, g, unknown or other
  misc_feature (686)..(686): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccatggagaaatagtgatgacgcagtcctccagcccacctgtctgtgtctcgaggggaancgccaccctctcctgcgaggccagtcagagtgtaggagctaacgttgccgtaggtaccagcaactaaccgtggaccacggcctcccgaggtcctaccgtctacttcgttagtcgggtcaccactcccgaccgacgggtccctagttcggtacctccccgagcccctacggtttcacgggtcggacgtagggtcggggttacgtacggggaacctacgtacggttaccctaccttcccgtactaccgtacttaccgaaggccacggcccttacggaccttaggttccgtaaggttaacggtttaagtttttacggggtaacgtttttaacgttacgttacggtaacgtaacggtaccgttaagttaaacgttaaacgttaccgttccggttccttaccgttaccgttaccggtttacgggcggggtaaacggtaccggtaagggtcgaagtacgtacgaaacgtacgtacggtcgtacgtacnccgtactgtaccg

SEQ ID NO: 226383 - DNA, 724 bp, Homo sapiens
  misc_feature: GYAE6OF01BLN9I.4.51.E07.1.454.CMB.1.raw
  modified_base (133)..(133): a, c, t, g, unknown or other
  misc_feature (133)..(133): n is a, c, g, or t
  modified_base (156)..(156): a, c, t, g, unknown or other
  misc_feature (156)..(156): n is a, c, g, or t
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (286)..(286): a, c, t, g, unknown or other
  misc_feature (286)..(286): n is a, c, g, or t
tcagagcactgtagcacgaccggtgctcgatttagcatactctacaacacacaaagggggaggaactgctcagttaggacccagacggaaccatggaacgccccagcgcagcttctcttcctcctgctacctntggctcccagactaccactgganaaatgtgatgacgcagtcnccagcccacctgtctgtcgtctaccgaggggaaacncncccaccctctccgngctagggccacgtcagagtgttaggacactaacttcgctaggtaccagacactaaaccncggaccacggcctcccgacggtcctcctacacttctacgttggacgtaccactaccccgaccgacgggtaccctaccggttacgggttacctaccccgtacggtccctaacggttacgtacgggttcggacgtaacgggttcgggttacgtaccggggacctaacgtttacgttcccgtacgttacccgtaccaaccgtactaccggaccgaccgtaacgtcccgtgaccgtacgtacgtacgtaagtttcgtttagttagttttacgtactgtacacgtataaacggttactaacgtttacggctttcccgtaccgttcgttaaccgggttccgggaacgggtaccgggtaaacccgtaaggggtacgtagtaaccggtaaaccgaaaccggttaacggtcgtacggttaccgacctaccgtaccgtgttttacccg

SEQ ID NO: 226384 - DNA, 680 bp, Homo sapiens
  misc_feature: GYAE6OF01DV7DC.4.51.E07.1.454.CMB.1.raw
  modified_base (220)..(220): a, c, t, g, unknown or other
  misc_feature (220)..(220): n is a, c, g, or t
  modified_base (318)..(318): a, c, t, g, unknown or other
  misc_feature (318)..(318): n is a, c, g, or t
  modified_base (472)..(472): a, c, t, g, unknown or other
  misc_feature (472)..(472): n is a, c, g, or t
  modified_base (527)..(527): a, c, t, g, unknown or other
  misc_feature (527)..(527): n is a, c, g, or t
  modified_base (652)..(652): a, c, t, g, unknown or other
  misc_feature (652)..(652): n is a, c, g, or t
  modified_base (675)..(675): a, c, t, g, unknown or other
  misc_feature (675)..(675): n is a, c, g, or t
tcagagcactgtagcacgaccggtgctcgatttagcatactctacaacacacaaagggggagaactgctcagttaggacccagacggaaccatggaagccccagcgcagcttctcttcctctgctactcgtggcctcccagactaccacgtggagaaatgtgatgacgcagtcctccacgccctaccctgtctgtcgtcgaccgaggggaaacgcacccncctctcctgcacgggccagtcgagtacgtggttaacggcactaacgtcgcgtacgtaccgagacactaacgcggccgagcctccgacggtcctcctanacttcgtagtgtcacctaccgtaccgaccgtacggacctaccgtccgggtaacctacccggacggtacccttacggttacgtacggtcggacggtagggttcgggtccgtaacgggtacctacgtacgttcccaccgtacttacccaacgtacnccgacgactaccgtcgtcgacgtacgtacgtaggttaactttggtttaacggttnttttaccgtaagttcgtacgaataccggttaattaaacgttacgtaccgttctcctacgttaccgttacggtcggaaccgggtaacggtacggagggtaccgagttaacccgagaaaccgttcgnggttacgactaccgactacgttnttccg

SEQ ID NO: 226385 - DNA, 768 bp, Homo sapiens
  misc_feature: GYAE6OF01EOVXL.4.51.E07.1.454.CMB.1.raw
  modified_base (126)..(126): a, c, t, g, unknown or other
  misc_feature (126)..(126): n is a, c, g, or t
  modified_base (134)..(134): a, c, t, g, unknown or other
  misc_feature (134)..(134): n is a, c, g, or t
  modified_base (457)..(457): a, c, t, g, unknown or other
  misc_feature (457)..(457): n is a, c, g, or t
  modified_base (540)..(540): a, c, t, g, unknown or other
  misc_feature (540)..(540): n is a, c, g, or t
  modified_base (760)..(760): a, c, t, g, unknown or other
  misc_feature (760)..(760): n is a, c, g, or t
tcagagcactgtagcacgaccggtgctcgatttagcatactctacaacacacaaagggggaggaactgctcagttaggacccagacggaaccatggaagccccagcgcagcttctcttcctcctcnctactcgnggtcctccgagtactaccagtaggaaagtaagttaggtagtagtacggaccgtacgtacgttccctaccgacccgacccctaccgtttcgttcgttcgttccgttaccggtaaccggggaaaggggaaaccgacccgtacccctaccccttccgtacccgtacggaccgggacggtaccgtacgtacgtaggtaggttaggttaacggaccgtaacgttaaccggtacggttacccggtaacggtaaccgacgtaacgttaaaccgtaccggccggaaccgtacggtccctaccggtcgtcccttaccagtactcgttacggngtacacctaccgacccgaacgggccgtacctaggtaccgtacctccgacgttaccgtagttcgacggtggtacgtgggtccgnggtacgtaactcgttacaccttccacgactactactacgactcgactcgtcgtagtacgtagtaagttacgtttcgtttagttacgtttacgttatcgtagtacgtaagttaacttacgtaacgttaccgtcgttcctacgttacggttacgggacggaacggtaccgtaggtacggtaggaacttacggtaactaggtagttcggactacgactacgtntcgttacg

SEQ ID NO: 226386 - DNA, 755 bp, Homo sapiens
  misc_feature: GYAE6OF01D82U9.4.51.E07.1.454.CMB.1.raw
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (693)..(693): a, c, t, g, unknown or other
  misc_feature (693)..(693): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagactaccactggaagaaatgtgatgacgcagtctccagcccaccctgtctgtgtacctccgaagggggaaacncgtcccaccctctccgtgccgacgggccaagtcaggagttcggttaggacncgtaaacttgaccctggtaccacgacaacttaaacccgtcggaccgacggtcctaccccgaggtccttaccccgtcgtaacttccgttagtgggtccacctaacgtaccccaccggacggggtacccctacgtcgggtaacctcccgaacggcccttaagttccgaggtcgacgtaggttccgggtacgtaggggacctaaccggtctttacccaacgttccctaaccgtacccacttaccgacggtacctaccgcccgttacaccggttacggtcccgtttaagaaccgggtttttatttaggggttttaaccttttagtttaacccgttggtaccgtaagtaaccgttaagtaacttaacgttaacgtccggtcttactacgttacgggttccgggaacgggtaccggtaacgtaacgggtaggtanaaaccggttaccgaaacggtcgttacgggtacggtcttaaccgggcctaacctagtttcccg

SEQ ID NO: 226387 - DNA, 498 bp, Homo sapiens
  misc_feature: GYAE6OF02H8GXG.4.51.E07.1.454.CMB.1.raw
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
tcagagcactgtagcacgaccggtgctcgatttagcatactctacaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctntcctgcagggccagtcagagtgttaggngcaacttagcctggtaccagcataaacctggccaggctcccaggctcctcatctatggtgcatccaccagggccactggtatcccagccacgttcagtggcagtgggtctgggacacagttcactctcacatcagcagcctgcagtctgaagtattttggagtttattactgtcagcagtataataactggaccttctcacgtttcggcgtagggaccaagggtggaagatcgaaacgactgtggctgcaccatcg

SEQ ID NO: 226388 - DNA, 528 bp, Homo sapiens
  misc_feature: GYAE6OF02FU98F.4.51.E07.1.454.CMB.1.raw
tcagagcactgtagcacgaccggtgctcgatttagcatactctacaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaagagccaccctctcctgcagggccagtcagagtgttaggagcaacttagcctggtaccagcataaacctggccaggctcccaggctcctcatctatggtgcatccaccagggccactggtatcccagccacgttcagtggcaggtgggtcgtgggacacgtacgttcactctccactatcagcacgcctgcagtctagaagttatttggtatttattcgttgactagctagttataattaacgtcgtccttctacttacgtttcgggcggtacgggaccgtagggtggagtactaacgaaacgtacgtgtcggctgccacgtattcg

SEQ ID NO: 226389 - DNA, 515 bp, Homo sapiens
  misc_feature: GYAE6OF02IXNEK.4.51.E07.1.454.CMB.1.raw
  modified_base (203)..(203): a, c, t, g, unknown or other
  misc_feature (203)..(203): n is a, c, g, or t
  modified_base (459)..(459): a, c, t, g, unknown or other
  misc_feature (459)..(459): n is a, c, g, or t
tcagagcactgtagcacgaccggtgctcgatttagcatactctacaacacacaaagggggaggaactgctcagttaggacccagacggaaccatggaagcccagcgcagcttctcttcctcctgctactctggctcccagataccactggagaaatagtgatgacgcagtctccagccacctgtctgtgtctccaggggaaangccaccctctcctgcagggccagtcagagtgtaggagcaacttagcctggtaccagcaataaacctggccaggctccaggctcctcatctatggtgcactcccaccgaggggcccacgtcggtactccccaggcccaacgtttccaaggttcggcaggttggggtctgggggaccacaggttcactctcaccatcagcagcctgctagtctgaagtattttggattttatactgtcagcagtataatacgtgcctntactacttcggcggagggactagggtgagatacgaacgtatgtcggctgcacatcg

SEQ ID NO: 226390 - DNA, 617 bp, Homo sapiens
  misc_feature: GYAE6OF02ISP8D.4.51.E07.1.454.CMB.1.raw
  modified_base (246)..(246): a, c, t, g, unknown or other
  misc_feature (246)..(246): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagacgcccaccctctcctgcagggccagtcagagtgtaggngcaacttagccgtggtaccagcaactaaaccgtggccaggcctcccgaggcctcctcatctagtggtgcactccaccgacgggccacgtggtactcccagcctacgttcgagtggctaggtgggtcgtgggacacgtagttcactctacacctatcgagcacgcctgcgtagtctagtaagttgttttaggtaattttattaccgtgtacgagtactaagttaataaacgtaacgtcggtaccctttcgtaccgttaaccggtttccggggacgggtaaccggggtaacccgtaagggggttcggaaacggtacgtaaacccgaaaacggtaccgttagggtacggtcgttaggaccctaccgtattccgg

SEQ ID NO: 226391 - DNA, 520 bp, Homo sapiens
  misc_feature: GYAE6OF02GY3YB.4.51.E07.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagngtgttaggancaacttagcctggtaccagcataaacctggccaggctcccaggctcctcatctatggtncatccaccagggccactggtactcccagccacgttcagtggcaggtgggtctgggacacagttcactctcaccatcagcacgcctgcagtctagaagtattttggatttatactgtcagtcagttataattaacgtggtcctcttcgtactttcgggacggtagggaccaagggtcggaagtatacgaaacgactaggtcggtctagacctacatcg

SEQ ID NO: 226392 - DNA, 494 bp, Homo sapiens
  misc_feature: GYAE6OF02GE8XX.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcataaacctggccaggctcccaggctcctcatctatggtgcatccaccagggccactggtatcccagccacgttcagtggcagtgggtctgggacacagttcactctcaccatcagcagcctgcagtctgaagtattttggatttattactgtcagcagtataataactggtcctctctactttcggcggaggaccagggtggagatacgaacgatgtggctgcaccatcg

SEQ ID NO: 226393 - DNA, 506 bp, Homo sapiens
  misc_feature: GYAE6OF02JDPNE.4.51.E07.1.454.CMB.1.raw
  modified_base (205)..(205): a, c, t, g, unknown or other
  misc_feature (205)..(205): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaggagcaacttagcctggtaccagcataacctggccaggctcccaggctcncatctatggtncatccaccgagggccactggtactcccagccacgttcagtcggcaggtgggtctgggacacagttcactcncacatcagcagcctgcagtctgaagtnttttggatttatactgtcagctagtatatacgtgcctctctacttcggcggaggtaccaagggtggacgtatacgaaacgacgttggcggtactggacctactagtcg

SEQ ID NO: 226394 - DNA, 494 bp, Homo sapiens
  misc_feature: GYAE6OF02GM4U0.4.51.E07.1.454.CMB.1.raw
  modified_base (205)..(205): a, c, t, g, unknown or other
  misc_feature (205)..(205): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaggagcaacttagcctggtaccagcataaacctggccaggctcccaggctcctcatctatggtgcatccaccagggccactggtatcccagccacgttcagtggcagtgggtctgggacacagttcactctcaccatcagcagcctgcagtctgaagtattttggatttattactgtcagcagtataataactgcctctctactttcggcggaggaccaagggtggagatcgaaacgatgtcggctgcaccatcg

SEQ ID NO: 226395 - DNA, 508 bp, Homo sapiens
  misc_feature: GYAE6OF02ICEAM.4.51.E07.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (360)..(360): a, c, t, g, unknown or other
  misc_feature (360)..(360): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttaggngcaacttagcctggtaccagcataaacctggccaggctcccaggctccctcatctatggtgcatccaccagggccactggtatcccagccacgttcagtggcagtggtctgggacacngttcactctcaccatcagcagcctgcagtctgaagtattttggattttattactgtacagctaagtataataactggacctctcacgtttcggcggtagggacctaagggtggaagatacgaaacgagtgtggctaggcaccgatccg

SEQ ID NO: 226396 - DNA, 507 bp, Homo sapiens
  misc_feature: GYAE6OF02IRKF2.4.51.E07.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (396)..(396): a, c, t, g, unknown or other
  misc_feature (396)..(396): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttaggagcaacttagcctggtaccagcataaacctggccaggctcccaggctcctcatctatggtncatccacagggccatggtatcccagccagttcagtggcagtgggtctgggacacgagttcactctcaccatcagcagcctgcagtctgaagttnttttggatttattactgtcagtcagtaataatactggaccttctctacgtttcggcggtacggacctagggtggagtactcgaaacgtatggtacggctagacacctatcg

SEQ ID NO: 226397 - DNA, 509 bp, Homo sapiens
  misc_feature: GYAE6OF02FV1RT.4.51.E07.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (506)..(506): a, c, t, g, unknown or other
  misc_feature (506)..(506): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaggancaacttagcctggtaccagcataaacctggccaggctcccaggctcctcatctatggtgcatcccaccgagggccactggtactcccgagccacgttcagtggcaggtgggtctgggacacagttccactctcaccatcagcagcctgcagtctgaagtattttggatttattctgtcagtcagtatataacgtgcctctctacgttcggcgtaggaccgtaagggtggagtataacgaacgtacgtggtaggctgacacctntcg

SEQ ID NO: 226398 - DNA, 567 bp, Homo sapiens
  misc_feature: GYAE6OF02IFJKK.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcaataaacctggccaggctcccaggctcctcatctatggtgcatcccacgagggcctactcggtatcccagccctacgttcaggtggcaggtgggtctggggacacgtacgttcaacgttcctacaccatacacgcacgcctgcagtctagtaagttagttttggtagtttattactgtacagtctaagtataaagtactggtacctctacgtacgtttcgggcggtacgggtaccgtaagggtcggaagtacgtaacgtaaaccgtacgttacggtacggtactacggacctaccgtattccg

SEQ ID NO: 226399 - DNA, 482 bp, Homo sapiens
  misc_feature: GYAE6OF02FIBE5.4.51.E07.1.454.CMB.1.raw
  modified_base (204)..(204): a, c, t, g, unknown or other
  misc_feature (204)..(204): n is a, c, g, or t
  modified_base (470)..(470): a, c, t, g, unknown or other
  misc_feature (470)..(470): n is a, c, g, or t
tcagagcactgtagcacgaccggtgctcgatttagcatactctacaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaggagcaacttagcctggtaccagcataaacctggccaggctcccagctcctcatctatgtgcatccacagggccactggtatcccagcccagttcagtggcagtgggtctgggacacagttcactctcaccatcagcagcctgcagtctgaagtattttggagtttatactgtcagcagtataataactgcctctcactttcggcgaggaccagggtgagatcaacgatgnggctgcacatcg

SEQ ID NO: 226400 - DNA, 513 bp, Homo sapiens
  misc_feature: GYAE6OF02H7NB1.4.51.E07.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (302)..(302): a, c, t, g, unknown or other
  misc_feature (302)..(302): n is a, c, g, or t
  modified_base (364)..(364): a, c, t, g, unknown or other
  misc_feature (364)..(364): n is a, c, g, or t
  modified_base (509)..(509): a, c, t, g, unknown or other
  misc_feature (509)..(509): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccaggggaangccaccctntcctgcagggccagtcagagtgttaggagcaacttagcctggtaccagcataaacctggccaggctcccaggctcctcatctatggtncatccaccagggccactggtactcccagccctacgttcagtggcaggtgggtctgggacacngttcactctcacatcagcagcctgcagtctagtaagtagtttttaggagttttattactgtcagctagttataatactgcctctctacgtttcggcggagggacctagggtggagactacgaaacgtagtggcggctagctaccnttcg

SEQ ID NO: 226401 - DNA, 521 bp, Homo sapiens
  misc_feature: GYAE6OF02HX58E.4.51.E07.1.454.CMB.1.raw
  modified_base (205)..(205): a, c, t, g, unknown or other
  misc_feature (205)..(205): n is a, c, g, or t
  modified_base (406)..(406): a, c, t, g, unknown or other
  misc_feature (406)..(406): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtccagagtgttaggagcaacttagtctggtaccagcaataacctggccaggctcccaggctcctcatctatggtgcatcccaccagggccacgtggtactcccagcccacgttcagtggcaggtgggtctgggacacgagttccactcctcaccatcagcagcctgcagtctgaagtnttttggagttttattacgtgtacagcagtataataactgtaccttctctactttcggcggtaggaccagggtggagtacgtacgaaacgtagtcggtaggcctgacctacgatcg

SEQ ID NO: 226402 - DNA, 565 bp, Homo sapiens
  misc_feature: GYAE6OF02IR9M3.4.51.E07.1.454.CMB.1.raw
  modified_base (215)..(215): a, c, t, g, unknown or other
  misc_feature (215)..(215): n is a, c, g, or t
  modified_base (303)..(303): a, c, t, g, unknown or other
  misc_feature (303)..(303): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagaggcaccctntcctgcagggccagtcagagtgttaggagcaacttagcctggtaccagcataaacctggccaggctcccaggctcctcatctatggtncactccaccagggcccacgtggtatcccagccacgttcagtggcaggtgggtctgggacacgagttcactctcaccatcagcagcctgcagtctagaagtagttttggagttttattacgtgtcagtactagttataattaacgtggtacccttcgtactaacgttttccgggacgggtacgggaaccgtaaggggtcgggaacgtaagtaaccgaaaaccggtaacgttggtacgggtcctaggacctaccctattcccgg

SEQ ID NO: 226403 - DNA, 510 bp, Homo sapiens
  misc_feature: GYAE6OF02H0T4V.4.51.E07.1.454.CMB.1.raw
  modified_base (303)..(303): a, c, t, g, unknown or other
  misc_feature (303)..(303): n is a, c, g, or t
  modified_base (446)..(446): a, c, t, g, unknown or other
  misc_feature (446)..(446): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacccctctcctgcagggccagtcagagtgttaggagcaacttagcctggtaccagcataacctggccaggctcccaggctcctcatctatggtncatccaccgagggccactggtactcccagcccacgttcagtcggcaggtcgggtctggggacacgagttcacttctacaccatcagcagctgcagtctgaagtattttggattttatactgtcagctagtataatactgcctntctacttggcgaggcaaggtcggagactaagaaacgtagtggtcggctacggactaccgtatcg

SEQ ID NO: 226404 - DNA, 516 bp, Homo sapiens
  misc_feature: GYAE6OF02FRC7M.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagcccaccctctcctgcagggccagtcagagtgttaggagcaacttagcctggtaccagcataacctggccaggctcccaggcctcctcatctatggtgcatcccaccagggcccacgtggtactccccagccctacgttcagtggcaggtgggtctgggacacgtagttcactctcaccatcagcagcctgcagtctagaagtattttggtagtttattactgtcagtctagtataataactggtcctctctacgtttcggcggagggaccgaagggtggagatacgaaacgatggtggctgcaccatcg

SEQ ID NO: 226405 - DNA, 538 bp, Homo sapiens
  misc_feature: GYAE6OF02HSQMB.4.51.E07.1.454.CMB.1.raw
  modified_base (398)..(398): a, c, t, g, unknown or other
  misc_feature (398)..(398): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagcccaccctctcctgcagggccagtccagagtgttaggagcaacttagcctggtaccagcataaacctggccaggctccaggctcctcatctatggtgcatccaccagggccactggtatcccagccacgttcagtgcagtgggtctgggacacagttcactctcaccatcagcagcctgcagtctgaagtnttttggagttttattacgtgttacagtctagtataataactggtcccttcgtcctaacgtttcgggacgggtacgggtaccgaagggtggagtaagtaccgaaacgaacgtggtacgggaccttggacctaccagttccg

SEQ ID NO: 226406 - DNA, 508 bp, Homo sapiens
  misc_feature: GYAE6OF02IVPW6.4.51.E07.1.454.CMB.1.raw
  modified_base (206)..(206): a, c, t, g, unknown or other
  misc_feature (206)..(206): n is a, c, g, or t
  modified_base (367)..(367): a, c, t, g, unknown or other
  misc_feature (367)..(367): n is a, c, g, or t
  modified_base (442)..(442): a, c, t, g, unknown or other
  misc_feature (442)..(442): n is a, c, g, or t
  modified_base (504)..(504): a, c, t, g, unknown or other
  misc_feature (504)..(504): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgtaggagcaacttagcctggtaccagcataaacctggccaggctcccaggcctcctcatctatggtcgcactccaccgacgggccacgtggtactcccagccacgttcagtggcaggtggtctgggacanagttccactctcaccatcagcacgcctgcagtctagagttattttggatttatctgtcagctatatatactgctntctacttcggcgaggacgaagggtggaatacgtaacgaacgtacgtgtcggtctagcctacngtcg

SEQ ID NO: 226407 - DNA, 541 bp, Homo sapiens
  misc_feature: GYAE6OF02HASLH.4.51.E07.1.454.CMB.1.raw
  modified_base (208)..(208): a, c, t, g, unknown or other
  misc_feature (208)..(208): n is a, c, g, or t
  modified_base (248)..(248): a, c, t, g, unknown or other
  misc_feature (248)..(248): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtcctccgaaggggaaanagcccaccctctcctgcagggccagtcagagtgttaggancaacttagcctggtaccagcaataaacctggccaggctcccaggcctcctcatctatggtgcatcccacagggccacgtggtactcccagccctacgttcagtggcaggtgggtctgggacacgtagttcactctccaccatcagcagcctgctagtctagaagttagttttaggattttattactgtacagctaagttataactaacgtgccttctactacgttcggacggtagggaccctaagggtggacgactaaccgaaacgtatggtacggcttcgacctacctatcg

SEQ ID NO: 226408 - DNA, 523 bp, Homo sapiens
  misc_feature: GYAE6OF02I4JZS.4.51.E07.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (518)..(518): a, c, t, g, unknown or other
  misc_feature (518)..(518): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctcggctcccagatacccactggagaaatgtgatgacgcagtctccagccaccctgtctgtgtcctccaggggaaancgccaccctntcctgcagggccagtcagagtgtaggagcaacttagcctggtaccagcataaacctggccaggctcccaggctcctcactctatggtgcatccaccagggccactggtactcccagccacgttcaggtggcgagtgggtctggggacacgacgttcactctcaccatcagcagcctgcagtcngaagtnttttggatttatactgtcagctagtataattactgccttcgtactacgtttcggcggtaggacccgaagggtcggaacagtacgaaacgtacgtggtcggactgacgtaccnttccg

SEQ ID NO: 226409 - DNA, 580 bp, Homo sapiens
  misc_feature: GYAE6OF02IP29M.4.51.E07.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgccaccctntcctgcagggccagtcagagtgtaggngcaacttagcctggtaccagcaataaacctggccaggctcccgaggcctcctcatctagtggtgcactccaccgacgggccacgtggtactcccagcctacgttcagtggcaggtcgggtcgtgggacacgtaggttccactctcacctatcagccagcctgcctagtccgtaggtaagttgttttaggagttttattaccgtgtacagtcaagttaataactaacgtgccttactctaccgtttcgggacgggtacgggtaccgtaagggtcgggaacgtacgtaaccgaaacgtacgttaggtacggccgttacggacctacccgtatacccg

SEQ ID NO: 226410 - DNA, 569 bp, Homo sapiens
  misc_feature: GYAE6OF02F6XBD.4.51.E07.1.454.CMB.1.raw
  modified_base (243)..(243): a, c, t, g, unknown or other
  misc_feature (243)..(243): n is a, c, g, or t
  modified_base (562)..(562): a, c, t, g, unknown or other
  misc_feature (562)..(562): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgtaggancaacttagcctggtaccagacaataaaacctggccaggcctcccaggctcctcatctatggtgcatcccacgacgggccacgtggtactcccgagcccacgttcaggtcggactaggtgggtctggggaacacagttcactctcaccatcagcagcctgctagtctaggaagtagttttggagttttattactgtacagtctaagtataacgtaactcggacctctacgtacgtttcgggacggtacggaacgtaagggtggaacggtaactaaccggaaacgtaacgtcgggtacggtacgtacggaccctaaccgtnttacccg

SEQ ID NO: 226411 - DNA, 635 bp, Homo sapiens
  misc_feature: GYAE6OF02IT8ZB.4.51.E07.1.454.CMB.1.raw
  modified_base (172)..(172): a, c, t, g, unknown or other
  misc_feature (172)..(172): n is a, c, g, or t
  modified_base (203)..(203): a, c, t, g, unknown or other
  misc_feature (203)..(203): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatgtgatgacgcagtcnccagccacctgtctgtgtctccaggggaaangccaccctctcctgcaggccagtcagagtgtaggagcaacttagcctggtaccagcataaacctggccaggctcccaggctcctcactctagtggtcgctactccgaccgacgggccctacgtcggtactccccgagtccctacgttacgacggttcggaccgtaggttcgggtctaggggacacgtacgttaccacgttctaccacctagtccaaggtccaagtccctagcctagtcctaggaagttagttttagggttaacgttttaacttacgttgtaccgaagtctaaggttaactaaacgttaacgtcgtcccttactccgttaacgtttcgggaccgggtacgggaacccgtaaggggtcgtaacgtacgtaaccgtaaacggaacgttacgggtacggtacctacggaaccctaccgtattccgg

SEQ ID NO: 226412 - DNA, 553 bp, Homo sapiens
  misc_feature: GYAE6OF02GQMPU.4.51.E07.1.454.CMB.1.raw
  modified_base (206)..(206): a, c, t, g, unknown or other
  misc_feature (206)..(206): n is a, c, g, or t
  modified_base (292)..(292): a, c, t, g, unknown or other
  misc_feature (292)..(292): n is a, c, g, or t
  modified_base (505)..(505): a, c, t, g, unknown or other
  misc_feature (505)..(505): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaangccaccctctcctgcagggccagtcagagtgttaggagcaacttagcctggtaccagcataaacctggccaggctcccaggctccncatctagtggtgcatcccacacgggccacgtggtactcccagccacgttcagtcggcaggtgggtctggggacacgtagttcactctccaccactcagcacgccctgcagtcctagtaagtatttttgggattttattacgtgtcgagtactaagttacttaaatacgttcgtaccttcgtactacgtttcgggcggtagggacctaaggggngtaagactacgaaacgtagttggtacggtacgtcgactaccgattccg

SEQ ID NO: 226413 - DNA, 587 bp, Homo sapiens
  misc_feature: GYAE6OF02HH95P.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcataaacctggccaggctcccaggcctcctcatctatggtgcatccacgacgggccacgtggtactcccagccacgttcaggtcggctaggtgggtctggggacacgtaggttccactctacacctatcagccagcctgcagtctagtaagttgttttggattttatacttgtcagtctaagttaataacttaacgtcggtaccttcgtacgtaccgtttcggggaccgggtacgggtaaccgtaaggggttcggaacggtaacgtaaccgtaaaaccggtacgttacgggtacggtaccgttcggacctacccgtagttcccg

SEQ ID NO: 226414 - DNA, 515 bp, Homo sapiens
  misc_feature: GYAE6OF02F94RJ.4.51.E07.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagagtgttaggagcaacttagcctggtaccagcataaacctggccaggctcccaggctcctcatctatggtncatccaccaggggcccaacgtcggtatccccagcctacgttcagtggcaggtgggtctgggacacgagttcactctcacatcagcagcctgcagtctgaagtattttggtagtttattactgtcagtcagtataataacgtgtacctctctacgtttcggcggtacgggactagggtgagtatacgaacgtacgtgtaggtctgcaccatcg

SEQ ID NO: 226415 - DNA, 539 bp, Homo sapiens
  misc_feature: GYAE6OF02I29CG.4.51.E07.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (412)..(412): a, c, t, g, unknown or other
  misc_feature (412)..(412): n is a, c, g, or t
  modified_base (461)..(461): a, c, t, g, unknown or other
  misc_feature (461)..(461): n is a, c, g, or t
  modified_base (535)..(535): a, c, t, g, unknown or other
  misc_feature (535)..(535): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgtaggancaacttagcctggtaccagcataaacctggcccaggctcccaggcctcctcatctatggtgcatcccaccgagggcccacgtggtactcccagccctacgttcagtggctaggtggtctgggacacagttcacgtctcaccatcagcacgcctgctagtctagtaagttnttttggtagttttattacgtgtacagtctagttataatacgtgtccttntcctacgttcggcggtaggaccgtaagggtggagtagtacgtaaacggtacgtggtcggtactgacctaccgtntccg

SEQ ID NO: 226416 - DNA, 500 bp, Homo sapiens
  misc_feature: GYAE6OF02FXUUT.4.51.E07.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (371)..(371): a, c, t, g, unknown or other
  misc_feature (371)..(371): n is a, c, g, or t
  modified_base (487)..(487): a, c, t, g, unknown or other
  misc_feature (487)..(487): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctntcctgcagggccagtcagagtgtaggancaacttagcctggtaccagcataaacctggccaggctcccaggctcctcatctatggtgcatccaccaggggccactggtatcccagccacgttcagtggcagtgggtctggggacacagttcactcncaccatcagcagcctgcagtctgaagtatttggagttttattactgtcagcaagtataataactggtcctctctctttcgggacggtagggaccaaggtggagatcaaacgactgnggctgcaccatcg

SEQ ID NO: 226417 - DNA, 548 bp, Homo sapiens
  misc_feature: GYAE6OF02IYCXI.4.51.E07.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (414)..(414): a, c, t, g, unknown or other
  misc_feature (414)..(414): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttaggancaacttagcctggtaccagcataaacctggccaggctcccaggctcctcatctatggtncatccaccagggccactggtactcccagccacgttcagtggctaggtggtctgggacacngttcactctcaccatcagcagtcctgcagtctagaagttattttggattttnttacgtgtcagtcagtataatacgtgtccttctcgtacgtttcgggacggtacgggtaccgtaagggttcggaacgtacgtaacgtaaaaccgtacgttggtacgggtaccttacggaccctaccgtattcccg

SEQ ID NO: 226418 - DNA, 528 bp, Homo sapiens
  misc_feature: GYAE6OF02FX231.4.51.E07.1.454.CMB.1.raw
  modified_base (205)..(205): a, c, t, g, unknown or other
  misc_feature (205)..(205): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaggagcaacttagcctggtaccagcataacctggccaggctcccaggctcctcatctatggtgcatcccaccgagggccactggtactccccagccacgttcagtggcaggtgggtctggggacacgagttcactctcaccatcagcagcctgcagtctgaagttattttggtagtttattactgtcagtcagttataataactggcctctctacgtttcgggcggaggtaccgaagggtcggagtacgtaccgaaacggtacgtacggtcggtcctggcctactatccg

SEQ ID NO: 226419 - DNA, 678 bp, Homo sapiens
  misc_feature: GYAE6OF02H7UVJ.4.51.E07.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgccacccctctcctgcagggccagtcagagtgtaggngcaacttagcctggtacccagcaataacctggaccaggcctccgaggcctcctcattctagtggtcgcactcccaaccgtagggaccctacgttggtacctccccgaggtaccctaccggttcaggtcggacgtaggttcgggtctaggggacctacgtagtttccaccttccgtaccaacctactccaagccgaacgtccctgaccgtacgttcgtaagtaacggttaacgtttttagggtaacgtttttaacgttaccgttagtacctaggtaccttaaggttaactaacgttaaaccggttcggtaccctttacgtaccgttacggtttaccggggacgggtaaccgggaccggtaaggggttcggaaggttactaaccgtaaacgtaacgtcggttacggtaccgttacggaccctaccgtacgttacg

SEQ ID NO: 226420 - DNA, 694 bp, Homo sapiens
  misc_feature: GYAE6OF02JZV0U.4.51.E07.1.454.CMB.1.raw
  modified_base (190)..(190): a, c, t, g, unknown or other
  misc_feature (190)..(190): n is a, c, g, or t
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccacctgtctgtntctccgaaggggaaanacgccaccctctcctgcagggccagtcagagtgtagganctatagcctggtacagcataacctggccaggctccaggctccncatctatggtcncatccaccgagggcccacgtggtacctccccgagcccaacgttccgaggttcggacctaggtcggggtctaggggacaactacggttccaccttcgtcaacctataccgagaccgacgtccttgacctgttacctaggtaacgttagtttttaggtaacggtttttaacttacgttgttaccgaggttaccgtaaagtttaaacgttaaacttaaccggtcggttaccctttaccgttaccctttaaccggtttaccgggtaaccggggttaccgggtaaaccgtaacggggttacgggtaaaccgttaacgttaaacccggaaaacggttaaccggttacgggttacgggtaaccttacccgggtaacctaaccggttaaccgtttaacccgg

SEQ ID NO: 226421 - DNA, 536 bp, Homo sapiens
  misc_feature: GYAE6OF02GQS33.4.51.E07.1.454.CMB.1.raw
  modified_base (204)..(204): a, c, t, g, unknown or other
  misc_feature (204)..(204): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttaggagcaacttagcctggtaccagcataaacctggccaggctcccaggcctcctcatctatggtgcatcccaccgagggccactggtactccagccacgttcagtcggcagtgggtctgggacacgagttcactctcacatcagcagcctgcagtctgaagttattttggatttatactgtcagtcagttataatacgtcgtccttctctacgttcgggacggtacgggacctaaggggtcgaagtacgtaccgtaaacgtacgttcggtacggaccttaggacctaccgtattaccg

SEQ ID NO: 226422 - DNA, 546 bp, Homo sapiens
  misc_feature: GYAE6OF02JABSO.4.51.E07.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (242)..(242): a, c, t, g, unknown or other
  misc_feature (242)..(242): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccacctntcctgcaggccagtcagagtgtaggancaacttagcctggtaccagcataaaccgtggccaggctcccaggcctccncatctatggtncactccacgagggcctacgtggactcccagcccagttcagtcggcaggtggtcngggacacgagttcacctctacgactatcagcagtccctgactagtctaggaacgttagttttggaattttagtactgtcaagctaagtactaatacgtacgtccttctactacgttcggacggtaggaccgtaaggtcggaagtacgtacgtaaacgtacgtggtacggtctcgacgtaccgtagttcg

SEQ ID NO: 226423 - DNA, 652 bp, Homo sapiens
  misc_feature: GYAE6OF02HYSAL.4.51.E07.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgccaccctctcctgcagggccagtcagagtgttaggancaacttagcctggtaccagcaataaacctggaccaggcctaccaggtcctcctcatctatggtcnccatcccacgtacgggcctacgtcggtaactccccgagtccctacgttcacggttcggcgtaggttggggtctaggggaaccacgtacggtttcccaacgtttcctaccacctacttaccgacgcctacggcccttagccgtaacgtccgttaggtaaacgtttaggtttttacggttagtttttaacgttacgttgtaccgaagtacttaaggttaataaacgttaaacgtcggtaccttcgttaccgttacgtttaccgggacggtacgggaaccgtaagggtcggaagtacgtaaccgaaacgtacgttggtacggtccgtagacctaccgtattccg

SEQ ID NO: 226424 - DNA, 636 bp, Homo sapiens
  misc_feature: GYAE6OF02JLKL0.4.51.E07.1.454.CMB.1.raw
  modified_base (243)..(243): a, c, t, g, unknown or other
  misc_feature (243)..(243): n is a, c, g, or t
  modified_base (539)..(539): a, c, t, g, unknown or other
  misc_feature (539)..(539): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggngacaacgttagccgtggtaccagtcaataaacctggccaggcctcccgaggcctcccgtcattcctagtggtcgcacgttcccaaccgtagggccctacgttgggtaacctccccaacggtccctaaccgtttccgaaggttcggacctagggtcgggggttcctacgggggaaccacgtaggttccctactcctacgacctactcacgctacggccttagacctagtccgtagaacgttgtttaggtactttattacgtgtcagtcaagtttactaaataccgttcggtcccttntaccgtacgtttcggaccgggtaggaccggtaaggttggaacgtagtaaccgtaaacggtaattcgggtcggtccgttgaccctaccggtattcccg

SEQ ID NO: 226425 - DNA, 607 bp, Homo sapiens
  misc_feature: GYAE6OF02I8CVH.4.51.E07.1.454.CMB.1.raw
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaanagccaccctctcctgcagggccagtcagagtgtaggagcaacttagcctggtaccagcaataaaccgtggcccaggcctcccgaggcctcctcattctatggtncactcccaccgagggcccacgtggtactcccgagccctagttcaggtcggactaggtcgggtctggggacctacgtaggttccacgtcctccgaacctatccgagtccacgtccctgactagttcctaggtaagttagttttaggtaattttacttacgtgtacgtagtacgtaagttactaaagttacgtcgtacccttactaccgttaccggtttccgggacgggtacgggtaccgaagggttcggaagtaactaacgaaaccgtagtcggtagaccgtcgactaccgagttcg

SEQ ID NO: 226426 - DNA, 610 bp, Homo sapiens
  misc_feature: GYAE6OF02GRD54.4.51.E07.1.454.CMB.1.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangccacctntccngcagggccagtcagtagtgttaggagcctaacttagcctggtaccagacaataaacctggccaggtcctcccgaggcctcctcatctatggtcgacactccaccgacgggccacgtggtactccgacgccacgttcaggtcgcgtaggtggtcgtgggacacgtagttcactcgtccaccatcagccgagtccctgactacgttactaggtaagttagttttagggtaacttttactacgttgtactagtacgtaagttataagtaacgtcgtaccttcgtaccgttacgtttaccgggacgggtacgggtaaccgtaaggggtacgaacggtaactaacgtaaaaccggtacgtaggttacgggtacctacggaccgtaacctagttacccg

SEQ ID NO: 226427 - DNA, 518 bp, Homo sapiens
  misc_feature: GYAE6OF02FXDSU.4.51.E07.1.454.CMB.1.raw
  modified_base (205)..(205): a, c, t, g, unknown or other
  misc_feature (205)..(205): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (513)..(513): a, c, t, g, unknown or other
  misc_feature (513)..(513): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaggagcaacttagcctggtaccagcataaacctggccaggctcccaggctcctcatctagtggtgcatccaccgagggccactggtactcccagccacgttcagtcggcaggtgggtctggggacacgagttcactctcaccatcancagcctgcngtcngaagtagtttggagtttatactgtcagctagtataactactgacctctctacgttcggccggtaggactagggtggagtactacgaaacgtacgtggtacggcctgaccgacctntaccg

SEQ ID NO: 226428 - DNA, 664 bp, Homo sapiens
  misc_feature: GYAE6OF02JE7N5.4.51.E07.1.454.CMB.1.raw
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccacgtggagaaatgtgatgacgcagtctccagccaccctgtctgtntctccgaggggaaacncgcccacctcgtccngacgacggtccagtcaggtagttcgtaggacactaacgtcgccgtaggtaccagactaacgtaaccgtcggaccacggttcctccgacggtaccttaccctacgtacgttacgttaggcggtaccactacctccgtaccgtaccggtaccgtacgtacgtacgtaccgtaccgtaccgtacgtaccgtcgtacgtacgtacggtacggtacggtacggacgtacgtacgtacgtacgtactacgtacgtacgtacgtacgtacgtacgtacgtcgtcgtacgtacgtacgtacgttacgttagttacgttacgttacgtcgtacgtcgtacgtacgtacgtacgtacgtcgtacgtacgtacgttacgtcgtacgtacggtacggtacggtcgtacgtacgtacgtacgtacgtacgtcgtacgtacgtacgtacgtagtcg

SEQ ID NO: 226429 - DNA, 537 bp, Homo sapiens
  misc_feature: GYAE6OF02H32LG.4.51.E07.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctntcctgcagggccagtcagagtgttaggagcaacttagcctggtaccagcataaacctggccaggctcccaggctcctcatctatggtgcatccaccagggccactcggtactcccagcccacgttcagtggcaggtcgggtctgggacactagttcactctcaccatcagcagcctgcagtctagtaagtatttttgggattttattactgtcagctagtataataactggtcctctctacgtttcgggacggtagggtaccgaagggtcggaagacgtacgaaacgtaacgttggtacggtactcggacctaccgtattcg

SEQ ID NO: 226430 - DNA, 644 bp, Homo sapiens
  misc_feature: GYAE6OF02GM3KJ.4.51.E07.1.454.CMB.1.raw
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcaggagtgttaggagcaacttagcctggtaccagcataaacctggccaggctcccaggcctcctctatctagtggtcncactcccaccgacggggccctacgtcggtactccccgacgccctaacgttcaaggtcggccgtaggtcgggtcgtaggggaccacgtacgttcctaacctcctaccgacctacgtcaacgccacggtccctggactacggttcctaggtaaggttagtttttgggaagtttttattacgtcgtactacggtactaaggttaacttaaagttaccgttggttacccttcgttaccgtacgtttccggggaccgggtagggtaaccggtaaggggttacggaaggtaaccgtaacggaaacgtacgttggtacggtcgtcggactacccgtattccgg

SEQ ID NO: 226431 - DNA, 580 bp, Homo sapiens
  misc_feature: GYAE6OF02GKAJ1.4.51.E07.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngcccaccctctcctgcagggccagtcagagtgtaggancaacttagcctggtaccagcataaacctggccaggctcccaggctcctcatctatggtncatccaccgagggccactggtactcccagccctacgttcagtggcgtaggtgggtctgggacacgtagttcactctcaccatcagcacgcctgctagtctagtaagttagttttggtagttttattacgtgtcagtctaagttataacttaacgtcggtacccttcgtactaccgttttcgggaccgggtacgggtaaccggtaagggtgggtaacgtacgtaaccgtaaaacggtacgttacgggtacggtaccgtacggacctacctacgttccg

SEQ ID NO: 226432 - DNA, 621 bp, Homo sapiens
  misc_feature: GYAE6OF02I31BZ.4.51.E07.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangccaccctctcctgcagggccagtcagagtgtaggancaacttagcctggtaccagcataaacctggccaggcctcccaggctcctcatctatggtgcatcccaccgagggccctacgtggtaactcccgagcccacgttcagtcggcaggtggtctggggacacgagttccacttctcacctatcagcagcctgctagtctagtaagttgttttagggtaacttttattacgttcgtactagtactaagttaactaaacgttaacgttcggtcccttacgttcctaaccgttttccggggacgggtaacggggtaacccgtaaggggttacgggtaacgtaacggttaaccgtaaaaccggtaacgttacgggttacgggtaccgttacggaccccgtaaccgtacgtttaccgg

SEQ ID NO: 226433 - DNA, 554 bp, Homo sapiens
  misc_feature: GYAE6OF02GRWZT.4.51.E07.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (315)..(315): a, c, t, g, unknown or other
  misc_feature (315)..(315): n is a, c, g, or t
  modified_base (342)..(342): a, c, t, g, unknown or other
  misc_feature (342)..(342): n is a, c, g, or t
  modified_base (452)..(452): a, c, t, g, unknown or other
  misc_feature (452)..(452): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagactaccactggagaaatgtgatgacgcagtctcagcccacctgtctgtgtctccgaggggaanacgccacctctcctgcagggccagtcagagtgttaggancaacttgcctaggtaccagcctaataaccgtggacccaggcctcccgaggccctcctcattcctagtcggtnccatcccacgacgggcctactggtacncccagccctagtcaggtgactaggttggcgtgggactagtgtcactctacaccatcagcacgctgctagtctagtaagttagtttggttagtttactacgttgtacgagntagttactaatactgtcctctacgtacgttcggacggtacgaccggtaggtacggtagtacgtactaaacggtagtgtacggtacgcgtactaccgtagtcg

SEQ ID NO: 226434 - DNA, 556 bp, Homo sapiens
  misc_feature: GYAE6OF02JE9PX.4.51.E07.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttaggagcaacttagcctggtaccagcaataaacctggccaggctcccgaggtcctcctcatctatggtgcatccaccgagggcccacgtggtactcccagccacgttcagtggcaggtgggtctgggacacgagttcactctcaccatcagcacgtcctagccagttcctagtaagtgttttggattttacttacgtgtcagtaccgtagtaataactaacgtcggtacccttctacgtaccgtttcgggaccggtacgggaaccaagggtcgaagtactaacgtaacgtacgtggtcgtccgtgacctacgtattccg

SEQ ID NO: 226435 - DNA, 589 bp, Homo sapiens
  misc_feature: GYAE6OF02HZ74R.4.51.E07.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacccctntcctgcagggccagtcagagtgttaggagctaacttagcctggtaccagcaataaacctggccaggcctccaggctcctcatctatggtgcactcccaccgagggcccagttcggtactccccagccctacgttcagtcggcgtaggtcgggtacgtggggaacctacgtagttaccactttcctaccacctactcacgtaccacgtccctcgtactacgtcgtaggtaattgttttcgacgtagttgtaatttacgtgttacaggtctaggtgtggtatccgtcaaccggtcgttacggaccgaacgggaaccgtaagggtacggaaatacgaaaaccgtgtacggtacggcctacggactaccgattaccg

SEQ ID NO: 226436 - DNA, 568 bp, Homo sapiens
  misc_feature: GYAE6OF02JASS9.4.51.E07.1.454.CMB.1.raw
  modified_base (243)..(243): a, c, t, g, unknown or other
  misc_feature (243)..(243): n is a, c, g, or t
  modified_base (470)..(470): a, c, t, g, unknown or other
  misc_feature (470)..(470): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaagagccaccctctcctgcagggccagtcagagtgttaggancaacttagcctggtaccagcaataaaccgtggcccaggcctcccgaggcctccctacatctaatgggtgcactcccaaccgaggggcccacgttggtactccccagccctacgttcagtggcaggtgggtctggggacacagttcactctcaccactcagcacgtcctgcagtctaggtaagttattttcgctagttgttacttactgtccagctaggtgtggtacnctaccgacgtaccggttccggaccgaacgggaccgaagggtacggaaacgtaacgaaacgtaacgttaggtacggtaccgtagacctacctagttacg

SEQ ID NO: 226437 - DNA, 572 bp, Homo sapiens
  misc_feature: GYAE6OF02HB5HJ.4.51.E07.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (368)..(368): a, c, t, g, unknown or other
  misc_feature (368)..(368): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccacctctcctgcagggccagtcagagtgttaggancaacttagcctggtaccagcaataacctggccaggcctcccgaggcctcctnatctagtggtncatcccaccgagggccagtcggtactccccgagccctacggttcaggtggacaggtcgggtcnggggaccacgtagttccactctccaccatcagcagcctgctagtctagaagttgttttaggtattttattactgtacagtcgtaagttactaacgttaacgtcggttaccttcgtaccgttacgtttcgggacggtacgggtaccgtaaggggtggagtaactacgaaacgtacgttggtacggctacggacctacgtattacg

SEQ ID NO: 226438 - DNA, 711 bp, Homo sapiens
  misc_feature: GYAE6OF02IQPH9.4.51.E07.1.454.CMB.1.raw
  modified_base (207)..(207): a, c, t, g, unknown or other
  misc_feature (207)..(207): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctcctgcgagggccaggtcaggagtgttacggagcaacttagcctggtaccagacaataaaccgtcggccaggcctcccgacggcctcccgtcacttcctagtcggtacgacactccctaaccgacgggccctacgtcggtactccccaggccctacgttcaaggtcggacgtggttcggggttctggggaacctacgtagtttccaccgttcctccgtaacctacgtaccgacggtcctaaccgccgttacgacgtagttaccgtagtaaaggtttagttttagggtaagtttttacttacgttagtacctaggtacctaaagttaataaactttaaccgtcggtaccctttccgttacgtaacggttttaccggggtaccgggtaacgggtaacccgtaagggggttacggaacggtaccttaaccggaaaacccggttaagttacgggtccggggttaccttacgggtacccgtacccgtaagtttaccgg

SEQ ID NO: 226439 - DNA, 792 bp, Homo sapiens
  misc_feature: GYAE6OF02H9R5B.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctcagccaccctgtctgtgtctccgaaggggaaagacgcccaccccttctcctgccgagggccagtcaggtagtgttaggagctaacgttggccttgggtaaccagccaataacctggaccaggcctcccgaggtcctccctcattctaagtggtcgctacgtcccaccgacgggccctacgtggtaacctcccgaggtaccctacggttcaacggtcggcgtaggttcgggacgtacgggtaacacggtaggttccctacctcccgttacctaaccccgtatacccgaacgacccgtaacggtcccgtacggaccgtacggttaccgttaggttaaaacgtttaacggtttttttagggttaacggttttttaaccgttttaaccgttacggttaaccgaacggttacgttaaaggtttaaatttaaacgttaaacccgttacggggtaccctttcgttaacccgtttaaccgggttttcggggtaccgggtaaccggggttaaacccgggtaacggggttaacgggaaaccggttaacggttaaaccgtaaaacccggttaacggttacgggtaccgggtacccgtttaacggaacccgttaacccgtagtttacccgg

SEQ ID NO: 226440 - DNA, 577 bp, Homo sapiens
  misc_feature: GYAE6OF02GJXV1.4.51.E07.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (347)..(347): a, c, t, g, unknown or other
  misc_feature (347)..(347): n is a, c, g, or t
  modified_base (394)..(394): a, c, t, g, unknown or other
  misc_feature (394)..(394): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtgtagganctaactgctggtaccagcaactaaacctggaccacggcctacccaggcctccctcactctagtcggtgcctactcccaccggcgggccctacgtcggtacnccgacgccctacgttcgaggtcgcgtaggtggtcgtagggacacgtntccactctacaccactcacgcacgctgctagtcgtagtaagttacgtttaggttagtttatactgtacagtactaagttataacgtacgtcgtacctcgttctacgttcgggacggtacggtacgtagggtgaacgtactaacggaacgtagttcggacgggtactacggacctactgttccg

SEQ ID NO: 226441 - DNA, 689 bp, Homo sapiens
  misc_feature: GYAE6OF02HFHZ0.4.51.E07.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (281)..(281): a, c, t, g, unknown or other
  misc_feature (281)..(281): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggcctcccagataccacgtggaagaaatagtgatgacgctagtcctccagcccacctgtctgtgtcctacgaagggaanacgccacctctcctgcgaggccagtcagtagtgtaganacaacgtacgcctggaccagacaactaaccgngccagcctaccgagtcctcctcactctagtggcacactccgacgacgggcctacgtacgtacctcccgacgcctacgttacaggttcggacgtagggttcggtaccggtacgggaacctaccgttacggttacctacctttaccgtacctaaccgtacttaccgaacggaccgaaccggtccgttaacggaccgtacggtaccgttagggttaaacgttttagttttaagggtttaacgtttacgtttaacgtcgttacacggttataagttaacttaacgttaaccgttcggtcccttacgttacgtaccgtttacgggacgggtaaccggtacgtaaggggtaagacgttaactaaacggaaacgtacgttcgggtacgtccgttaacgaccctaccgtattaccg

SEQ ID NO: 226442 - DNA, 870 bp, Homo sapiens
  misc_feature: GYAE6OF02F843E.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggcctcccagataccactggaagaaatagtgatgacgcagtcctccagccacctgtctgtgtctccgagggaaagcgccaccctctcctgcgaggccagtcaggtagtgttaggacgactaacttacgccgtaggtaaccgagaccaacttaaaccgtggacccgtaggcctaccccggaaggtcccttacccgtactaacttccgttaacggtcggggtacgaccctaacgtacccccgaaccggtaccggggtacccctaacggttacggggtaaccctccccggaaccgtacccgtaccggttaccgaacgggttcggacgtacggggttacgggttaccggttacgggaacctaccgtacggtttacccgtaccgttcccgttacccaacccgtaacgttaccgaaccgggtaccgtaccgtcccggtacggacccgttaaacgggtttcccggttaaaggttaaacggttttaacgggtttttacgggttttaaacgtttttacccgtttaacggttccggtttacgtaaacgggttaccgtaaaacggttttaaacttaaacccggtttaaaccggttccgggttaccctttacccgttaaccggtttaacccgggtttaccgggaccggggtaaccggggtaccggtaaaggggtacggtaacgaaccggttaaccgaaacggttacggttgggtaccggtaccggactaccggttaacctcgtttacccg

SEQ ID NO: 226443 - DNA, 572 bp, Homo sapiens
  misc_feature: GYAE6OF02IQGO4.4.51.E07.1.454.CMB.1.raw
  modified_base (566)..(566): a, c, t, g, unknown or other
  misc_feature (566)..(566): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctccccagataccactggagaaatagtgatgacgcagtctccagccaccctgtctgtgtctccaggggaaagacgccaccctctcctgcagggccagtcagacgtgttaggacgcaacttagcctaggtaccagcaataaacctggccaggctacccaggctccctcatctatggtgcagtcccaccgacgggccacgtggtacctcccagtccacgttcaggtcggactaggtgggtctagggacacacggttcacctctccacctatcgagcagcctagcagtctgaagttattttggattttatctgtcgatctaagttagtaactaacgtcgtaccttcctacttaccgttccgggacggtacgggacctaacggggtgaacgtacgtaaccgtaaacgtaccgtggtaccggtcgcgtaccctacgnttaccg

SEQ ID NO: 226444 - DNA, 730 bp, Homo sapiens
  misc_feature: GYAE6OF02H9L8E.4.51.E07.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggcctcccagataccactggagaaatagtgatgacgcagtctcagccaccctgtctgtgtctccgaaggggaaancgcccaccctctcctgcagggccagtcagagtgtaggancaacttagcctggtaccagctaactaaaccgtggaccaggcctcccaggtctcctcatctatggtcgcatccacgacgggtccacgtcggtactccccgagtccctaacgttcgaaggtcggccgaagggttcgggtcgtcggggaacctacgttcggttaccacctttccgtaccctaacctaacgttacccgaacggtaccgtaacggtccccgttacgggtaccctaacgggttcccgttaagggtaaacgttttacgtttttttaacggggtaaaggtttttttaacctttaccgttaggttaccgtaacggttacgttaaaccggtttaatttaaaaccgtaaccgttccgggacccttttaccgttaccgttaccggtttacggggacccggggtaacgggtaccggtaacggggtggaacgtaacgtaaccgaaacgtacggttcggtacggcgttaccgacctacccgtagttccg

SEQ ID NO: 226445 - DNA, 615 bp, Homo sapiens
  misc_feature: GYAE6OF02GZLNP.4.51.E07.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaangcccaccctctcctgcagggccagtcagagtgttaggancaacttgcctggtaccagctaataacctggccaggcctcccgagctcctcatctanggtncactcccacgacggccacgtggtacctcccgagtcctacgttcaggttggacctaggtcggggtcctaggggaccatacggttccactcctacaccagtccagccacgtccctggaccgtgttaccgtagtaacgttagtttttacggtatttttacgtcttaggtacctaggaccttaaagttaataacgttaaccgtcgtaccttctacgttaccggtttccgggagggtacggtaaccgaggggtcggtaacgaactaaccggaaagtacggttcggacggttcgtacggaccttaccgagttaccg

SEQ ID NO: 226446 - DNA, 643 bp, Homo sapiens
  misc_feature: GYAE6OF02IY9Q4.4.51.E07.1.454.CMB.1.raw
  modified_base (206)..(206): a, c, t, g, unknown or other
  misc_feature (206)..(206): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttaggagacaacttagcctaggtaccagacactaaacctggcccaggcctccgacggtcctccgtcaattctaactgggtcacgtactacccaccggtacgggcccacgttggtaacctccccgagtaccctacgttacgacgttggcctaggtcgggtcgtaggacctaactagtcaacctctcaccgactcgaagtccgacgtcgttacgcgtacgtcgtacgtaagttcgttttacggtagttttacgtaacgttgtacgtagtacgttaagttataacgttaacgtcggtaccttccggtacttacgtttcgggacgggtacgggaacccggtagggttggaaccgtacgtaaccgaaccggttagtaccggtcgtcggtacaaccggtactacgtttcg

SEQ ID NO: 226447 - DNA, 739 bp, Homo sapiens
  misc_feature: GYAE6OF02G2UAT.4.51.E07.1.454.CMB.1.raw
  modified_base (206)..(206): a, c, t, g, unknown or other
  misc_feature (206)..(206): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatgtagatgacgcagtctccagccacctgtctgtcgtctccgaaggggaancgccaccctctcctgccgacgggccaagtcagagtgtaggagctaactgcctggtaccagcaataaccgtggaccgacggtcctccgaggtcctcgtactacgtctagtggtcgctacgtcccgacgacggcctacgtgtacctccgacgtcccgacgttcgagtcggacgtacgggtcgggttcgtacgggaactacgtacgttaccgaaccttcgtacccaccgtacgtccgacgggtaccacggtcccgtgtacccgtaggtttacccaagggttaaccggtttaaggtttttacgggttaacgtttttaaccgttaacggtttccgtaagtaacggtaacgttaaccggttaaagttaaaccgtttaccggtaccgttaccgttaccgttaccgttaaccggtttcgggaaacccggggttaccggtaacggttaacgggtcgggtaaaaccgtcgttaaaacccggtaacggttaccgttacggggtacgtacccgttaaggtaccccgttaaccgtaccgtttaccg

SEQ ID NO: 226448 - DNA, 710 bp, Homo sapiens
  misc_feature: GYAE6OF02JN338.4.51.E07.1.454.CMB.1.raw
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggaagaaatgtgatgacgcagtctccagccacctgtctgtgtctcgaaggggaaancgcccaccctctccngcgacggccagcgaggtgttgtaggactactaacgtacgtcgtacggtaccagtactaaacgtaaaccgtcggaccgacggtaccctacccggacggtccttccccgtacgtaccgttacgtacggttacggtccgaactaccgtaccccgaaccggtaccggggacccttaaccggttacgtacccgtaccccggtaaccgtacccggttacgttaccgtaaggtccggtacggtacggtcgggtcgtacgggactaacgtacgtacctaccgtacgtacctacacgtcgacgtcgtaccgtccgtcgtacgtacgtacgtacgttaagttgtttaggttactttagttacctgtactagtcgttaagtaactaacgtacgtccgttactcgtaccgtacgtccggaacggtacgtaacggtaagggtcggtacgtaacgtaaccggtaacggtagtacgggtacgtacgtacgtacctacgtcttacg

SEQ ID NO: 226449 - DNA, 615 bp, Homo sapiens
  misc_feature: GYAE6OF02FF6TN.4.51.E07.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactgganaaatagtgatgacgcagtctccagccaccctgtctgtgtctcgaggggaangcccaccctctcctgcagggccagtcagagtgtaggancaacttagcctggtaccagcataaacctggccaggctcccagctcctcatctatgtgcatcccaccagggccacgtcggtactcccagccctacgttcaggttcggcgtaggtcggggtctggggaaccacgtacggttccacctctacacccataccagccacgtcctgacctacgtctaggtaagttagttttaggtacgtttttaattccgtttaggtaccgtaacgtcgtaagttaacttaaacttaaccgttccgggttacccttactacccgttacgtttaccgggacgggtacgggaaccggtaagggtacggaaggtaactaaccgaaacggtacgtgtaggtcctagaccctacgtacttaccg

SEQ ID NO: 226450 - DNA, 650 bp, Homo sapiens
  misc_feature: GYAE6OF02GJ2CV.4.51.E07.1.454.CMB.1.raw
  modified_base (206)..(206): a, c, t, g, unknown or other
  misc_feature (206)..(206): n is a, c, g, or t
  modified_base (313)..(313): a, c, t, g, unknown or other
  misc_feature (313)..(313): n is a, c, g, or t
  modified_base (450)..(450): a, c, t, g, unknown or other
  misc_feature (450)..(450): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcgagggcagtcagagtgtaggagacaacttagctaggtacagcaactaaacctggacccaggcctcccgaggcctccctcatctatggtancactccaccgagggcccagtaggtacctccccgacgtccctaacggttcaaggttcggacgtagggttcggggtaccgtaggggaacctacgtacgtttacccacgttcctaccgaccctagtcacgtccacgtccngtacagttactaggtaagttgttttagggtaatttaattacgtggttacacggtactaaggttaacttaaacgttaacgtcggttaccctcgttaccgttacgtttaccggggacgggtaaccgggtaacggtaggtacggtaagtacttaacggaaaaccgtaggtcgttaggacctacggtaaccaccgtagttaccg

SEQ ID NO: 226451 - DNA, 802 bp, Homo sapiens
  misc_feature: GYAE6OF02JWQKD.4.51.E07.1.454.CMB.1.raw
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
  modified_base (577)..(577): a, c, t, g, unknown or other
  misc_feature (577)..(577): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccacctgtccgtgtgtctaccgaaggggaagacgcccaccctcctcctgccgagggcctagtcaggtgtgttaggganctaacgtacgccgtaggtacccanaccgtaacaaaccccgtgggacccgaccgggtacctccccccggaaggtccctacccgttctaacttccctaggtacgggttcgaacctaccggttaccccacccgtacggggaccctaccggtaacgggttaccctaccccgaaccggtccccttaaacgtttcccgggaagttccggggtaccgtagggttcccggggttacggttacggggacctaaacggtccggttactacccggtacttcccgaacctagtcccgaagtccccgaatccccgttagacgtacggttaccgnggtttaaccggttaggtttttacgtaggtttttaacttacgttacgtaccgtacgttaaggtaaccgttaacgtttaaaacgttcccggtttcgttacccgttaactttccccggtaacgggtttcgggacccgggttacggggtaaccctaagggtacgggtacttaacggaaccgttaagaaccgttcgggacaccggttacggaccctaggttacgttccgg

SEQ ID NO: 226452 - DNA, 666 bp, Homo sapiens
  misc_feature: GYAE6OF02HAFRC.4.51.E07.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggaagaaatagtgatgacgcagtctcacgccacctgtctgtcgtcnccgaagggaancgccaccctctcngcgacggccagtcagagtgtaggagactaacgttcgcctggtaccagacaacgtaaaccgtcggaccacggcctcccgaggtccttcctctacttctagtggtcgacctactacccgaccggacgggcctacgttcggtacctacccgagcccgtaccgttgacggtcgacggtaggtcggtcgtaggaacctacgttacggttccacttccgtaccaacctacgtaccgacgtaccacgtccgtacgcgtaacgttcgtaacgtaaggtttacgttttacgggtaatttttaacttacgttcgtacgaacgtactaagttaactaacgtacgttcgtacccttcgttacgttaccggttacgggacggtacgggaacggtagggtacggtacgaacgtaaccgaacggttaagtcggtaacggtcgtaacgtacctacgtagttcg

SEQ ID NO: 226453 - DNA, 772 bp, Homo sapiens
  misc_feature: GYAE6OF02I4SV4.4.51.E07.1.454.CMB.1.raw
  modified_base (205)..(205): a, c, t, g, unknown or other
  misc_feature (205)..(205): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (329)..(329): a, c, t, g, unknown or other
  misc_feature (329)..(329): n is a, c, g, or t
tcagagcactgtagcacgaccggtgctcgatttagcatactctacaacacacaaagggggaggaactgctcagttaggacccagacggaaccatggaagcccagcgcagcttctcttcctcctgctactctggctcccagataccactggagaaatgtgatgacgctagtctcagccacctgtctgtcgtctaccgaggggaaancgccacctctcctgcgacgggccagtcagtagtgtacggnctaacgttagcctaggtaccagtcaataaaccgnggacccaggtcctacccgaggtccctcctacgacttaccgtagtcgggtnaccgtactccccgaaaccggacgggcccttaaccggttagggtttaaccccaccccgtaacggtaccccttaacgggtttaccgagggttccggtaccgttaggggttccggggttacgtaacgggaaaccttaacgttaccggtttaccgaacccgttacccgttacctaacccgtacgtaccgacgtcccgtacgtcccgtacgacgttacgttacgtagttaacggtttagttttacggttaacgttttacgttacgttacgtacgtaacgtacgtaacgtttaacgttaaacgttaaccggtccgttaccttaccgtttaccgttaaccggttacgggtaacgggtaccgggtaaccggttaagggtacggtaacgtaacggtaaaccgtaaccggttaacgtcggtaccggtacgtaccgtaccgtaacctaggttcg

SEQ ID NO: 226454 - DNA, 546 bp, Homo sapiens
  misc_feature: GYAE6OF02I2JIC.4.51.E07.1.454.CMB.1.raw
  modified_base (205)..(205): a, c, t, g, unknown or other
  misc_feature (205)..(205): n is a, c, g, or t
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagagcaacttagcctggtacccagcaataaacctggaccaggctacccaggcctcctcatctatggtgcatcccaccagggccactggtatcccagccacgttcagtggnagtgggtctagggacacacgttcactctacacgntcagcngctgacngtactgaagttnttttggaagttttatactntacagactaaggtataaatacgtcgtaccttctctacgttttcgggcggtacggaaccgtaaggtcggacgtaataccgaaacgtacgtggtacggtacgtacggacctaccgattccg

SEQ ID NO: 226455 - DNA, 672 bp, Homo sapiens
  misc_feature: GYAE6OF02GAQ0Y.4.51.E07.1.454.CMB.1.raw
  modified_base (206)..(206): a, c, t, g, unknown or other
  misc_feature (206)..(206): n is a, c, g, or t
  modified_base (365)..(365): a, c, t, g, unknown or other
  misc_feature (365)..(365): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccacctgtctgtgtctaccgaggggaaanacgcccaccctctcctgcgacgggccagtcagagtgttaggagactaacttacgcgtcggtacagctaataaaccgtcggccacggtcctcccgaggtcctcccgtacactactagtggtcgacctactcccaccgaggggaccctactacgggtaccncccgacggaccctacggttcaggtcggaccgtagggttcgggtcgtacggggacacgtacgttccacttctaccacctagtaccaggacctacggtcctagaccgtacgttaccgtagtaacggttgtttttagggtacgtttttacgttacgttcgtacgacggtcttaaagttaacgttaattaccgtcggttccttcctaccgttcgttaccgggaccgggtacggaccggaaggtaagggtacctaagtaaccgtaaacggtacgttaggtacggtaccggtcgacccgtacctagttcccgg

SEQ ID NO: 226456 - DNA, 717 bp, Homo sapiens
  misc_feature: GYAE6OF02G6VC2.4.51.E07.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatgtgatgacgcagtctccagcccaccctgtctgtgtctccgaggggaaangcccaccctntcctgcaggccagtcagngtgtagngcaatagcctggtaccagcaataacctgaccaggcctccaggcctcgtcatctagtggtcgcactcccgaaccgtacggggccctaacgttggtacctaccccgaggtaccctacggttacacgggttcggacgtaaggttcgggtactacgggactacgtagttcccaaccgtctaccgtaccacttaccgacgaccacgtcctcggacctacggttacctaggtaaacggttacgtttttagggaaacgtttttgttaaccgtttcggtacctacggtaccgttaaagttaacgttaaacgttaccgttacgggttacctttccgttaaaccgttaaccggttttaccgggaacggggtttaacccgggaaccggttaagggtccgggttaaacggtaccgttaaaccgggtaaaaccgtaccggttacgggttacgggtaccgttacgaacccgtacccgtacgtttacccgg

SEQ ID NO: 226457 - DNA, 631 bp, Homo sapiens
  misc_feature: GYAE6OF02FLJOU.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctccccagataccactggagaaatagtgatgacgcagtctccagccaccctgtctgtgtctccgaggggaaagacgcccaccctctcctgcagggccagtcagagtgttaggagcaactgcctggtaccagcaataaaccgtggccaggcctcccgaggcctcctcatctatggtgcctatcccgaccgagggccctacgtcggtactccccgagccctacgttcgacgggtggcgtaggttcggggtccgtcggggaacctacgtacgttccaccttctaccacctatccaacgcacggtccgtcgactaggtctacggtaagtttacgtttttagggtaactttttaacttacgttcgtacgagtactaaggttaactaagttaaccgtcgtaccttactctacgggtttccgggacggacgggtaaccggtaggtacgggactaacgtacgaaaccggtcggtaggtcggaccgtaggacctaccgtgttaccg

SEQ ID NO: 226458 - DNA, 699 bp, Homo sapiens
  misc_feature: GYAE6OF02H20WR.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtcctgtgtcctaccgaggggaaagcgcccaccctctcctgccgagggccagtcaggtagtggttaggagctaacttgccgtggtaaccagctaataaccgtggccaggcctccgaggcctcctactatctagtggtcgcacgtccgaaccgtacgggcctacgtcggtacctccgacgcctacgttcagtcggcgtaggtggttccgtagggacctagtcgttccacgttcctaccgactactacgagcacgtccgtgtccgtacggttcgtaggttaacgttacggttttaggttaagtttttaacgttacgttcgttacgacgtacgtaagttaacgttaacgttaaccgtccgttaccgttccgtaaccgtttaccggtttaccgggtaaccgggaacggggttaaccggtaaggggttaacggtaaacggtaaccgttaaacggtaaaacccgtcggtttaagggtacgggtacccgttacggtacccgttacccggttacgtttaccgg

SEQ ID NO: 226459 - DNA, 707 bp, Homo sapiens
  misc_feature: GYAE6OF02GMVZT.4.51.E07.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctccngcagggccagtcagagtgttaggagcaacttagcctggtaccagcataaacctggccaggctcccgaggctcctcatctagtggtcgcactcccacgagggcctacgtggtactcccgagtccacgttcagtcggactaggtgggtctgggacacgtacgtttccgaccttcgtaccacctacgtcacggtactacggtccctaggactacggttacgtacggtaaaggtttacgtttttaggggtaacgttttttaacgttaccgttaggttaccgtaacgtacgttaaacggtttaaatttaaaccgttaaaccggtcgggttacccctttacgtttaacccgttaccgggtttttacccgggggaccggggtaaacgggggtaacccgtaaaggggggttcgggaacggttaaccgtaaaccggtaaaaccggtacgtttacggggtacggtaccgtaccggtacccgtaccgtaagtttcccgg

SEQ ID NO: 226460 - DNA, 670 bp, Homo sapiens
  misc_feature: GYAE6OF02IDV28.4.51.E07.1.454.CMB.1.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
  modified_base (440)..(440): a, c, t, g, unknown or other
  misc_feature (440)..(440): n is a, c, g, or t
tcagagcactgtagcacgaccggtgctcgatttagcatactctacaacacacaaagggggaggaactgctcagttaggaccagacggaaccatggaagccccagcgcagctttctcttcctcctgctactctggctcccagataccactggagaaatagtgatgacgcagtctccagcccacccttgtcctgtcgttctaccgaagggggaaanacgccctaaccctctcctgcgagggccaagtcagagtcgttagganctaacttagcctggtacccagaccaactaaacctggaccctaggcctacccgaggtcctcccgtactaacttccgtagttcgggtagtacctactacccgtaaccgacggggcctaacgtcggtactcccgacgtacctaccgttacacggtcggcgacgggttcggtcgtacgggaacncgtacggttccacttcgtacctacacgtccacggcaccgtcctggacctacgtacgtagttaaacgtttaggtttttacgggaatttttacttacgtcgtaacgtaggacttaaggttactaaacgttaccgtacgttaccttctcgttaccgtttagggcgtaccgggacgtagggtggataacgtaacgtaacgaagttcggtacgccgtactacgaccgagtttccg

SEQ ID NO: 226461 - DNA, 625 bp, Homo sapiens
  misc_feature: GYAE6OF02IQMC1.4.51.E07.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (278)..(278): a, c, t, g, unknown or other
  misc_feature (278)..(278): n is a, c, g, or t
  modified_base (352)..(352): a, c, t, g, unknown or other
  misc_feature (352)..(352): n is a, c, g, or t
  modified_base (427)..(427): a, c, t, g, unknown or other
  misc_feature (427)..(427): n is a, c, g, or t
  modified_base (458)..(458): a, c, t, g, unknown or other
  misc_feature (458)..(458): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatgtgatgacgcagtctccagcccacctgtctgtgtctccgaggggaaancgccaccctntccctgcaggcagtcagntgtagngcaactagccnggtacagcataacctggccaggctaccnggctcctcatctatcggtgcactccacgaggcctagtcggatcccgagcctaagttcagtggcgtagtcgggtntcgggacaaccgtgttccgactccgtaccacctaacgtacaggcacggcctagtcaacgttccagtaaacggttnttttagggacttttagttacttgtacagtanaacggtttataaacttaaccgtggacccttcgtaccgttaaacgttttccggggaacgggtacgggtaacccgtaaaggggttgggtaaaccgaacgttaaccgaaaacgtaaccggtttggttaaccggggcctttaacggaccccgttaacgtaccgtttaccgg

SEQ ID NO: 226462 - DNA, 710 bp, Homo sapiens
  misc_feature: GYAE6OF02F4PS4.4.51.E07.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanacgccaccctctctgccaggccagtcagagtgtaggngacaacttgcctggtaccagacaactaaccgtggacccaggtcctcccgaggcctcctcatcttagtggtacnctactcccaaccgagggtcccacgttggtacctccccgagtcccgtaacggttcagggttcgggaccgtaggggttcggggttaccgtaggggtaaacctaccgtaacgggtttcccaacccgtttccgttaccacccgtatacccgaaggtcccacggtccctacgccgttaacgttcctaggttaaaggttttcggttttagggttaactttttaacgttacgttagtaccgtagttaacgttaaattaacgtaaacgttaccggttccgtacctttactaccggttaaccggtttccgggacggggtaccgggaaccgtagggtacggtaacggttaacgtaacgaaaccggtacggttggtccgggtactaccggactaccggtattaccg

SEQ ID NO: 226463 - DNA, 761 bp, Homo sapiens
  misc_feature: GYAE6OF02JS4FX.4.51.E07.1.454.CMB.1.raw
  modified_base (156)..(156): a, c, t, g, unknown or other
  misc_feature (156)..(156): n is a, c, g, or t
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggcctcccagataccactgggaanaaatgtgatcgacgcagtctccagccacctgtctgtntctccgaggggaaancgcccacctgtcctggcgacgggccagtccgagtaacgttggttaggacgtctaaaccgttgccgttacggaccagacctaacgtaaaccgtcgggccctaagggtccctacccggaggtccctaccgtacgacttaccgtacgttacggggtcctaaccctaaccgttaccccgaaccgggtaaccgggggtccctaaccggttaggggtaccccttaccccgacggtacccgtaaccgtttccgaacgggttcggacgttacgggttcgggtccgtacgggacctaccgtggttaccacgtcctactaccgacttcgaagtccctggtaccttgacgtcgtacgtacgtaagttcgttttagtaacgtttactttacggtacgtacgtacgtaaccgttacgtacgtttaaacttccgggttacgtaccgttaccgtaaccggttaccggtttcggggaaccggtacgggaaccggttaggaaccggtaagtaccttaaccggaaccggttagcggtttacggccgttaaccggacctaagttcgttccgg

SEQ ID NO: 226464 - DNA, 599 bp, Homo sapiens
  misc_feature: GYAE6OF02F479R.4.51.E07.1.454.CMB.1.raw
  modified_base (208)..(208): a, c, t, g, unknown or other
  misc_feature (208)..(208): n is a, c, g, or t
  modified_base (248)..(248): a, c, t, g, unknown or other
  misc_feature (248)..(248): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtcgtctccgaggggaaancgcccaccctctcctgcagggccagtcagagtgttaggancaacttagcctggtaccagcataaacctggccaggctcccaggcctcctcatctatgatcgcactccgaagacgggtccaacgtggccactcccgagcctaggttcaggttcggacgtaggtcggggtctaggggactaggtacctttcgactcctacacactaccaccgacgaccgtacgacgtcctggtaacggttagtttcgtacgttactttacgttacgtcgtacgagtacaggtcgtaacgcgtaacgtcggacccttgtcgtcttaccgtacgtttcgggaccggaacgggaccgtaagggtacggtaagtacgtaacgtaaacgacgtaggtacggacgtacg

SEQ ID NO: 226465 - DNA, 709 bp, Homo sapiens
  misc_feature: GYAE6OF02FJ2JE.4.51.E07.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagactaccactggggaaatagtgatgacgcagtctccagccaccctgtctgtgtctccgaggggaaacngcccaccctntcctgcagggccagtcagntgttagganctactgcctggaccagcataaacctggccaggcctacccgaggcctaccgtcacttcgagttggcgtaccacgtaccgaccgtagggccctacgtcgggttaactccccgagcccgtaccgtttacgaaggttcgggacctaaggggttcgggtacccgttaggggacctaaccgtacggtttaccacccgttaccgtacccaacccgtagtaccgacggaccctaacggtcccgtacggaccgtacggttacgtacggtaaacgtttacggtttttaggtaacgttttaacgtttacgtcggttacgaacgtcgttaaagtaactttaaacgtaaccgttcggtaccttacgtacgtacggtttaccgggacggtacgggacccgtaaggggtcgtaacgtaccggtaaccgaaaccggttagtcggtcggtactaccggactacccgttagtccgttaccg

SEQ ID NO: 226466 - DNA, 748 bp, Homo sapiens
  misc_feature: GYAE6OF02HES0T.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtcgtcctccgaggggaaacgacgcccacctcctcctgccagggccagtcagagtgttaggagactaacttagccttaggtaccaggacctaacgtaaacccgtcggcccaacgggcctaccccgaggtccctacctacactcctagtgggtacgcctactcccgaccggtacggacccacgttcggtaacctccccgacggtaccctacgttccgacggttcgggccgtaggttaccggggttctacgggggaaccctacgtacggtttccaaccgtttccgtaacccgaacctacgtaccaacggccacggtccttgaccgtacgtctacggtaaacggtttacgttttagggttaactttttaccgttaaacgttcggtaccgtaacgtcgttaaacgttaaccttaaacgttaaccgtcgggttacccttacgttaccgttaccgtttacgggggaccggtacggggaaccgtaacggggtacggtaaccgtaagttaacccgaaaacggttcggttaggtaccggtaccttacggacccgttactagttacccg

SEQ ID NO: 226467 - DNA, 682 bp, Homo sapiens
  misc_feature: GYAE6OF02JUR8J.4.51.E07.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
  modified_base (509)..(509): a, c, t, g, unknown or other
  misc_feature (509)..(509): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggcctcccagataccactggaagaaatgtgatgacgcagtcctccagcccaccctgtctgtgtcnccgaaggggaaanacgcccaccctcgtcctgccgagggccagtcagagttgtaggagcaacttgcctaggtaccagcaagtaaaccgtgggaccagggccctaccgacggtccctccgtacacttccgtaaggtcgggtcgaccaacgtccccaaccggacgggtcccctaacgtcggtaacctccccgaggaccctaacggttcacggttcggcgtaagggtcgggtctacggggactacgtagtcccaactcgtacacntcagccagcctncgtagtctaagtaagttagtttacggtatttattacgtnttacgagtaacgtaagttaacgttaaacctacgttacggtcccttacgttaccgtaccgggttttaacggaccgggtacggtaaccgttaacgggggtacgtaaagtaaccgttaaccggaaacggtaccggttggttaaccggccgtttacgacccgtaccgttagttaccg

SEQ ID NO: 226468 - DNA, 887 bp, Homo sapiens
  misc_feature: GYAE6OF02GN5JL.4.51.E07.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
  modified_base (282)..(282): a, c, t, g, unknown or other
  misc_feature (282)..(282): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagactaccactggagaaatgtgatgacgcagtctccagcccacctgtctgtgtcctccgaaggggaancgcccaccctctccngcgacgggccagtcagtgtgtagganacacgttacgcctcggacagactaactaaaccgnggacccaggccctacccgaggtcctcccgtactacgttcgtacggtcggtacgacctaaccgtcccgaaccggacggtacctaccggttacggtaacccgttaccccgaaccggtacccttaacgggttacccgtacgggtccgggtaccgtacggggttaccggggtaccggtacggggtaacctaacgttaaccgggtttaccctaaccgttaccgtaacccctaaccggtaactacccggaggtacccgaacccggtacccgttacggtaccgtacggttaacccggttaaggttaaacgggttttaggtttttaaccgggtttaagtttttaaaccctttacgggtacgtttaaccggaacggttaaccgttaaacgggtttaaactttaaaaccgggttaccgttaccgggtaaccctttaccggtttaaccggtttaacccgggttaacccgggggtacggggtaaccgggggttaaccggtaaaggggttaccgggttaaacgttaaacccgggtaaaaccgtaaaccggggttaaccggttacgggtaacccgggtaccgttaaccgggtacccgttaaccgtacggttttccccgg

SEQ ID NO: 226469 - DNA, 670 bp, Homo sapiens
  misc_feature: GYAE6OF02I4WKU.4.51.E07.1.454.CMB.1.raw
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
tcagagcactgtagcacgaccggtgctcgatttagcatactctacaacacacaaagggggaggaactgctcgagttaggacccagacggaaccatggaagccccagcgcagcttctcttcctcctgctactctggctcccagataccactggagaaatgtgatgacgcagtctccagccaccctgtctgtgtctccaggggaaangccaccctctcctgcagggccagtcagagtgtagncaacttgcctggtaccngcataacctggccaggctccaggctctcatcatggncactcccacgnggccagtggactccagccctagttcaggtggctagggtcgggtctaggggaacctactacggtttccaaccgtttcgtaccaacccgtaacttccgaacggtccgtaacggcccgttaggtacccgtacggttacccgtaaggtaaacggtttacggttttttagggttaactttttaacgtttaccttcggtacgtaacgtaccttaaagtttaaacgttaaacgtttaacggtccgggttacctttcgtacgttaccgttttacggggaccggtaacgggaaccgttaagggtaacgggagttaactaaccggtaaaccgtaacgttggtacggtaccgttacgacccggtacctagttcccgg

SEQ ID NO: 226470 - DNA, 756 bp, Homo sapiens
  misc_feature: GYAE6OF02F1EWA.4.51.E07.1.454.CMB.1.raw
  modified_base (208)..(208): a, c, t, g, unknown or other
  misc_feature (208)..(208): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaancgcccacctctcctgcgacgggccagtcaggtagtaggttaggacgactaacgttcgccgtacggtaccaggacctaaacgttaaccgtggacccgaaggtccctaccccgaaggtcccttaccgtactaacttaccgtaacggttcgggtacaccgtaacctaccccggaaccggacggggtaccctaacgttaccgggtaccctacccgaaccggtacccgtaacgttaccgtagggtccggacgtacgggttcgggtaccgtacggggaacctacggtaccgttaccaccgttaccacgaacctacgtcgaacgtccgaccgtcgtacgtacgtaacgttactagggttaacgtttaggttttacgttaacgttttacgtaacgttcggtaactacggtaacttaaacggttaataaaccgttacgtccggttacctaccgttacggtacgggtacgggtaccggtacggtaccgtaagggtcgaaacgtacctaaccggtaaacgtcgtacggtcgaccgttacgaccgttacgactttacccg

SEQ ID NO: 226471 - DNA, 922 bp, Homo sapiens
  misc_feature: GYAE6OF02JSQRC.4.51.E07.1.454.CMB.1.raw
  modified_base (219)..(219): a, c, t, g, unknown or other
  misc_feature (219)..(219): n is a, c, g, or t
tcagagcactgtagcacgaccggtgctcgatttagcatactctacaacacacaaggggaggaactgctcagttaggacccagacggaaccgatggaagccccagccgcagcttctcttcctcctgctactctggctcccagactaccgacgtggagaaatagtcgatgaccgctagtcctccagcccacccgtgtcctgtctaccgccgagggaaagcncccctaccctctccgtgaccgtacgggccacgtcgaaggtagttggttaaggacgtcctaaacgttacggtcccgtacggtaccaagcgtaacttaaaccccgtcggaccctacggccctacccgaggtccctacccgtactcgttaccgtacgtcggtagaccctaccgtcccggaaccgtcggggaaccccttccgttagggttacccctccccgaacgttaccccgtacggttaccgaacgggttccggccggtttaacggtcggggtttacgtaaccgggacctaacccgttacggtttaccccgaacgttccccgttaaacgtaccccgtaactttacccggaacccggtaccgtaccggtaacccgtacgggtaccccgttacgggtttaaccggtaacggtttaaaccgggtttagttttaaccggggtttaaccttttaaacggttttacccggttacgtttacccgaacggttaccgttaaccgtttaagttaaacccggtttaacggtcccgggtttaacccttacccggttaccgtttaaccgggttccgggtacccggggacgggttaacccggttaaggtaaccggggttaaccgtaacgttaaaccccgtttaaacgggtaacccggtttacgggttaccgggtaacgttaccccgggtaaacgtttaccggttacccgttttaaccgg

SEQ ID NO: 226472 - DNA, 958 bp, Homo sapiens
  misc_feature: GYAE6OF02H2XVA.4.51.E07.1.454.CMB.1.raw
tcagagcactgtagcacgaccggtgctcgatttagcatactctacaacacacaaagggggaggaactgctcagttaggacccagacggaaccatggaacgccccagcgcagcttctccttcctcctgctactctggctcccagataccacgtaggagaaatagtgatgacgcagtctccgacgccctacctgttctggtcgtcctaccggaagggggaaacgacgtcccctaacccccttctcccgtcgccggacgggtcccgaacggttccgtaaggtagttagggtttaaggaacgtaccgtaaaccgttacggtcccgtacggtaacccaaggtacctaaactaaacccggtcggacccgtaacggtccctaccccggtacgggtccctccccgttactaacgttcgttacgtcgggtctaccctacgtccccgaacggccgggaccctacggttacggtaaccgtccccgaacggtacccttaaccggttcgacgggttaacgggtccggtaggggtttaccggggtaccgttacgggggaacctaaccgttaacgttccccttacctacccgtaccgacctaaactccgaaaccgtccgaaccggtctacgtaccgtacgttaacgtaaggttaaggttttacgggttttttaacggttaacgtttttaaaccgttacgggttaaacgttaccggtaaacggttttaccggttaaaaacggttttaaaccttaaaaacgggttacccggtttaacccggtacccgtttttaccggtaaccggttttaacccgggtttacggggggaaccccggggttaaacgggttaacccggggttaagggttaaccgggaaaccggtttaaaacgtaaaaccccggttaaaagtttaaccccggggtaggggttaaccgggtccctaaacccgggtacccgtaccggttttactttacggg

SEQ ID NO: 226473 - DNA, 747 bp, Homo sapiens
  misc_feature: GYAE6OF02IQN3O.4.51.E07.1.454.CMB.1.raw
  modified_base (220)..(220): a, c, t, g, unknown or other
  misc_feature (220)..(220): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
tcagagcactgtagcacgaccggtgctcgatttagcatactctacaacacacaaagggggaggaactgctcagttaggacccagacggaacatggaacgccccagcgcagcttctcttcctcctgctactctggactccagactaccactggaagaaatagtgatagacgacagtcctccacgccctacccgttgtctgtcgtcctaccggaaggggaancgcccacctcctcgtcgcggacggcctagtcgagtaggtcggttaaggctactaacgttcgcgtcgtaacngacaacgtaccgnggacctagcctccgaggtcctcctnacgtctagtgtcactacnccgaccgcggcctaggtcgtactccgagtccctacggtagtcggtacggtactaggggtccggtgaccgggtaataccgttagttaacccgctttacccgactaaccgtaccgtacggaaccgtacgtaccgtaccgtcgtaccgttacgtacgtacggttaaggtttacggttttacggtttaagttttaacgttacggttacgtaccgtacggtaccgttaaacgtttaactttaaacggtacccggtacgtttcccgtaacggttacccttaccgggggttacggttaaccgggtaacgggtacggttaaccgggacggttaaacgaccggtaaaaccgtaaccgggttacgttacgggtcggttaccgacccggttacctaaaccggttcttccgg

SEQ ID NO: 226474 - DNA, 647 bp, Homo sapiens
  misc_feature: GYAE6OF02HGOVX.4.51.E07.1.454.CMB.1.raw
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctcgtagtctccgaaggggaaagacgcccaccctctcctgccagggccagtcagagtggttaaggagactaacttagcctaggtacccagcaataaaccgtgaccaggctcccaggctcctacactctagtggtgcactcccgaacgagggcctacgtgtacctaccaggtaccctacgttcacggtcggactacgggttcgggtaccgtacggggaaccaacgtacggttacgacctttccgtacctaactacgtacgaacggacaacggtccctagcctaagtaccgtagaaagtttacgttttagggtaatttttaactcgtagtactacgtacgtaaagttaataaacttaacgtcgccttataccgtaacgtttcggggacgtagggtaaccgtagggtcggaagactaaaccggtaactaacggttgacggtcgtactaaccgtacgtattccgg

SEQ ID NO: 226475 - DNA, 762 bp, Homo sapiens
  misc_feature: GYAE6OF02JF0HA.4.51.E07.1.454.CMB.1.raw
  modified_base (259)..(259): a, c, t, g, unknown or other
  misc_feature (259)..(259): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctaccagcccaccctgtctgtgtctccgaaggggaaagacgcccacccctctccgtgccgtagggccagttccaggtagtgttagganctaacgttcgccgtcggtaccagaccaacttaaaaccgtcggacccgtaacggtccctcccgaacggtccttcccctcgtacttacttaggtcgggtagtaccacctacccgaacgtacggggccctaccggttggtaacctaccccgacggtacccgttaccgttccgtaacgggtcggaccggtagggtcgggttccggtacggggtaccaacccgttaggttcctacccgttctaccgtaacctaccgttccggacgtccgtaccgtccgtacgtacccgtacgtacgtacggttaaggtttaggttttaggtttacgtttaacgttcgttgtaccgtacgtacgttactaagtttaacgttacgtccggttaccttccgtaacccgttaccggtttacggggaccggtaccgggtaacggtaacgggtagggtaaccgtacgtaaccggtaaacgttaacggtacggttcggtaccgtacgtccgtacttacgttcccg

SEQ ID NO: 226476 - DNA, 733 bp, Homo sapiens
  misc_feature: GYAE6OF02GM8QA.4.51.E07.1.454.CMB.1.raw
  modified_base (258)..(258): a, c, t, g, unknown or other
  misc_feature (258)..(258): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctacctctggcctcccagactaccactggaagaaatagtgatgacgcagtctccacgcccaccctgtctgtgtcctaccgaaggggaaagcgcccaccctctccgtgcgaggccagtcagagttggttagganacaacttacgcctacggtaccagcaacttaaaccgtcggacccgaggcctcccgaaggtcctcccgtacacttcctaagtcggtgactactcccaaccgtagggcccacgttggtaacctcccgacgccctaacgttcaagggttcggacgtagggtcgggttcgtacggggaacaccgtacggttccaccgtctaccaacctactaccgacgaccgacgccgtcgacgtacggttactaggtaaacgttagttttcgacgtacggttagttaactttaccgttcgtacctacggtacccgtaagggttcgggttacgggttacgtccgttacccggtaacccggtaaccgggtttacccgggacccggtaaaaccggggtaaccggtaaacggggttaacgggaaaacgttaaccggaaaaccgtaacggttacggtaccgggtacgttacggaccctaaccgtactttacccg

SEQ ID NO: 226477 - DNA, 841 bp, Homo sapiens
  misc_feature: GYAE6OF02IBUZN.4.51.E07.1.454.CMB.1.raw
  modified_base (216)..(216): a, c, t, g, unknown or other
  misc_feature (216)..(216): n is a, c, g, or t
tcagagcactgtagcacgaccggtgctcgatttagcatactctacaacacacaaagggggaggaactgctcagttaggacccagacggaaccatggaagccccagcgcagcttctcttcctctagctactctggctcccagataaccactggaagaataggttcatggacgtctagtctccagccacctgtctgtactcgtacgaaggggaaacgngccgacccttcgtcctgcagggaccagtcgaagtagttcggttaagagactaacttaggaccttggtaacccagactaacgttaaaaccgtgggacctagggacctacccgacgggttctacccgttacgtacgttaccgtaagtcgggtaggtacctaacgttaccgaacccgttagggccccgttaaacgttcggggtaaccttaccccgtaacggtaaccccgtagggttttaaccgaacgggttcggtacggtaaacccgggtttgggggacccgtttacgggggaaaccctaaccggtacggtttttaccaaaccgtttccccggtaaacgtaacctaacgttaccgaaacgtaccgaacgtaccgttcggacgttacgtacggttaagtaaccgttaagtttttagggtaacgttttaacttacgtacgttactacggtacgttaagttaacgtaaacgttaaaccgtaccggttacctttaaccgtaaccgttacggtttacccgggtacgggttaaccggggtaaccgtaaacgggtcggtaaacggtaacgttaaccggaaaaccgttcggtaacggtaccggttaccgttaccggacctaccgtagtttacccgg

SEQ ID NO: 226478 - DNA, 677 bp, Homo sapiens
  misc_feature: GYAE6OF02F4PRC.4.51.E07.1.454.CMB.1.raw
  modified_base (209)..(209): a, c, t, g, unknown or other
  misc_feature (209)..(209): n is a, c, g, or t
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagataccactgggagaaatagtgatgacgcagtctccagcccaccctgtctgtcgtctccgaggggaaangcccaccctctcctgcagggccagtcagagtgtagagcaacttagcctggtaccagcaataaaccnggacccaggcctccccgaggtctcccgtnactctaagtggtcgcacgtccaccgacgggtcccacgtggtaacctcccacgccgtacgttcgaaggtcggactaggtcgggttactcggggtaaccacgttagttccaccgtcttcaacccgtaactccgaagccgtaaccgccctcggtacaacgttccgtaggttaaacggtttacgttttcggttaagtttttactttaacgtcggtacgttacgtacttaaaggttaacttaaacgttaaaccggttcgttacccgttattaccggtacgttttacccggggacgggtagggtaacgtaacggggtcgaaggtacctacgaaaaccgtggttcggttacgtcccgtacgtacctaccgtcgttacccg

SEQ ID NO: 226479 - DNA, 846 bp, Homo sapiens
  misc_feature: GYAE6OF02HP0CU.4.51.E07.1.454.CMB.1.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagactaccactggagaaatagtgatgacgcagtctccagccaccctgtctgtntcctcgaggggaancgccaccctctcctgcgagggccagtcagagttgttagggacgtactaacttacggccgtacggtaaccagtacctaaacgttaaaaccccgtcgggtacccgacgggtccctaccccgaacgggtcccttacccgtcctaacgttccgttaagttcgggttcgacctaaccgttaccccgaacccgggacggggtacccctaacggttaccggggttaaccctacccccgaacggtaccccgttaaccggtttacgaacgggtttcgggaccggttaggggttcgggggttaccgttacggggaaccttaaccgtacggtttccctaaccgtttccctaccgaaccctacgttaccgacggaccctacgggtcccttacggtaccttacggttaccggttaacgggttaaaggtttttacggtttttttaaggggttaaacgttttttttaaccgtttaacgttcggttaaccgtacggttaacgtaaagttaacgttaacgttaaccgttacggtccctttacgtacctttaccggtttccgggacgggtacgggtaccgtaaggggtcggtaacgtaacgttaacggaaaccgtacgttagggtaccgggtctacggtacccaccggttacgttccg

SEQ ID NO: 226480 - DNA, 703 bp, Homo sapiens
  misc_feature: GYAE6OF02HE0BH.4.51.E07.1.454.CMB.1.raw
  modified_base (213)..(213): a, c, t, g, unknown or other
  misc_feature (213)..(213): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggcctcccagataccaacgtggaagaaatagtgatgacgcagtctccagcccaccctgtctgtgtcctccgaaggggaaanacgcccaacccttctcctgccgaggccagtcaagagttgttaggatccaaacgttagcctaggtaccagacaaactaaaccgtcggaccaggcctacccgacggcttacccgtcctatcctagtggtacgcatcccgaaccgacggacctacgtcggtaacctcccgagaccctacgttacgagtacggccgaaggttcgggtactacggggtaacaacgtacgttaccacgttccctacgaaccactaccgaagacccgtagaccttacgacgtaacgttacgtagtaaagttacgtttttagggtaacgttttatttaacgtggtaccctaaggccttaaacggttaattaaacgtaacgttccggaccttacgttaccggttaacgtttccgggacggggtaacgggaacctaaggggtcgaaacgtaagttaaccggaaaccgtaagttccggtaggccttacgggaaccctaccgtaagtttccg

SEQ ID NO: 226481 - DNA, 856 bp, Homo sapiens
  misc_feature: GYAE6OF02GIKVD.4.51.E07.1.454.CMB.1.raw
  modified_base (61)..(61): a, c, t, g, unknown or other
  misc_feature (61)..(61): n is a, c, g, or t
  modified_base (212)..(212): a, c, t, g, unknown or other
  misc_feature (212)..(212): n is a, c, g, or t
tcagagcactgtagcacgaccggtgctcgatttagcatactctacaacacacaaagggggnggaactgctcagttaggacccagacggaaccgatggaagccccagcgcagcttctcttcctcctgctacgtctggcctcccagataccactggagaaatagtgatgacgcagtctcacgccctacctgtctgtcgtctccgaaggggaaancgtcccaccctctccgtagccgacgggccagttcgaagtggttaggttaggacgtacctaaacgttacggccgttaggaacccgaagtacgaaacttaaaaccgtcgggacccctaagggtcccctacccggaacggtcccttacccgtctaacgtccttaagtcggtacgacctaacgtacccgaaccggtaccgggacctaacgtacggtaccctccgacgacctacgttcgaggtcgtacggtaggttcggtcgtagggaacctacgttcgtacctaccgtttacaccgtacccgtaagtcaacgtccccggtaactcccggtagtacccgtaggtaaccttaagggtaacgttttagttttacgggtttaacttttaaactttacgggtacgttccgtaacgttaacggtaacgttaaaacgtttaaccggttaaccggttccgttacccttaccggttaaaccggttacccggggttaccggggtaacggggttaaccgggtaacccggttaaaagggggttacggaaaccgggttttaaaaccgtaaaaccgggttaaaacccgggtagggtttaacccgggtacggggttacccgtaaaccgggttaaccccttaacccgggttccttttacccggg

SEQ ID NO: 226482 - DNA, 764 bp, Homo sapiens
  misc_feature: GYAE6OF02H81DQ.4.51.E07.1.454.CMB.1.raw
  modified_base (152)..(152): a, c, t, g, unknown or other
  misc_feature (152)..(152): n is a, c, g, or t
  modified_base (419)..(419): a, c, t, g, unknown or other
  misc_feature (419)..(419): n is a, c, g, or t
  modified_base (540)..(540): a, c, t, g, unknown or other
  misc_feature (540)..(540): n is a, c, g, or t
tcagagcactgtagcacgaccggtgctcgatttagcatactctacaacacacaaagggggagaactgctcagttaggaccagacggaaccatggaagccccagcgcagcttctcttcctcctgctactctggctcccagactaccactgganaaataggtgatggacgcagtctaccacgccacctgtctgtcgtctacgaaggggaaacgcgccctacccgtctacgcggacgagggccaagtccgaaggtagtggttaaggacgtactaacgtttggaccgttaggaaccaggactaagtaaacccgtcggaccaacgggcccttacccggaacggtccttaccctctaacgttaccgttaagtcgggttacaccgtaactaccccgaacggtacggccgtaacgtcgggttaaccncccgtaaggtacccgtacggtttacgacggtcggacgttacgggtcggtacggtcgggaactacggtaccgttacgacgtacctacgactaacgtccacgtcgacgtccgtagaccgtacncgttaaggtaacggttcgttttaacgttaggtttaacctttacgtacgtaacgtacggttaactaacggttactaaaccgttacggttacccgtactttacccgtagttaacccgggtttcgggaaaccggaaccgggttaacggtaacgggttacggaacgttacgaaacccgtaacggtacttacgggcgtacccgttacggaacccttactaccggttacg

SEQ ID NO: 226483 - DNA, 639 bp, Homo sapiens
  misc_feature: GYAE6OF02I3H1C.4.51.E07.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagactaccactggagaaatgtgatgacgcagtctccagccacctgtctgtgtctccgaggggaanacgcccacctctcctggcagggccagtcagtagtgtaggancaacttagccgtaggtaccagactaactaaaccgtggaccaggcctacccgaggccttcccgtacacgttctagtcggtgaccacgtacccgacgtacgggaccctacgttacgggtacctcccgacgcccgtaacgttcgtaggtacggcgtacggttcggggtaccgtacgggggaccaacgtcggttacctaccgtactaccgacctactcgaacgacacgtacctgacgtacgtccggtagtaagttacggttttaggtactttaattcgtgtactagtacaaggttactaacgttacgtcgtaccttactacgtacgtttcgggacggtacggacgtagggtacgagtacgtaacgaacgtagtgtcgaccttcgaccgtactgttccg

SEQ ID NO: 226484 - DNA, 748 bp, Homo sapiens
  misc_feature: GYAE6OF02JTMHB.4.51.E07.1.454.CMB.1.raw
  modified_base (251)..(251): a, c, t, g, unknown or other
  misc_feature (251)..(251): n is a, c, g, or t
  modified_base (340)..(340): a, c, t, g, unknown or other
  misc_feature (340)..(340): n is a, c, g, or t
tcagagcactgtagcacgaccggtgctcgatttagcatactctacaacacacaaagggggaggaactgctcagttaggacccagacggaacatggaacgcccagcgcagtcttctcttcctctgactactctcggctcccagataccacgtggaagaaatagtgtatcgacggcctagttcctaccgagaccctaccgtgtcctaaggttcgtacctaccggtaaggggaaaccgacgcccctaccccttntccccggtgaccggagggtaccctagggtaccgaaagtcggttagggttaaccggagtaccttaacgtacggccgttacgtaacccganacgtactaaaccgtcggaccgtacgcctaccgcggttccacctacgtattaccgtatcggtaccgctacacccgaccggtacggacctacgtaccggacttacccgtcgaaccgttcgttaccgtggaccgggttcctaagggtggttcccgtaagggaccgtttacgtaacgttcgtaaccgtcttaaccgcctaactccgtaacgcgtaacgtccgtacgtcgtaacgtctaacggttagttacgtttacgttcgtttaacctggtacgtagacttacgagttaacgtaccttcggtacgtaccgttctacgttaccgtggacggtaccgtggtaacggtacgaacggtaactacgttaacccggattacgggtacgtacggttacgacgtttacgcgtttaaccg

SEQ ID NO: 226485 - DNA, 779 bp, Homo sapiens
  misc_feature: GYAE6OF02JTAUK.4.51.E07.1.454.CMB.1.raw
  modified_base (221)..(221): a, c, t, g, unknown or other
  misc_feature (221)..(221): n is a, c, g, or t
tcagagcactgtagcacgaccggtgctcgatttagcatactctacaacacacaaagggggaggaactgctcagttaggacccagacggaaccatggaagccccagcgcagcttctcttcctcctgctactctggctcccagactaccactggagaaatagtgatcgaacgcagtcctccgacgcccacccgtgtctggtcgtacctccggaagggggaaanccgaccctacccgtctccgtcgacgacgggcctagtcgaggtaggttggttaacggacgtacctaacgttcgccgttaggtaccagacctaacgtaaaccgtggacccgacggtaccctcccgacggtccctcccgtactaacgttccgttaagtccgggtctacctacccgtacccgaaccgggaccggggtaccctacgttacgggtaaccctccccgtaaccggacccgttacggtacggtaccggtacgggaccgtttacggggtccggggttcggtaacgggtaacctaacggttccgttaccacgtccctacgacctactcgaacgcctaacgcctacggctacggttcgaagttaacggtttgtttaccgttagtttaaccttacgtcggtaacgtaacgtacgtttaataaaccgtttacgaaccgttccgttaacctccggttaacggttcccggttacgggtacggtaaccgggtacgttaagggtacgggtaactacggtaacgaacggtgtaaccggtcggtactccgtacctacgttatttccgg

SEQ ID NO: 226486 - DNA, 216 bp, Homo sapiens
  misc_feature: GYAE6OF01AKRF2.44.56.F01.1.454.CMB.1.raw
  modified_base (213)..(216): a, c, t, g, unknown or other
  misc_feature (213)..(216): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnnn

SEQ ID NO: 226487 - DNA, 223 bp, Homo sapiens
  misc_feature: GYAE6OF01CALDN.44.56.F01.1.454.CMB.1.raw
  modified_base (212)..(223): a, c, t, g, unknown or other
  misc_feature (212)..(223): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctggggcacagcggccctgggctgcctggtcaaggactattcctcgatcgcgtctgagcgggctggcaaggcgcatagnnnnnnnnnnnn

SEQ ID NO: 226488 - DNA, 216 bp, Homo sapiens
  misc_feature: GYAE6OF01B0NTZ.44.56.F01.1.454.CMB.1.raw
  modified_base (214)..(216): a, c, t, g, unknown or other
  misc_feature (214)..(216): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 226489 - DNA, 518 bp, Homo sapiens
  misc_feature: GYAE6OF01B1S1Y.44.56.F01.1.454.CMB.1.raw
  modified_base (393)..(393): a, c, t, g, unknown or other
  misc_feature (393)..(393): n is a, c, g, or t
  modified_base (420)..(420): a, c, t, g, unknown or other
  misc_feature (420)..(420): n is a, c, g, or t
  modified_base (488)..(488): a, c, t, g, unknown or other
  misc_feature (488)..(488): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggagtcggggggggcttgggcacagccagggcggtctctgagactctcctgtgtagtctcaggattcagtcttagtgattatcacttggcctgggtccgtcaggctccagggaggggcttggagtggatcactttcgtcagaatgaaacgttatggtgaagtaagagtacgccgcgtctgtgaagganattcacgtctacaagggatgactcaangtgtgcctattacaatgagcaacctgaacgacccgagacacgaggctctatctgcgccaggcgatccngggctcgatcgctattgatgttggggaccg

SEQ ID NO: 226490 - DNA, 216 bp, Homo sapiens; identical to SEQ ID NO: 226488
  misc_feature: GYAE6OF01DD2T5.44.56.F01.1.454.CMB.1.raw
  modified_base (214)..(216): a, c, t, g, unknown or other
  misc_feature (214)..(216): n is a, c, g, or t

SEQ ID NO: 226491 - DNA, 728 bp, Homo sapiens
  misc_feature: GYAE6OF01BQ8KV.44.56.F01.1.454.CMB.1.raw
tcagacagtatatacacgaccggtgctcgatttagcagacgtctgtcggcgggggggattcccagctgtttctgcttgctgatcaggactgcacacagagaactcaccatggagtttgggctgagtcttgggttttccttgttgcttaattttaaaaggtgtccagtgtgaggtgcaggtgagtggaagtttgggggacgccgtaggttccgggccggggggcccctaagactctcctgtctcgtctctcgaaccctacttagcagctactggatgctacgtcgggtccgaccaagtcctaccgaagggaaacgggcctaggagttggtcggggtactacgtacgttaacgttaaccgaccgtagtagggaacttatcgaacgttacggttaacctcgaacggacggtacccggttaggaaccggggtcccgtaatttaccgataccgtaacttacccgtaccgaagaaccgtaaactaaacgtacggttaaaccgaaaacgtaacgggttaacgtttaaagtttaacaaaagtacgtaaacgtaggttaacgtaaaggtacggtacggaacggtacgtacggtactacggtactacgttagttgtagtagtaacgtacttagtgttattacgtaggttagggtacgttagtcggtttcggacccgtacgtcgtacggggacgaacgggttaccgttcggtaccgttcgtccgtctccgtcgtacccg

SEQ ID NO: 226492 - DNA, 793 bp, Homo sapiens
  misc_feature: GYAE6OF01CVBXQ.44.56.F01.1.454.CMB.1.raw
  modified_base (705)..(705): a, c, t, g, unknown or other
  misc_feature (705)..(705): n is a, c, g, or t
  modified_base (730)..(730): a, c, t, g, unknown or other
  misc_feature (730)..(730): n is a, c, g, or t
  modified_base (736)..(736): a, c, t, g, unknown or other
  misc_feature (736)..(736): n is a, c, g, or t
tcagacagtatatacacgaccggtgctcgatttagcagacgtctggaaacgaccacgaaagggggcgtcttggggagaggagcccctagccgtggagattccccaggtagtttacccaccttggtagattcagcacctgagcacagaccaccaacccagtacggagttttggccttaatcttgtattttccttgttagtttttttagaacggtcgtccagtcgcggacggggtcgacttggcggagggtccgggggggggcttgggcgaccgagccgacgggcggtctcgtcgacgactctccgtgttgtagtctcgagggacttacgagttacgtttaggtcgtaacttttactccttacgttcgggccccttcggggtaccccgttaccgaccgggtccttcccggtaacggggtacccggggtcgttttacggaccggttacgggtacttaccgtacggttttccgaccgtaacggtaacggttacggtaaaaccgtttaggtcgggggtaaccgggtaaacggtaaacggtacggttaaccggtcccggtacggttacgtacgggttacggtaaacgggtaacgtactttacccgaaccggtttctaacggaaggggtctacgacgtaccgaaggtacggttgttacggtacttaatttaacgaaattcggaactacctaaaccgtgaaccgaccccgganaccacgtacggtcctctaacgttcncggccncgaggcacttcccgggtggacctgattcggactttagtttcgagtttgggtccgggg

SEQ ID NO: 226493 - DNA, 600 bp, Homo sapiens
  misc_feature: GYAE6OF01BRX3T.44.56.F01.1.454.CMB.1.raw
  modified_base (458)..(458): a, c, t, g, unknown or other
  misc_feature (458)..(458): n is a, c, g, or t
  modified_base (492)..(492): a, c, t, g, unknown or other
  misc_feature (492)..(492): n is a, c, g, or t
  modified_base (530)..(530): a, c, t, g, unknown or other
  misc_feature (530)..(530): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaaggtgtccagtgcggaggggcgacgtgggcgggagggtcgggggggggcttgggcacgagccgaggggcggtctcgtgagactctccgtgtgtagtctcgaggtattcagttcttagtgatttatctacgttggccttggggtcccgtcgaggtcctccgaggggaaggggtcttggaggtggatcgtactttcgcaagtaataggaaacgttgtggtaggaaagtaagagtacgcgcgtctggtaggaaagggatagttccgacgtcgtacgaagggntaggactacaagtagtgtgacctattacaatgancaacgtgaacgacccgagacacgaggctactattacgngaccgtcgaggctacgttccgagggtaccgtcgatcggacttacgtttagacgtttggttggggaacccg

SEQ ID NO: 226494 - DNA, 575 bp, Homo sapiens
  misc_feature: GYAE6OF01EVJY9.44.56.F01.1.454.CMB.1.raw
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (455)..(455): a, c, t, g, unknown or other
  misc_feature (455)..(455): n is a, c, g, or t
  modified_base (520)..(520): a, c, t, g, unknown or other
  misc_feature (520)..(520): n is a, c, g, or t
  modified_base (537)..(537): a, c, t, g, unknown or other
  misc_feature (537)..(537): n is a, c, g, or t
  modified_base (545)..(545): a, c, t, g, unknown or other
  misc_feature (545)..(545): n is a, c, g, or t
tcagacagtatatacacgaccggtgctcgatttagcagacgtctgaacacacgaaaggggggagaggagccccagccgtgagattcccaggagtttccacttggtgatcagcactgagcacagaccaccaaccatggagtttgggctaatcttgtattttccttgttagttttttagaaggtgtccagtgcgaggggcgacgtggcggaggtcggggggggcttggcacgagccgagggcggtctctgagactctcctgtgtagtctcaggattcagttcttagtgattatctacgttggccgtgggtccgtcgaggctccgaggggaggggcttggagtggatctacgtttcgtcagtaagtagtaaacgttagtggtaggaaagtaaagagtacgccgcgtctgtaggaagggaagacttcgaccgtntacgaagggtntagactaccgaaanggttgttggacctatttaacaaatgaagcaactgacgacccgagacacgaggtcttactattacngccgcgaggcactccgngggctcgntcgctatttgatttagttgggcctagggac

SEQ ID NO: 226495 - DNA, 692 bp, Homo sapiens
  misc_feature: GYAE6OF01BJ095.44.56.F01.1.454.CMB.1.raw
  modified_base (400)..(400): a, c, t, g, unknown or other
  misc_feature (400)..(400): n is a, c, g, or t
tcagacagtatatacacgaccggtgctcgatttagcagacgtctgtcggcggggggattcccagctgttctgcttgctgatcaggactgcacacagagaactcaccagtggtaggttgggctgagtcgttgggttttccttgttgtacttaagttttaaaaggtgtaccagtgtggaggtgcgaggtgagtagggtaaggtttgggggaccgtccgtagggttccggggcccggggggtacccctaagcctctccgtgtctcgtctctacgaaccctacgttagcagtctacgtggatgctacgtcgggtccacaagcctaccgaagggaacggtcctagtagtggtcggtctacgtaacgttaataaccgacgtagtacggactatctacgttgttacncgacgaccgtcggtaggacggtctatcatcactcctacgaagacgtaactaagtacgtaacgaaaacgtacggttaagttaattaacaaagtaagtaaactacgtaacgtaaagtacgtaacgaacggacgtacgtctacgtacttagttagttgtagtagtacgttaacttagtagttacgttacgtaggttaggggttattagttcgggttaccggtacccgtacggtacggtacggggtaccgtacgggttaccggttcggtccgttcgttaccttccgtcgtaccgtc

SEQ ID NO: 226496 - DNA, 217 bp, Homo sapiens
  misc_feature: GYAE6OF01EQR6Y.44.56.F01.1.454.CMB.1.raw
  modified_base (214)..(217): a, c, t, g, unknown or other
  misc_feature (214)..(217): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnn

SEQ ID NO: 226497 - DNA, 559 bp, Homo sapiens
  misc_feature: GYAE6OF01EWLIY.44.56.F01.1.454.CMB.1.raw
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (425)..(425): a, c, t, g, unknown or other
  misc_feature (425)..(425): n is a, c, g, or t
tcagacagtatatacacgaccggtgctcgatttagcagacgtctgaacacacaaaggggggggtcacaagaggcagcgctctcgggacgtctccaccatggcctgggctctgctgctcctcactctcctgactcaggacacagggacctgggcccagtcccgccctgactcagccagcctccgtgtctgggtctcctggacagtcgctcaccctctcctgcactggaactaatactgatgttaggaaatataaccttgtctcttgtacaagtactaccacgtaaacccccaactccttcttatgaacgtacaatacgcggccctcggctatttcncgtatcgcttcncagtctacagtctgcaacgaccggctcgttagacttaattcgtcgtcctcgtgccgtgacgacgagccgtacttattntcgctgctcatagtgcggtctagattcgtttgggtcgtcgggcggacgggcccgtcgtcggaccggttcctaggtccgacgccgaagcctccgccccgtgtaccacgttcctaccttccccgcccttcgtaccg

SEQ ID NO: 226498 - DNA, 726 bp, Homo sapiens
  misc_feature: GYAE6OF01DMMLY.44.56.F01.1.454.CMB.1.raw
  modified_base (402)..(402): a, c, t, g, unknown or other
  misc_feature (402)..(402): n is a, c, g, or t
tcagacagtatatacacgaccggtgctcgatttagcagacgtctgaacacacaaagggggggagaggagccccagccgtgagattcccaggagtttccacttggtgatcagcactgagcacagaccaccaaccatggagtttggctaatcttgtattttccttgttagttttttagaaggtgtccagtgcggaggggcgacgtgggcggaggtcggggggggcttgggcacgagccgagggcggtctcgtgagactctcctgtgtagtctcgaggattcagtcttagtgtattatcacgtttggccgttgggtcccgtcgagggtcctaccgaagggggaacggggtcttggagtggatctacttttcgacagtaatgaaacgttgtggtagaaagtaaagngtacgcgcgtctggtagaaagggagtattccgaccgttctacgaagggactacggtacctaccgtaaacgtaggttacggttacggacccttaagtttaaccaaaagttcggaaacgtaccctaaacccgttacggaaccggaaccccggtaacgaaccgaaaccggtacgggtaccgttaccgttaaacgtttaccgtcggacccgtacccgtaagggccgtaacgttcccggtacgggggtacccgtcggtaaacgttcggtaccttaaggtttcggtaaacgtttagggtttaccggggggacccgtaaggggggtaaacc

SEQ ID NO: 226499 - DNA, 771 bp, Homo sapiens
  misc_feature: GYAE6OF01BTKFN.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttggctaatcttgtattttccttgttagttttttagaaggtgtccagtgcgaggggcgacgtggcggagggtcgggggggggcttgggcacgagccgagggcggtctcgtgagactctcctgtgtagtctcaggtattcagttcttagtgtatttatcacgttggccttgggtccgtcgacggcctccggaggggaaggggtcttggaggtggactcgtacgttttcgtacaagtaataggtaaaacgtttagtaggggtaaggaaagtaaaggacggtacggccggtcgtcgtaggtaggaaaggggtaagtacgtttccgaacccggttactacgaaaggggtacttacggaaccctacccgtaaacgtagggtttcggtttaacgggacccttaaagttttaaaccgaaaagtttcgggaaactacccgtaaacccgttaggaacccggtaacccccggaagtaacccgaacccggtaacgggtcccgttaccgttaattacccggtggaccccgtacccggaacggggccgttaacgttccccgggttagggggaaccccttcgggtaaacgttcggtactttaaggttttcggtaaacggtttacgggtttacccgggggg

SEQ ID NO: 226500 - DNA, 644 bp, Homo sapiens
  misc_feature: GYAE6OF01DMAC3.44.56.F01.1.454.CMB.1.raw
tcagacagtatatacacgaccggtgctcgatttagcagacgtctgaacacacaaaggggggagaggagccccagccgtgagattcccaggagtttccacttggtgatcagcactgagcacagaccaccaaccatggagtttgggctaatcttgattttccttgttagttttttagaaggtgtccagtgcgaggggcacgtgggcggaggtcgggggggcttgggcacgaggccagggcggtctcgtgagactctcctgtgtagtctcgaggattcagttcttagtgtattactctacttggccctgggtccctcgaggctccgaggggaagggtcttggagtggatctactttcgacagaatgtaaacgttgtggtaggaagtaaagcgtaccgcgtacgtcgtggtaggaaagggtagtaatttcgaagttcgtactacgaagggtatcgaacctccgaaacgtaggtgttacggacctaagtttaacaaagtgaacgacaacccgtgaaccgtaacccgacgaacacgaggtcctactataccgtgaccgcgaagggcctaagtcccggtaggggaccgttcggaacgttcgaccgttacgtttaaggattttacgggtttcgggggaacccgtaaaggggg

SEQ ID NO: 226501 - DNA, 680 bp, Homo sapiens
  misc_feature: GYAE6OF01ATTG9.44.56.F01.1.454.CMB.1.raw
  modified_base (416)..(416): a, c, t, g, unknown or other
  misc_feature (416)..(416): n is a, c, g, or t
  modified_base (470)..(470): a, c, t, g, unknown or other
  misc_feature (470)..(470): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtggcgggagggtcgggggggggcttggcacgagccgagggcggtctcgtgagactctccgtgtgtagtctcgaggtattcgagtcttagtgtattatctacgttggcctggggtccctgacggcctccggaggggacgggtcttggaggtggtactctacgtttcgtacaagtaatagtaaacgttgtagggtaaggaaagtaaaggngtaccgcgtcgtcgtggtaggaagggatacttccgaccgtactacggaagggtntcgaacctccgaaacgtggttcgttacggaccttaaagtttaacaagtcggtaacacccgtaaccgtggaaaccggaccccgaagaccaacggacgggttccttacgttaacgttacgcggacccgtaccgacgggtccgacgttcccggtaggggtacctacggacgttcgacgtttagtttagggtacgtttacggggttaccggggg

SEQ ID NO: 226502 - DNA, 752 bp, Homo sapiens
  misc_feature: GYAE6OF01CPBEB.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgtattttccttgttagttttttagaggttgtccagtgcggaggggcgacgtgggcgggagggtcgggggggggcttgggcgacgaggccgaggggccggtctctgagactctcctgtgtagtctcgaggtattcgagttcttaagtgtattatctacgttggccgtgggtccgtcgaggtcctaccggaggggacgggtcgttggagtggtaatcgtacttttcggactaagaacgttagtaaacggtttgtaggggtaggtaaagtaaaggtacggtaacgccggtcgttacgtaggtacggaaagggaagttacgttaccgtaaccggtctaaccgtaaaggggtactaggaacccgttaaccaaacggttacggttgggttaaccgggtacctttaaacgtttaaccgtaaagttcgggaaacctaacgtaacccggttaaggacccggtaaccccggaaaccgtacaaccggttaagggcccgtttactaacgtttaccgtcggaccgaccgtacggtccggtaccgtccgggtacgggaccgttaggacctacggtaccttagttttacggaagtttcgggttacgggg

SEQ ID NO: 226503 - DNA, 800 bp, Homo sapiens
  misc_feature: GYAE6OF01BJEHP.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttagtacttttcttgtttagtttttagaggtgtccagtgcggagggcgacgtgggcggacggggtcgggggggtcttgggcacgagccgagggtcggtctcgtgacgtactctccgtgtgtacgtctcgaggtattcgagttcttagtgtatttatctacgttcggccgttcgggtccgtcgacggtccgtaccggaaggggtaacggggtcgttagggtaggttacgggtacttaccgttacgtttttccggacgtaaaggtagttaacggtaaacgtttaggtaggggtaagggtaaaagtaaaggtacggtaaccggcccggtacgtgttacggtaagggaaacgggaagtacgttaccgtaccggtactaccggaaagggtacttaacgaaccgtaaccgaaacgttaggttacgggtttaccggtaacttaaacgttttaaacaaacgttaacgggaactaacccgtaaaccgttcggaaacccggaacccccggaacgtaaacccgaacggaaccgggtaccgtttacctaagtttccgtacggtcccgaccggtacgggccgttaccgttaccgggtacggggtacccgtacggtacgtccggtattagtttacggtagtttaggggttaccggggg

SEQ ID NO: 226504 - DNA, 743 bp, Homo sapiens
  misc_feature: GYAE6OF01DNHHM.44.56.F01.1.454.CMB.1.raw
  modified_base (667)..(667): a, c, t, g, unknown or other
  misc_feature (667)..(667): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttggcacgagccgaggggcggtctcgtgagactctcctgtgtagtctcgaggtattcagttcttagtgtattatcctacgttcggtccgttcggggtcccgtacgagggccgttccggaagggggaagggggtcctttagggaggttcgggtacgttcgtaccgttttccgtacgaagtaagttaggtaaacgtttagtagggtaacgggtaaaggttaaaaggcggttaccggccggtaccgttcgtaggtacggaaaaggggtaacgtacgtttaccgaacccggttctaaccggaaaggggtactcggtaacccttaccgaaaacgttggttcggtttacggacccctttaaagtttaaccgaaagttggaaccgtaccaaacccgtgaccggaacccccgtagaccacgaggtccgttacttacgttaccnggccccgtacgaggtcctaacgtccggtacgggacctgacgttcgagttattttcggacgtttgggttaaccgggg

SEQ ID NO: 226505 - DNA, 546 bp, Homo sapiens
  misc_feature: GYAE6OF01A037D.44.56.F01.1.454.CMB.1.raw
  modified_base (372)..(372): a, c, t, g, unknown or other
  misc_feature (372)..(372): n is a, c, g, or t
  modified_base (444)..(444): a, c, t, g, unknown or other
  misc_feature (444)..(444): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
  modified_base (514)..(514): a, c, t, g, unknown or other
  misc_feature (514)..(514): n is a, c, g, or t
  modified_base (523)..(523): a, c, t, g, unknown or other
  misc_feature (523)..(523): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagtttttttagaaggtgtccagtgcgaggggcgactgggcgggaggtcggggggggggcttgggcacagccgaggggcggtctctgagacctctcctgtgtagtctcaggattcagttcttagtgattatcacttggcctgggtcccgtcaggctccgaggggaagggcttgaggtggatcactttcgcagaatgaaaacgttntagggtaggaagtaaagagtacgccgcgtctggtgaagggatattccacgtctacgaagggatgactccaanagtgttcggctattacaatgagcaactgacacccganacacnggctctattcngcgccaggcgcgtccgngggctcggntgctattgattggttcgggacgg

SEQ ID NO: 226506 - DNA, 802 bp, Homo sapiens
  misc_feature: GYAE6OF01DL0KB.44.56.F01.1.454.CMB.1.raw
tcagacagtatatacacgaccggtgctcgatttagcagacgtctgaacacacaaagggggggagaggagccccagccgtgagattcccaggagtttccacttggtgatcagcactgagcacagaccaccaaccatggagttggctaatcttgtattttccttgttagttttttagaaggtgtccagtgcggaggggcgacgtgggcgggagggtcgggggggggcttgggcacgagccgaggggcggtctctgagactctcctgtgtagtctcaggtattcagttcttaggtgtatttaatctacgttcggccttggggtcccgtcgagggtccttccggaagggggtaacggggtcttggaggtggtatccgtaacttttcgacgtaagtaaagttaggtaaacgtttagtgggtaaggtaaacggttaaaaggcggttaccggaccggtcggttcgtagggtacgggaaaagggtaagtactttacccggaacccggttcgtaaccggaaaggggtactacggtaacccgttacccgaaacgtagggttaggtttacggaccctttaaagtttaacgtaaaagtcgggaaagtacccctaaaccggttacggaaccgtaccccggaaaccggaacccgtaaccggtacgggtaccgttaccttaacgtttaacccgtcggacccggtcccgaacggggaccgtaacgtcccgggttaacggggacccgtttaggagttccggtaacgttagtttacggtaagtttacgggtttacgggggacccgttaaggggggtaaac

SEQ ID NO: 226507 - DNA, 720 bp, Homo sapiens
  misc_feature: GYAE6OF01A14SR.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcgggagggtcgggggggggcttgggcacgaggccgaggggcggtctcgtgagactctcctgtgtagtctcgaggtattcgagttcttagtgtattatctacgttcggccgtgggtccgtcgaggccgtccgaggggtaagggtcttggagtggatcgtacgtttcgacagtaagtaggtaaacgttgtaggtaggtaaagtaaaggacgtaacgccgtacgtcgtaggtaggaaagggtaagtacgttaccgaaccgttcgtaacggaaagggtacttacggaaccttaccgaaagtaggttcggttaccggaaccttaagttttaaacaaagttggaacgtaccgtaaaccgtggaacccgaaccccggaacgtaaccgaacggtaacgggtccgttaaccgtaagtttacccgcggaccgacccgaggggtccctaaggttccccggtaggggaacccgttcggaacttcgggtacttaacgttttggaagtttcgggttaccggggg

SEQ ID NO: 226508 - DNA, 645 bp, Homo sapiens
  misc_feature: GYAE6OF01B86GG.44.56.F01.1.454.CMB.1.raw
  modified_base (605)..(605): a, c, t, g, unknown or other
  misc_feature (605)..(605): n is a, c, g, or t
tcagacagtatatacacgaccggtgctcgatttagcagacgtctgaacacacaaaaggggctgggagaggagccccagccgtgagattcccaggagtttccacttggtgatcagcactgagcacagaccaccaaccatggagtttgggctaatcttgtattttccttgtagtttttttagaaggtgtccagtgcgaggggcacgtgggcgggaggtcggggggggcttggcacgagccaggggcggtctcgtgagactctcctgtgtagtctcgaggattcagttcttagtgtattatcacgttggccgtgggtccgtcgaggcctccgaggggacgggtcttggaggttggatctacgttttcgacgagtaataggtaaacgtttagtagggtaggaaagtaaaggtaggtaaccgccggtcgtcgtaggtaggaaagggaatacgtttcgaccgttactacggaagggacttcgactaccgaagtacgttggtcgtacctaagtttaaccgaaagttcgaacgtaccctaaccgtcggaacgaaccccgacgaaccgaaccgacggtcttactagttacgcgaccgtcgaggcctacgtccgngggtacgtcgtagtcgctagtttgagttaggttcgggacg

SEQ ID NO: 226509 - DNA, 593 bp, Homo sapiens
  misc_feature: GYAE6OF01BE2W4.44.56.F01.1.454.CMB.1.raw
  modified_base (518)..(518): a, c, t, g, unknown or other
  misc_feature (518)..(518): n is a, c, g, or t
tcagacagtatatacacgaccggtgctcgatttagcagacgtctgaacacacaaagggggggagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcggggggggcttggcacagccagggcggtctctgagactctcctgtgtagtctcaggattcagtcttagtgattatcacttggcctggggtcccgtcaggctccgaggggaaggggcttggagtggatcacgtttcgtcgagaatagtaaacgttagtaggtaggaagtaaagagtacggccgcgtcgtggtaggaagggaagtattcgaccgtgtacgaagggatcgactaccaagtagtgttcggacctaattaacgaaatgacgacaactacgacgacccgacgacacgacggtctactattacngccgccgaggacctgtcccggtgggacgttcggatcgctagtttaggactttagggttcgggccgtaggggtaac

SEQ ID NO: 226510 - DNA, 762 bp, Homo sapiens
  misc_feature: GYAE6OF01B61Q8.44.56.F01.1.454.CMB.1.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaaggttgtccagtgcggaggggcgacgtgggcggagggtcggggggggcttgggcacgagccgagggcggtctctgagactctcctgtgtagtctcgaggtattcagttcttagtgattatcacttcggcctgggtcccgtcgaggctccgaggggaacgggcttggagtggatctacgtttcgacagtaatagtaaacgttgtagggtaggaaagttaaaggcggttaacggccgtacgtcgtaggtacggaaagggtaagtactttcgacccgttacgtacggtaaggggtactcggtaaacccgtaccgaaacgtaggttggtttacgggaccttaaagttttaaaccgaaagttcgggaaacgtaaccgtaaacccgttagggaaacccggtaacccccggtaaaccggtaccgtaaaccggtagggtttacctttaccgttaactttaaccggtccgtaccggtacccgaacggggtaccgtaacccggttccccggttaaggggggacccttacgggtaacttcgggtacccgtttaagtttaggtaacggtttacgggtttccggggggaaacccgg

SEQ ID NO: 226511 - DNA, 810 bp, Homo sapiens
  misc_feature: GYAE6OF01BOWGY.44.56.F01.1.454.CMB.1.raw
  modified_base (375)..(375): a, c, t, g, unknown or other
  misc_feature (375)..(375): n is a, c, g, or t
tcagacagtatatacacgaccggtgctcgatttagcagacgtctgaacacacgaaagggggggagaggagccccagccgtgagattcccaggtgttttcattcagtgatcaggactgaacacagaggactcaccatggagtttgggctgagcgtggtagttttcctaggctgtacttaagttttaaaaggtgtccagtgtggaggtgcgtaggttgggtggtagttcggtggggggtaggtttaggtaaaacggtccggtgggggacttaccccgttaaggaccgttccttccgttgtcggcacggcccttgtggtactttcctaacttttcgaacgttaaccgtccgtaggactcggacccgtcggggtccccnccgaggtccgtaccgggagggggacggggcgtgggagggttggggttcgaccggttagttaacgaaaccgaaagtcgtagggacgggtaggacgagaccgaggtactaccggctacggccgaaacccggtagaaacggctaaaggactttcccgaacctacttaccgaacgaaggtagtaacgttaacgaaacgtttaaacgaaaacggtacggtttacggtcggttaaccgttcggacgtacgtaaggtattaacgaaccggtacgtaacccgtaaaggaaacccggaccggaacgtaacgaaccgtaccggtcccgttaagttaaccgttacggttcggtacggttagggttaccgtttcgggttacgtaccggtttaccgggaccccggtaacgggttaacccggtttcgggtaaacccgtcccgttacccg

SEQ ID NO: 226512 - DNA, 753 bp, Homo sapiens
  misc_feature: GYAE6OF01BCXYZ.44.56.F01.1.454.CMB.1.raw
  modified_base (710)..(710): a, c, t, g, unknown or other
  misc_feature (710)..(710): n is a, c, g, or t
tcagacagtatatacacgaccggtgctcgatttagcagacgtctgaacacacgaaagggggggagaggagccccagccgtgagattcccaggagtttccacttggtgatcagcactgagcacagaccaccaaccatggagtttgggctaatcttgtattttccttgttagttttttagaggtgtcagtgcgaggggcgacgtgggcgggagggtcgggggggggtcttgggcacgaggccgaggggcggtcgtcgtgacgacctctccgtgtgtacgtctcgaggtacttcgagttacgtttagttcgtaatttactcgtaacgtttcggccgttcggggtcccctccggagggtcccgttacccgggaagggggtaacgggggtccgtttagggaggttaggggacttaccgttaccgtttcgtaccgtaaggtaattacggtaaaacggttggtagggtaaggtaaaggtaaagaggtaccgccggtcgttcgtaggtaggaaagggaagtacgttaccgaccgtcgtaaccgtaagggacttacgaaccttaccaaagtaggttgtaccggtaccttaagtttaacgaaacgttgacgtacctaaacccggtgaaccccggtaacccggaaccgaacgacggacggtcccgtaatttacgtacgcgaccgccgagaccggtctaccgggtggaccgtagcgttccgnttaacggtttagacgttttaggcggggaaccgtaggggtaacc

SEQ ID NO: 226513 - DNA, 800 bp, Homo sapiens
  misc_feature: GYAE6OF01EI7MU.44.56.F01.1.454.CMB.1.raw
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
  modified_base (293)..(293): a, c, t, g, unknown or other
  misc_feature (293)..(293): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttggctaatcttgatttccttgtagttttttagaggtgtccagtgcgagggcgactggcggnggtcgggggggggcttggcgacagccgagggcggtctcgtgngactctccgtgtgtagtctcaggtatccagtcttagtgtattanctacttggccttcggggtccgtcgaggtccgtacctttaagggggacgggtcgttaggtaggtaggacttaccgttaccgaatttacgggttactaggtaaaaacgtttgaaacgtttagtaagggttaagggaaaggttaaacgacggtaacggtacccgtacggttacgtaacgggtagaagggtaacgtaacgttaccgtaccggtacggtacgtaacggggaactttaccggaaaccgttccgaaaaccgttaggtaccgttaggttaacccgaaaacgtttttaccgaaaacgttacggaaaccgtacgaaacccgtaaccgggtaaacggaacccccgtaaacgaaccggaacccgtacgggtaccgttaacccgttaggttaacccgtaccggtaaccggcccgtaacgggtaccccggtaacgggtcccggttcggggaacgtttccgggaaccgtttaagttacccggtaaagtttttaacggtaagggttaaccggg

SEQ ID NO: 226514 - DNA, 678 bp, Homo sapiens
  misc_feature: GYAE6OF01ENG8M.44.56.F01.1.454.CMB.1.raw
  modified_base (632)..(632): a, c, t, g, unknown or other
  misc_feature (632)..(632): n is a, c, g, or t
  modified_base (641)..(641): a, c, t, g, unknown or other
  misc_feature (641)..(641): n is a, c, g, or t
  modified_base (646)..(646): a, c, t, g, unknown or other
  misc_feature (646)..(646): n is a, c, g, or t
  modified_base (653)..(653): a, c, t, g, unknown or other
  misc_feature (653)..(653): n is a, c, g, or t
tcagacagtatatacacgaccggtgctcgatttagcagacgtctgaacacacaaaggggggagaggagccccagccgtgagattcccaggagtttccacttggtgatcagcactgagcacagaccaccaaccatggagtttgggctaatcttgtattttccttgttagttttttagaaggtgtccagtgcgaggggcgacgtggcgggaggtcggggggggcttggcacgagccgagggcggtctctgagactctcctgtgtagtctcgaggtattcagttcttagtgatttatctactttggccttcggggtccgttcgacgggtcctacccggaaggggaacgggggtccttaggaggttgggattccgtaacgttttccggtacaaggtaacgttaggtaaaacgtttagtaggtagggtaaacgtaaaggacgtacggccgtcgtcgtggtaggaaagggagtacgttccgaccgttctaccggaagggactagaacccttaccgaaacgtaggttggttacggacccttaaagtttaacaaagttgaacgtacctaaacgtgaaccgacccgacgaacaccgacgggtactacttagtaccgtgccgtccgaggccacgttaccggnggaccgtgngtcgnttagttnagttacggttcgggacgtagggtac

SEQ ID NO: 226515 - DNA, 782 bp, Homo sapiens
  misc_feature: GYAE6OF01DDBYS.44.56.F01.1.454.CMB.1.raw
  modified_base (406)..(406): a, c, t, g, unknown or other
  misc_feature (406)..(406): n is a, c, g, or t
tcagacagtatatacacgaccggtgctcgatttagcagacgtctgaacacacaaagggggggagaggagccccagccgtgagattcccaggagtttccacttggtgatcagcactgagcacagaccaccaaccatggagtttggctaatcttgtattttcttgttagttttttagaaggtgtccagtgcggaggggcgacgtgggcgggagggtcggggggggcttgggcacgaggccgagggcggtctctgagactctcctgtgtagtctcgaggtattcagttcttagtgtattatcacttggacctgggtcctctaggctccgagggacggggtctgagtggatcctacgtttcgacagtaacgtaggtaaacgtttagtgggtacggtaaaggtaaaacggngttaaccggccggtacgttcgtggtacgggaaaggtaaggtactttccgaccggttctaacggtaaaggggtactacggaacctacccgtaaagtacggttaggttcgggaacccttaagttttaaacaaaggttcggaaacgtaccgtaaacccttacgggaacccgttaaccccggaacgtaacccgaaccggtacggggtacccgtttacgttaaacctttacggtaccggcccgtaacccgggaaccgggtacccggttaccggttacccgggttacgggggtaacccggttacgtaaccggttcgtacctttaggttttaggtaacgtttacggggttttccggggggaacccggttaagggggaaacccg

SEQ ID NO: 226516 - DNA, 864 bp, Homo sapiens
  misc_feature: GYAE6OF01B9JPZ.44.56.F01.1.454.CMB.1.raw
tcagacagtatatacacgaccggtgctcgatttagcagacgtctgaacacacgaaagggggggagaggagccccagccgtgagattcccaggagtttccacttggtgatcagcactgagcacagaccaccaacatggagtttggctaatcttgtattttccttgttagttttttagaaggtgtccagtgcgaggggcactgggcggagggtcgggggggcttggcacgagccgagggcggtctcgtgacgaccttcctccgtggttcgtacgtctcgaggtattcgaggttcttagtgtattactctacgtttggcctgggtccgtcacggtcctccggaaggggtacgggtcttaggaggttggactcgtaccgtttcgtacaaggtaacttacggtaaaacgtttgtacgggttaaggaaagtaaacggtacggtacggtcccggacggttacttagggtacgggaaaggggtacgttaaacgttacccggtaacccggttaccgtaacgggtaacggggtaacttacggtaacccttaaccggaacggtaacggtttacgggttaacgggtacccctttaaacggttttaaaaccgtaaaacgttacgggtaaacgtaccctaaaaccggtttaccggaaaccccgggtaacccccgtacgggaaaccgtaacccgggtaacgggttacccgttaacgtttaacccgtttaacggttacggaccccgtaccgaacggggttacccgtaaccgggttacccggggtaccgggttaaccgttacggtacgtacggttacccttaagggttttcgtaacggtttacggggtttccgggggtaaacggtaaccggggggtaaacg

SEQ ID NO: 226517 - DNA, 611 bp, Homo sapiens
  misc_feature: GYAE6OF01A2RCD.44.56.F01.1.454.CMB.1.raw
  modified_base (525)..(525): a, c, t, g, unknown or other
  misc_feature (525)..(525): n is a, c, g, or t
  modified_base (543)..(543): a, c, t, g, unknown or other
  misc_feature (543)..(543): n is a, c, g, or t
  modified_base (555)..(555): a, c, t, g, unknown or other
  misc_feature (555)..(555): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaggtgtcagtgcgaggggcgacgtggcgggaggggtcgggggggggcttgggcgacgacggccgaggggccggtctcgtgacgtacctcctccgtgtgtacgtctcgaggtattcagttcttagtgtattatctacgttggccgtgggtcccgtcgaggcctccggaaggggtacggggtcttggaggttggacgtctacgtttcgacgagtaataggtaaacgttgtagggtaggtaagtaaaggagtaccgacggcgtacgtgtaggaagggagtacgtcgaccgtctacggaacggatcgaacctacaacgtgtgtcgacttaattaacaaagtgacgacacgngacgacccgacgacacgngtcttatacgtncgacgacgtaggaccgtgtccggtggcgtgagctctagttgattggttcgggaacg

SEQ ID NO: 226518 - DNA, 731 bp, Homo sapiens
  misc_feature: GYAE6OF01CVLP7.44.56.F01.1.454.CMB.1.raw
tcagacagtatatacacgaccggtgctcgatttagcagacgtctgaacacacgaaagggggggagaggagccccagccgtgagattcccaggagtttccacttggtgatcagcactgagcacagaccaccaacatggagtttggctaatcttgtatttttccttgttagtttttttagaaggtgtccagtgcggaggggcgacgtgggcgggagggtcggggggggggcttgggcacgaggccgaggggcggtctcgtgagactctcctgtgtagtctcgaggtattcgagttcttaggtgtaatttactctacgtttcgggccgtggggtcccgtcgacgggtcctacccggaaggggggtaacgggggtcttgggaggttcgggaacttccgtaaccgtttttcgaacgtaggtaaattaggtaaaacgtttgtagggttaaggaaaagttaaaacggaggtaaccggcggtaccgtcgttaggagggtaaaggagtactttccgaccgttgtacggaaggactcgaacctaccgaagtgttcggtacgtacctaatttaacgaaagtcgaactaccgtaacctcggaacgaaccccgagaaccaacggtcggtaccgttactacgttacgcggaccgcccgtagggcctagtacccggtgggtacggttagcgtacggtacttagtttcggtacgtttagggttacgggggcccgtaagggggtaaac

SEQ ID NO: 226519 - DNA, 895 bp, Homo sapiens
  misc_feature: GYAE6OF01CJIKT.44.56.F01.1.454.CMB.1.raw
tcagacagtatatacacgaccggtgctcgatttagcagacgtctgaacacacaaaggggctgggagaggagccccagccgtgagattcccaggagtttccacttggtgatcagcactgagcacacgaccaccaacagtggtagttggctaatcttgtatttcttgttagtttttagagtgtcagtgcgagggcgacgtggcggagggtcgggggggggctggcgacgagccgagggcgtctcgtgagtacgtccgtcgtggtgtagtctcgtaggtattcgagttcttaggtgtattatctacgttcggccgttgggtccgtcgacggtcctaccggagggagggtcttggagtacggtacttcgtaccgtttcgtacgaagtaacgttaagtaaacggtttaggttagggtaacgggtaaaaggttaaacggaacggttaaccggtaccggtacgtttaccggttagggtaagggtaaacggggttaaacgtaactttacccggtaaccggttcgtaaaccggaaacgggggttacttacgggtaaaccccttaaccgggaaaccgttaggggttttaccggtttagggaacccccttttaaaggttttaaaaccgaaagtttaccggggaaacccgttaacccctaaaacccggggtaccggtaaaaccccggtaaaccccgggtaaaccggtaaaccccgtaacgggttaccgggttaaacccgttttaaccgttaaaccgtttccccggttaacggtcccggaaaccccgtacgggtaacccggtttaccccgtacccggggtcgggggtttaaaccgtacccgtacggtttacgtcccggttaaaggtttttccggaaaggtttacgggttttcccggggggaaaccggg

SEQ ID NO: 226520 - DNA, 227 bp, Homo sapiens
  misc_feature: GYAE6OF01ASIJE.44.56.F01.1.454.CMB.1.raw
  modified_base (215)..(227): a, c, t, g, unknown or other
  misc_feature (215)..(227): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctgggggcacagcggccctgggctgcctggtcaaggactacttcctcgatcgcgtctgagcgggctggccaaggcgcatagnnnnnnnnnnnnn

SEQ ID NO: 226521 - DNA, 789 bp, Homo sapiens
  misc_feature: GYAE6OF01B6QQT.44.56.F01.1.454.CMB.1.raw
  modified_base (195)..(195): a, c, t, g, unknown or other
  misc_feature (195)..(195): n is a, c, g, or t
tcagacagtatatacacgaccggtgctcgatttagcagacgtctgtcggcgggggggattcccagctgtttctgcttgctgatcaggactgcacacagagaactcaccatggagtttgggctgagctgggttttccttgttgctattttaaaggtgtccagtgtgaggtgcaggtgagtggaagtttgggggacnccgtaggttccgggccgggggccctaagactctcctgtctcgtctctcgaaccctacttagcagtctacgtggatcgaccacgtcgggtccgacaacgcctaccgaggaacgggtcctagtagtggtcgggtctaccgtaacgttacttaaaccgaccggtagtacggggtactacgtccgtacggttacgggtttaacctacggaacgggtacccggtacccgggtaggaaccggggtacccgttaagttacccgtataccgtaacgtccgtaacccgaagtaacgtaactaacggttacggtaaaccggaaaaccggttacggttaacggttaaactttaaacgaaacgttaagaaaccgtaacggttaacgtaaaggtaacggtacgggtaacggtaccgtacggtccgttacgtaacgttacgttagttaggttagtacgtaacgttaccgtttaagtgttactttacggacgggtttaggggttagtttcgttaccggttacgggtaccctacggtaccggtacggggtaccggtacgggttacccgttcggtaccgttccgttaccgtacccgtcgtccgttaccccg

SEQ ID NO: 226522 - DNA, 670 bp, Homo sapiens
  misc_feature: GYAE6OF01EYSUR.44.56.F01.1.454.CMB.1.raw
  modified_base (276)..(276): a, c, t, g, unknown or other
  misc_feature (276)..(276): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaaggtgtccagtgcggagggcgacgtggcgggagggtcggggggggcttggcacgagccgagggcgtctctgagacctctcctgtgtagtctgaggtnttcagttcttagtgtattatctacgtttggccgttgggtcccgtgacggcttccggaggggtagggtcttggagtggattcgtacgtttcgacaagtaagtagtaaacgttagtagggtaggaaaagtaaggagtaccgcgtcgtcgtaggtaggaaacgggtagtacgttacgtaaccgtactacggaaaggtgtacgtaaccgtaccaaacggttaggttcggttacggtaccttaaagtttaaaccgaaagtcggaactaccgaaccgtacggaacgtaaccccgacggaaccacgtacggtcttacctattaccgcgacccgaccacgggcgtctaccggcgggaccgtcgaagttcgtacgtagttttagagtttggttcggggaaccg

SEQ ID NO: 226523 - DNA, 834 bp, Homo sapiens
  misc_feature: GYAE6OF01CHUDU.44.56.F01.1.454.CMB.1.raw
tcagacagtatatacacgaccggtgctcgatttagcagacgtctgtcggcggggggattcccagctgtttctgcttgctgatcaggactgcacacagagaactcaccatggtagttgggctgagtcgttgggttttccttgttgtacttaattttaaaaggtgtccagtgtgaggtgacaggtgagtggtaagtttggggacgtccgtagggttccgggacccggggggtaccctaagacgtctccgtgtctcgtctctacgaaccctacttagcagtactacgtggtatcgcacgtcgggtccactaagctaccgaaggaacggctgagtggtcggtctacgtacgtactaaccgaccggatacgggtactacgtactacgttacgttaccgtcgaacgaccggtaccggtaggaacggggtacctaagttaccagtacacgtactaccgaagtaacgaactaagtaacgtaaccgaaaacggttacgtaacttaaacgttaaacgtaaataacggtaaacgtaacgttaacgtaaacggtaacggtaacgggaacgggtaaccgtaaccgggttacttacggttacttaacgtttacggttaggttaacggtacgtaaccgttaaaccgtttaagtttacggttaaccgttttacgggtacggggtttaggggttaaaccgtttacggtttaccgggttaacccgggtaccccggtaaaccggtccggggttaacccggggtaacccggttaaacggggttaacccggtttaccgggttacccggttacccgtttaccggtaaccctttccggacccgtttaaacccccggg

SEQ ID NO: 226524 - DNA, 773 bp, Homo sapiens
  misc_feature: GYAE6OF01B6VH2.44.56.F01.1.454.CMB.1.raw
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
tcagacagtatatacacgaccggtgctcgatttagcagacgtctgaacacacaaaggggctgggagaggagccccagccgtgagattcccaggtagtttccacttggtgatcagcactgagcacacgaccaccaaccagtggtagtttgggctaattcttgtactttttcttgtttagttttttagaaggttgtccaggtgcggaggggcgtacgtgggcgggaggggtcggggggggnttgggcacgnggccgagggcgtctcgtgagtactcgtcgtggtcgtacgtcgtcgaggtactttcgagttcttagtcgtaattctctacgttcggccgttacgggtccgtacgtacggtccgtaccggaagggggtaacggtcgttacggtaggtcggtacttccgtacgttttcgaacgaaggtaattaacggtaaacgtttaggtaagggtaggtaaagtaagacggtacggccgttaggtacgttagggaaggtaaagggtaactacgttaccgtaaccgtcgttaacggaaggtactacgtaaccgtaacgtaaggttacgtacggttacggaacctttaaagttaacgtaacgtaggtaaccgtaactaacccgtaggaaaccgtaaccccggaagaaccgtacggtacggtaacgttactttacgtcggacggtcccgaaacgtcgggaccgtaccggttaccggacgggtcgttacggtcgacgttacgtttgttaaaggtacggtttagggtccggggtaaacggg

SEQ ID NO: 226525 - DNA, 886 bp, Homo sapiens
  misc_feature: GYAE6OF01A635G.44.56.F01.1.454.CMB.1.raw
  modified_base (670)..(670): a, c, t, g, unknown or other
  misc_feature (670)..(670): n is a, c, g, or t
tcagacagtatatacacgaccggtgctcgatttagcagacgtctgtcggcggggggggattcccagctgtttctgcttgctgatcaggactgcacacagagaactcaccactaggtaggttagggttcggctaggcgttcggggtttttccggttttcgttggtcgtaactttttaaaaaggtttaagggtcctacgtaggttggtaggtggtccaaggtggtatagggtaaggtttaggggggttaccgggacccttcggtttaccggggtccccgggggggggacccccgggttaacctaacgtccttcccgttcggtcgtccgttccgtcctacgaacccgaccctttacgtcgagcgtacttggagtcgcaccgtggggttcccggccaacgacgtcccaacgggaaaggggcctgagtgtgggtctcacgtattaacaccgagtgggtactactcacgtacggtttactaccaggacgccgggtacggtaaaggggacccgtactttacgtaactacacttacctaccccgaaggaaggaacctaaagttcggttaccgggaaaaaaccgtaaccggttaggttaacttttaaccaaaatacggtaaacgtaaacgttaacggtttaaacggaaacggtccgggtaacgggaacggtaaccccgngttcgttaactacctttaagtttaggtcggttagtaacggtaacccttttagttagtacttttacggttaccggttaggggggttaggtttaactttaccgggtttccggggacccccttaaccgaaaggggttcccgggggtacccgtaaaccggggttacccggtttaccggttccgggttccccgttaacttccccttacgccggttaccccg

SEQ ID NO: 226526 - DNA, 783 bp, Homo sapiens
  misc_feature: GYAE6OF01CJRG6.44.56.F01.1.454.CMB.1.raw
tcagacagtatatacacgaccggtgctcgatttagcagacgtctgtcggcgggggccccagccctgggattcccagctgtttctgcttgctgatcaggactgcacacagagaactcaccatggagtttggctgagcgtggtctttccgttgttgtcttaagttttaaaaggtgtcctagtgtgaggtgcgaggtgtagtgggtagttggggactcgtggtcgggccgggggtaccctaagctctcgtgtctcgtctctacgaaccctacgttacgcgtagtacctacgtaggtatcgaccgtacggttccggggtacccgaccgaacggtccgtaccgggaaacgggtaacgggtcctaggtacgttggttcggtactacgtaacggttaactaaccgacgtagtacggactatacgtacgttcggtaactcgaacggtacggccggtaaggaacggccgtatacactacgtactccgaacgaagtactaacgtagtaacggtaaccggtaaaacgtgggttaactttaaagttaaacgaaaaccgttgaaacgtaacggttaacgaaacggttacggaacggtaacggactaaccgggtagttccgtaactttagtacggttggttacggtaaaccgttacgttaaccgttagtacggttaacgttttaccgggaaacgggttttcgggggtaactttcgggttacccggtcgggaacccctaacgggtacgggtacccggggtaccgttaagggggttaccgtttcgggtcccgttacccg

SEQ ID NO: 226527 - DNA, 822 bp, Homo sapiens
  misc_feature: GYAE6OF01AXLT5.44.56.F01.1.454.CMB.1.raw
tcagacagtatatacacgaccggtgctcgatttagcagacgtctgtcggcggggggggattcccagctgtttctgcttgctgatcaggactgcacacagagaactcaccatggtagtttgggctgagtcgttgggttttccttgttgcttaattttaaaaggtgtccagtgtgaggtgcgaggtgagtgggtaagtttcggggggactccgttaggttccggggccggggggacccctaagctctcctgtctcgtctctacgaaccctctttagcagtctacgtggactgctaccgtcgggtcccaccaagcctacgaacgggaacggtcctggagtcggtcggtctaccgtaacgttacgtaaccgaccgtagtacgggtaacttacgtacgtaaccgttggttaacctcgaacgggaccggttcccggtaaagggaaacccgggtccgttaactttacctaacgttccctaacgttacccgaaccgaaagtaacggtaactaacggtaccgggttaaaacggaaaccgttaagggtttaattaaactttaaacgaaacgttaagtaaacctaaggtaacgtaaaggtacgtacgggaaggtaaccgtaccggtctttaacgtaccttaacgttagtttcggtaggttacaacgttaccttaaggttccttagtttcccggtaagggtttggggtaacgtttcgggttacccggttcgggaaccccgtaggttacccggggtacggggtacccgtaaacgggtttacgggttcccggttccggttaccgttacccccttacgtcccgtccgtaacccccgg

SEQ ID NO: 226528 - DNA, 845 bp, Homo sapiens
  misc_feature: GYAE6OF01D6ZG5.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagacccaccaaccatggtagtttggctaatcttgtattttcttgttagttttttagagtgtcagtgcggagggcgacgtggcggagggtcggggggggtcttcggcgacgagccgacgggcggtctcgtgagtactcgtcctgtgtagtctacgtaggtacttgtagttacttagtagtattactctagttcggtccggttcgggtccgtcgacggtccgtaccggagggggaacgggtcggttaggacggtaggtacttcgttaccgtttcggtacgtaagtaaagttaacgtaaacggtttaaggttggggtaaacggtaaaaggtaaaacgtaacgggttaaccggacccgggtacggttacgttaagggtaacgggaaacggggttaaacgtactttaccggacccggttaacgtaacgggaaagggttaatcggtaaccctaaccgaaaggttaggttcgggtttaacggaccctttaaaagttttaacgaaaggttacggaactacccgtaaacgggtacaaacccgggacccccgtaaaagtaccggaaacgttaccggggtacttttaacgttaaccgtttccgccggggtaccccgaacccgtacggggtacccgtagttaccccggggttcgggggaaaccctttccggaagtttccggtaacttttaagttttcggtaaaagggttcccgggtttaaaccgggggggg

SEQ ID NO: 226529 - DNA, 895 bp, Homo sapiens
  misc_feature: GYAE6OF01ETMD9.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagaccaccaaccatggagttgggctaatcttgtattttcttgttagttttttagaggtgtcagtgcgagggcgacgtggcggagggtcgggggggggtctggcgacgaggccgagggcggtctcgtgagacctctccgtggtgtagtctacgaggtacttcgtagttcgtttaagttcgtaatttacttaccgttacgtttcgggtcccgtttcggggtcccgttaccggacgggtcccgttacccgggaaggggggtaaacgggggtccttttagggacggttagggtactttccgttaaccgtttttcggaccgtaaggtaaagttaggtaaaacgttttacggtaggggttaacgggtaaaaaggttaaaacgggtaacggttaaccgggtacccggttaccggttacgttagggtaagggtaaaacggggtaacggtaacgtttcccgaaacccggtttaccgtaacgggtaaaggggtacttacggaaaccgttaacccgaaacggttacggtttacggggtttaccggaacctttaaagtttttaaacgaaaggttcggaaccgtaccgtaaaccggtacggaaaccgtacccccggaaccgaaaccggtacggtaaacgggtccgtttaacctttaacgtccggtaccggccggacccgtacggggtacccgtaacccgttccgggttacggggaaccgtacggttagtaccgggtactttaaaggttttccggttaaaggttttcggggtaacccgggggg

SEQ ID NO: 226530 - DNA, 717 bp, Homo sapiens
  misc_feature: GYAE6OF01E0LAL.44.56.F01.1.454.CMB.1.raw
  modified_base (295)..(296): a, c, t, g, unknown or other
  misc_feature (295)..(296): n is a, c, g, or t
  modified_base (380)..(380): a, c, t, g, unknown or other
  misc_feature (380)..(380): n is a, c, g, or t
  modified_base (582)..(583): a, c, t, g, unknown or other
  misc_feature (582)..(583): n is a, c, g, or t
  modified_base (663)..(663): a, c, t, g, unknown or other
  misc_feature (663)..(663): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccagtggtaggtttcgggactaattcttagtacttttccttgtttagtttttagtaggtgtcgagtggcggagggcgacgtaggcggggaggtcgggggggtcgttggacgacgacggccgacgggtcggtcgtacgtcgacgtaccgtccgttccggnnttacggttacggttacgtacgtacgtacgtacgttacgttacgttcgttacgttacgtacgttaccgttaccgtacgttaccanggggtccgttactctttcggttcccgtacggggtaacggggtacgttacggtacggtacggtacgtacgtacgttacgtacgtacgtaacgtacgtaacgttaagtaggtaggtaacgtaaggtacggtacggtaacggacgtacgtacgtacggtacggtacgtacgtacgtacgtacgtacgtacgtacgtacgtaacgnngttcgtacggaccgtacgttacgtaacgttaggtacgaacttaaccgtagtacgaaccgacgaactacgacgaccgacgnacgtacgtacggtcgtaccgtacggtacgtacgtacgacggacgtcgtagtacg

SEQ ID NO: 226531 - DNA, 727 bp, Homo sapiens
  misc_feature: GYAE6OF01C6AHX.44.56.F01.1.454.CMB.1.raw
  modified_base (285)..(285): a, c, t, g, unknown or other
  misc_feature (285)..(285): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgtattttcttgttagttttttagaggtgtccagtgcgaggggcgacgtgggcgggagggtcgggggggggcttgggcacgacgccgaggggcggtctcgtgacgactctccgtgtgtagtctcgaaggtnttcagttcttagtgtattactcacgttggcctgggtcctgacggctccgaggggagggcttggagtggatctactttcgcgtaagtaagtaagtaacgtttagtgggtaaggaaagttaaaggtacgtaaccggcgtcgtcgtggtaggaaaggtaagacgtttccgaccgttcgtaccggaagggtactcggtacctaccgaaagtgttaggttcgaaccttagttttaaaccgaagtgaacgaccctaaacgtcggaaacccgacccggaacgaacctacgggacggtcccgtttaactacgttaccgtacggccgtacccggagggtaccgtaacccgtttccggggtacggggttaaacccggttcgggtaacgttcggttaaccgttagttttacggtaaacggttttgggggttttaacccggggggaaacccggg

SEQ ID NO: 226532 - DNA, 670 bp, Homo sapiens
  misc_feature: GYAE6OF01BZSKF.44.56.F01.1.454.CMB.1.raw
  modified_base (451)..(451): a, c, t, g, unknown or other
  misc_feature (451)..(451): n is a, c, g, or t
  modified_base (478)..(478): a, c, t, g, unknown or other
  misc_feature (478)..(478): n is a, c, g, or t
  modified_base (588)..(588): a, c, t, g, unknown or other
  misc_feature (588)..(588): n is a, c, g, or t
tcagacagtatatacacgaccggtgctcgatttagcagacgtctgaacacacaaagggggctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggaggtcggggggggggcttgggcacgagccgagggcggtctgtgagactctcctgtgtagtctcgaggtattctagttcttagtgtattatctacgttggtccgttgggtcccgtcgacgggcctcccggaagggggaacggggtcgttaggacggtagggactcgtaccgttttcgacctaaggtaatacggtaaacgttagtgggtaggtaaagtaaaggagtaccgcgtcgtcgngtaggaagggaagtactactaccggtntacggaagggcttacgaccttaccgaagtaggttgtcgaccttaattaaacaagtcgataccaacgtgaacccgtaacccgacgcaacgacggttccgtataagttccgnggccggtaccaagggccgtaacgtcccggaggggtcccttagacgttcgtattcgtttagacgtttggggttcggggaaccg

SEQ ID NO: 226533 - DNA, 660 bp, Homo sapiens
  misc_feature: GYAE6OF01EVZ9P.44.56.F01.1.454.CMB.1.raw
  modified_base (413)..(413): a, c, t, g, unknown or other
  misc_feature (413)..(413): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgattttccttgttagttttttagaaggtgtccagtgcggaggggcgacgtggcggaggtcgggggggggcttggcacgagccgagggcggtctcgtgagctctcctgtgtagtctcaggattcagtcttagtgatttatctacgttggccttggggtccctcgacgggtcctccggaggggaacggggtcttggaggtggattctacttttcgcaagatagtaaacgttagtggtagaagtaaagagtacgccgngtactggtaggaaggtaagattccgaccgtctacgaagggtactaggaactaccaagtaggttggttacggaccttaagttttaacgaaagtttcggaacgacctaaaccgtggaaccgaaccccgagaaccacgacggtacgtacttagtaccgtcgacccgtaccgaaggtcccgtagtcccggtggggacccgttacgaacgttcgggtacttaaggttttcggaagtttgggtttaccggggg

SEQ ID NO: 226534 - DNA, 862 bp, Homo sapiens
  misc_feature: GYAE6OF01D0DBK.44.56.F01.1.454.CMB.1.raw
tcagacagtatatacacgaccggtgctcgatttagcagacgtctgtcggcggggggggattcccagctgtttctgcttgctgatcaggactgcacacagagaactcaccatggagtttgggctgagtcgttgggttttccttgttgtacttaagttttaaaaggtgtccagtgtgaggtgcgaggtgagtggtaagtttgggggacgtccgtacggttccggggcccggggggtaccctaagaccgtctccgtgtctcgtctcgtacgaaccctacgttagcagctacgtggatgccacgtcgggtacccgaccgtaacgccgtaccggaaagggaaacgggtccgtaggacgttggggttacgggtaccgtaccgtaaccgggtttaacttaaaccgacccgggtaaggtacggggtaacctactaccgtaacgttacgggtttacctacggaacggtaccggaccgggttaacgggaaccgggtaccgttaagttacctaagtaccgtaacttccgtaccgaagaacgtaactaagtaacgtaaccgaaagtcggttaattaaattaacgtaaagtacgaaacgtaacgttacgtaaacggtacggacgtaacggaaccgtacggtacttagtaccgtttaattacgttggttagtacggttaacgttaccgttaagtttacgtttacgttttacggttagggtttacgggggtttaacgtttacgggtttcccgggttaccgggtaacccgttaacggttaccggggtacggggtaacccccggttaagggttaaccccggtttcgggtttacccggtttacccgtacccgtttacccgttacgtaccggttaaccccg

SEQ ID NO: 226535 - DNA, 727 bp, Homo sapiens
  misc_feature: GYAE6OF01DOO4E.44.56.F01.1.454.CMB.1.raw
  modified_base (538)..(538): a, c, t, g, unknown or other
  misc_feature (538)..(538): n is a, c, g, or t
  modified_base (687)..(687): a, c, t, g, unknown or other
  misc_feature (687)..(687): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccagtggagtttggctaatcttgtattttcttgttagtttttagaggtgtcagtgcggagggcgacgtgggcgggaggggtcggggggggtcttgggcacgacggccgagggtcggtctcgtgacgtctcctccgtgtcgtgtcgtcgaggtattcgagttcgttagtgtacttatcgtacgttcggccgttcggggtccgtacgaggtccgttaccgggaagggggtaacggggtcttaggagggtgtactaccgttacgtttacggtactaagtaagttacggtaaacgtttaggtacggggttaaaggtaaaggttaaaggaacggtaaccgggtccggtggttacgtaggtaagggtaaacggtaacgttacgttaccgaccgtttacgaacggaagggtntaccggacctaacgaacgtgtcggttacgaacttattaacgaagtcgacgtacctaaaccggtgaacccgtaacccgcgaaaccgcgtaaccggtcttaacgttacaccggtcgaccggtccgaagggtccgtaccgttggaccgggtntaccgagtctagttattagtaggttggttcggggaaccgg

SEQ ID NO: 226536 - DNA, 254 bp, Homo sapiens
  misc_feature: GYAE6OF01DCINM.44.56.F01.1.454.CMB.1.raw
  modified_base (214)..(254): a, c, t, g, unknown or other
  misc_feature (214)..(254): n is a, c, g, or t
tcagacagtatatacacgaccggtgctcgatttagcagacgtctgaacacgacaaagggaccacggtcaccgtctcctcagcttccaccaagggcccatcggtcttcccctggcgccctgctccaggagcacctctggggcacagcggccctgggctgcctggtcaaggctacttccacgtctactgctgagcgggctggcaaggcgcatagannnnnnnnnnnnnnnnnnnnnnnnnnnnnnnnnnnnnnnnn

SEQ ID NO: 226537 - DNA, 723 bp, Homo sapiens
  misc_feature: GYAE6OF01AHL92.44.56.F01.1.454.CMB.1.raw
  modified_base (682)..(682): a, c, t, g, unknown or other
  misc_feature (682)..(682): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgtattttccttgttagttttttagaggtgtccagtgcggaggggcgacgtgggcgggaggggtcgggggggggtcttgggcacgaggccgaggggccggtctcgtgagacctctccgtgtgtacgtctcgaggtattcagttcttagtgtattactctacgtttcggccgttcggggtcccgtcggacggtccgttcccggaaggggggtaacggggtctttagggaaggttgggaacttccgtacgttttcggacgtaagtaagttacggtaaaacggtttagtggggttaaggaaaggttaaagtacggtaccgccggtcgttacgtagggttaggaagggtaagttacgttaccggacccggttctaaggaacggggtattaccggaaccctaccgaaagtggtttccgttacgggacctttaaagtttaaccaagttgaaccgtacctaacgtcgaaccgtaaccccgagacctaccggtggtaccttacgtacttacgcgccgaccgaggtcgccgttcggngggtctgactcggtacttaggttgacgttgggtcgggacgg

SEQ ID NO: 226538 - DNA, 783 bp, Homo sapiens
  misc_feature: GYAE6OF01BH0K9.44.56.F01.1.454.CMB.1.raw
tcagacagtatatacacgaccggtgctcgatttagcagacgtctgaacacacaaagggctggagaggagcccagccgtgagattcccaggagtttccacttggtgatcgagcactgagcacagaccaccaaccatggtagttggctaatcttgtatttccttgttagtttttagaaggtgtccagtgcggagggcgacgtggcggagggtcgggggggcttgggccgacgacggccgagggcgtcgtcgtgacgtacctctccgtgtcgtacgtcgtcgtagtacttacgtagttcgttaggtagtaatttacgtacgtacgttcggtccgttcgggtccgtacgtacggtaccgtaccggaggggtacggtcgttaggacggtgtacgttaccgttacgtttcgaagtaagtaagttaacgtaaacgttgtaggtaaggtaaagtaacggacggtaccgcgtagtcgtagaggaaaggtacgtacgtaccgtaccgtacgaacggaaggtacgtacgtaaccgtaaccgtaacgtacggtttcggtacgtaacctttaaagtttaaaccgaaagttacgaaccgtaaccgtaaaccgtacggaaccccgtaacccggaacgaacccggtaaccgtacgggttacccgttaacgttaacgttacccggtaccgccggtaaccgtacggtacccgtacggtacccgggtaccgggtcccgtaggttacgtccgttaacgttaacggttttacggtaacggtttacggggttacccggggaaacg

SEQ ID NO: 226539 - DNA, 785 bp, Homo sapiens
  misc_feature: GYAE6OF01A98SG.44.56.F01.1.454.CMB.1.raw
  modified_base (362)..(362): a, c, t, g, unknown or other
  misc_feature (362)..(362): n is a, c, g, or t
  modified_base (461)..(461): a, c, t, g, unknown or other
  misc_feature (461)..(461): n is a, c, g, or t
tcagacagtatatacacgaccggtgctcgatttagcagacgtctgtcggcgggggccccagccctgggattcccagcttgtttctgcttgctgatcaggactgcacacagagaactcaccagtggtagtttgggctgagtcggttggtttcgttgtagtacttaagtttaaaggtgtcagtgtgaggtgcgtaggtgtagtagggtaaggttcgggggaccgtccggttacggggttccggggccccggggggtacccctaaggtccttccttccttcgttccgttccgttcctaccgttaccgtaaccccttaccgtttacgaccacgtctacgtggagtcgaccgtcggtcgggtacccncgtaacgtccgtacggaagggaacggtcgtggtaggtcggtcggtactaactacgttaactaacgacggagtacggtacctactcgtacgttacgtacncgtacgacgcgtaggacggcttatcgactcactactacgagtagacgtagtacgtaacgtaaacgtaagttattaactaaacgtaagtaacgtaactaagtagtaagaacgacggacgacgtacgtacgtacgtacttacttagttgttagtagttacgttacgttacgttagtttacgttacggttacgggttagggtttacggtttaccggtttacggttcgtaccggtacccggtaccgggtaccgggtaccgggtaaccgggttaccgggtttaccggccggtttttttttttttttttttttttttttttttccgtccg

SEQ ID NO: 226540 - DNA, 836 bp, Homo sapiens
  misc_feature: GYAE6OF01A5IEU.44.56.F01.1.454.CMB.1.raw
tcagacagtatatacacgaccggtgctcgatttagcagacgtctgaacacacaaagggggggagaggagccccagccgtgagattcccaggagtttccacttggtgatcagcactgagcacacgaccaccaaccatggagtttgggctaatcttgtattttccttgttagttttttagagtgtccagtgcggaggggcgacgtgggcgggagggtcgggggggggcttggcacgacggcccgaggggccggtctcgtggacgactcctcctgtgtacgtctcgaggattcgagttcgtttagtgtatttacgtcctacgtttcgggtccgttacggggtccccgttgacgggtcccttaccgggagggggtaacgggggtctttagggaaggtggtaacttccgtacgttttccgtacgtaaggtaaagtacggtaaaacggttttggagggttaacggggtaaaaggttaaacggtacggttaacccggcccggtacggttacggtagggtaacgggaaaacgggtaacgttacgttcccggtaaccggttacggtacggaaaaggggtcttaacggaaccccttacccgtaaaacggtacggtttcgggtttacccgtaaccctttaagttttaaacccgaaaagttcgaaacgacctaacccgtagggaaacccgtacccgaacgaactaccggacgggtccttacgttaagttaccgcgaaccggtcccgaagggtccgtaacgtccgggttacggaccggttacgacgttccgacgtttagttacgggttaagtttaccgggtttcggggggaacccgtaaggggtaaacc

SEQ ID NO: 226541 - DNA, 719 bp, Homo sapiens
  misc_feature: GYAE6OF01DOTXW.44.56.F01.1.454.CMB.1.raw
  modified_base (658)..(658): a, c, t, g, unknown or other
  misc_feature (658)..(658): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaaccaaccatggagtttgggctaatcttgtacttttccttgttagttttttagaaggtgtccagtgcggaggggtcgacgtgggcggagggtcgggggggggcttggcacgaggccaggggcgtctcgtgagacctcgtcctggtgtacgtcttacgaggtaattccgaagttcttagtagtatttagtctaagttcggccttaggggtcccgtgacgggccgtcccggggtaagggtcttaggaggtggacttcctaacgtttcgtacgagtaataggtaaacgttagtgggtagaaacgtaaaggacgtaccggcggtacgttcggtagtaggaaaacggggtaactacgttacgaaccggttacgtaccggtaaaagggggctaaggacccctaccgtaaacgagtttcggttaggacctaatttaacaagtcggaactaccgaacctaggaaccgaccccggtaacacgacgacggtctacgtattacggtcgaccgtcccgaggtaccggacttacccgggngggtaaccgttacgaagttacggacttaacggttaggtaatttccgggttgggaacccggg

SEQ ID NO: 226542 - DNA, 858 bp, Homo sapiens
  misc_feature: GYAE6OF01CKY0V.44.56.F01.1.454.CMB.1.raw
tcagacagtatatacacgaccggtgctcgatttagcagacgtctgaacacacaaaggggctgggagaggagccccagccgtgagattcccaggagtttccacttggtgatcagcactgagcacagaccaccaaccagtggtagtttgggctaatcttgtattttccttgttagttttttagaggtgtccagtgcggaggggcgacgtgggcggagggtcgggggggggcttggcacgagccgagggcgtctcgtgagctctccgtgtgtgtctcgaggtattcagttcttaggtgtactttatcgtacgttcgggtcccgttaggggttcccgtacggacgggtccgttacccgggtaaggggggaacggggtccttttagggaacggttgggtaacttacccgtttaacccgttttccggtaccgtaaagggtaaacgttaacggttaaaacggtttaaggttacgggggtaaagggtaaaaacgggttaaaacggtaacgggttacccggacccggttacgggttaccgttagggttaaggggtaaacggggtaaacgttaacggtttacccgaacccgggtttacgtaacccggaaagggggtaacgttacccggtaaccttacccgaaacgttaagggtttcggtttacgggtaaccctttaaggtttaaaccgaaacgttacgaaccgtaccgtaaacccgtggaaacccgtacccccgaaggaacctacgacggtcccgttaactacgttacgcggtacccggaccgtacggaccgtaccgttccgggtacgggtaccgtccggtattcggacctttaggttaggtaagtttcgggttaacgggggacccgg

SEQ ID NO: 226543 - DNA, 688 bp, Homo sapiens
  misc_feature: GYAE6OF01DJ04Q.44.56.F01.1.454.CMB.1.raw
  modified_base (601)..(601): a, c, t, g, unknown or other
  misc_feature (601)..(601): n is a, c, g, or t
tcagacagtatatacacgaccggtgctcgatttagcagacgtctgaacacacgaaagggggggagaggagccccagccgtgagattcccaggagtttccacttggtgatcagcactgagcacagaccaccaaccatggagtttggctaatcttgtattttcttgttagtttttagagtgtccagtgcgagggcacgtgggcggagggtcggggggggcttggcacgagccgagggcggtctcgtgagactcctctgttgtagtcctcgaggtattcgagtcttagtgtattatctacgttggccttgggtccctgacggtctaccgaaggggacgggtcttaggaggtggtactcgtacgtttcgtacgaagtaaagttggtaaaacgtttgtaggttaagggaaaacggttaaaggacggttaacccggccgtacgttcgttagggtagaaaacggggtactacgttcgaacccggttgtacgaagggtactcgactaccgaactaggtcgtacggtactaatttaacgaaagttcggaacgtaacctaaccgtacgaaccggacccgtaacgaacacgtcggtacgtacttgttaccgngtccgactacggctactccgggtacggacctcggtagtcgacgtttagttggtactttacggggttacgggaccgttggggtaaacc

SEQ ID NO: 226544 - DNA, 706 bp, Homo sapiens
  misc_feature: GYAE6OF01EZ7KP.44.56.F01.1.454.CMB.1.raw
  modified_base (490)..(490): a, c, t, g, unknown or other
  misc_feature (490)..(490): n is a, c, g, or t
tcagacagtatatacacgaccggtgctcgattttagcagacgtctgtcggcgggggggattcccagctgtttctgcttgctgatcaggactgcacacaggagactcaccatggtagtttggctgagcttcgggttttcctgttgcgttagttttaaaggtgtccagtgtgaggtgcaggtgacgtggtaagtttcgggggactccgttagggttccgggcccgggggtacccctaaggcctcctccgtcgtccttccgtctcgtaccgtaaccctacctttagccagtcctacgtggatcgctacggtcgggtcccgcgaacgtcgtccgtagggaacggtcctgtacgtggtcggtcctacgtacgttataaccgcgtagtcggactagtctacggttgtactcgacggaccgtcgtagaccggtcattcatctactcctacgaaggacacgtagtaacgtaaccgtaacgtaggtacttaaacgttanaaacgttcgaacgtacgtaacgtaagtacgtacggacgtaaccgaccgtgttactcctttaacgtgttgtagtacggtaacttcgttaagtcgttacgttcggtaaggtttgggattttaccggtcgggttaccgacgtaccggtagggttacccgggacggttaaccgggttacttccgggttacgtcccgtacttccgtcgtacccgttacccg

SEQ ID NO: 226545 - DNA, 787 bp, Homo sapiens
  misc_feature: GYAE6OF01DQ9J1.44.56.F01.1.454.CMB.1.raw
  modified_base (108)..(108): a, c, t, g, unknown or other
  misc_feature (108)..(108): n is a, c, g, or t
  modified_base (124)..(124): a, c, t, g, unknown or other
  misc_feature (124)..(124): n is a, c, g, or t
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (642)..(642): a, c, t, g, unknown or other
  misc_feature (642)..(642): n is a, c, g, or t
  modified_base (652)..(652): a, c, t, g, unknown or other
  misc_feature (652)..(652): n is a, c, g, or t
tcagacagtatatacacgaccggtgctcgatttagcagacgtctgaacacacaaaggggggagaggagccccagcccgtgagacttcccaggagtttcccacttggtnatccagcactgagcanagacccaccaacactggtagttcggctaatcttgtattttcttgttagttttttacgaggtgtccagtgcgaagggcgagtggcggngggtcgggggggcttggcacngccgagggtcggtctcgtggagtacctctcctagtgtactctcgaggtattcaggttctttaggtatacgttacttactaccgtttcggtcccggttcggggttaccgtcggtacgggtcccgttacccgggaaggggggtaacggggtcttagggtagttacgggtattcccgttaacttttccggaacgaagtaaacgttggtaaaacgttgtagggtaacggaaagttaaaaggacggttaccgaccggttcggttacgttagggtaggaaaggggtaacttacgttaccgacccggttacgtaaccgggtaaggtctacggaaccctaccggtaacgttgtacgttaccggactttaagtttaaaccagttcgaacgtaaccctaacgtcggaactacccccgganaccgaacggngttaccgttactactacgtccggacctccgtaaggaccctaggtttcccggacggggtaccttgggtaaacttccggaactttaaggtttcgtaaacggttttccgggtacggggaccgtaacgggggtaaaccc

SEQ ID NO: 226546 - DNA, 722 bp, Homo sapiens
  misc_feature: GYAE6OF01AOT92.44.56.F01.1.454.CMB.1.raw
  modified_base (627)..(627): a, c, t, g, unknown or other
  misc_feature (627)..(627): n is a, c, g, or t
tcagacagtatatacacgaccggtgctcgatttagcagacgtctggtcggcgggggggattcccagctgtttctgcttgctgatcaggactgccacacagagaacctcgaccatggagtttgggctgagcttcgggttttccttgttagcttaagttttaaaaggtgtccagtagttggacggtgcaggtgatcggaagtttggggacgtccgtaggttccgggccggggggcccctaaggacctctccgtgtcctcgtctctcgaacccgtaccttagccagcctaacgtggactcgctacggttcgggcccacgtaagcctaccgaagggaaacggcctggacgttggtccggtactacgaacgttaacgtaaccgaccggtaagtcgggacttacgtacgtacgttaggttaaacctcgaacggaccggtccgggttacgaaacggtccgtaacttacaacgtcgtactacctacggaagacgtaaccgtaaacgtacggtaaccgtaaaacgtacgggtttaattaacgtttaacaaagttacgaaactaacgtacgtaaagtacggacgtaacggacacgtgtagtacgttactagttagtagtacgtacgtaccttaagtnttacgttacgtacggttggtacgtcgtcggtcgacccgtcggacggacgggtaccgaggttaccgtcggtacgttcgtacgtctacgcgtacccg

SEQ ID NO: 226547 - DNA, 713 bp, Homo sapiens
  misc_feature: GYAE6OF01BI67T.44.56.F01.1.454.CMB.1.raw
  modified_base (120)..(120): a, c, t, g, unknown or other
  misc_feature (120)..(120): n is a, c, g, or t
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (379)..(379): a, c, t, g, unknown or other
  misc_feature (379)..(379): n is a, c, g, or t
tcagacagtatatacacgaccggtgctcgatttagcagacgtctgaacacacgaaagggggggagaggagccccagccgtgagattcccaggtagtttccacttggtgatcagcactgancacagaccaccaaccatggtagttggctaatcttgtattttcttgttagtttttagagtgtcagtgcggagggcgacgtggcgggaggggtcggggggggcttggacacgacgccgagggcgtcgtntgacgactcctccgtgttgtacgttccncgaggtattcgagttcttagtgtattatcctacgttggccgtgggtccgtcgcggtccacgggaggggtacgggtcgttaggaggtggtatctacgtttcgtanagtaagtagtaaacgttagtaggtaagtaaaagtaacggtacgtaccggtccggtgttaccggtaggtaaggggtaaacggagttacgtccgtaacggttctaaggaacgggtacttccggaaccttaaccgaagtcgtttacggttccgtaactttaacgttaaacaagtagacccgtaacgtaccgacggaaccaccccgaagaacccgaggtcgtacccgtaatttacgttccgcggaccgtaccggacgcccgttaagtcccgggttcggggaaccttggtctacgttagtttagtcgttaaggttacgggtcgggacggaagggtaccc

SEQ ID NO: 226548 - DNA, 909 bp, Homo sapiens
  misc_feature: GYAE6OF01EU4FD.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaattcttgtattttccttgttagttttttagaaggtgtcagtgcggagggcgagtggcggagggtcgggggggggtcttgggcacgaggccgaggggcggtctcgtgacgtacctctccgtgtgtagtctcgagtattcgagtcttagtgattatctacgttggccgttcgggtccgtacgacggtccgtaccggaggggaacgggtcgttaggtacggtggtacttcgtaaccgttttcgtacgaaggtaacgttaggtaaaacggtttagtagggttaaggtaaaacgtaaaggtaggttacccggaccgtacggttcgttaggtaacgggtaaaaggggtaacgttacggttaacccgtacccgggtttaccttaacggggtaaacgggtacgtttaacccggtaaacccgtttaacccggtaaaacggtttagggtttaccggtttaaccggggtaaccctttaaaagtttttaaaaccggaaaactttagggaaaccgttacccaaacccggttaacgggtaaccggaaaccccccggtaaagggaaaccccgtagggtaaaccggttcccgttaacgtttaaacggttacccggtaccgggttcccgaaaccccggtacggggtaacccgtttaccgggtttaacccccgggtaaaggggggtacccgttaacgggttaaccgtttacggggttacccttttaaaagggtttttcccggaaaaggtttttcggggtttaaacccggggggg

SEQ ID NO: 226549 - DNA, 788 bp, Homo sapiens
  misc_feature: GYAE6OF01DEXUI.44.56.F01.1.454.CMB.1.raw
  modified_base (371)..(371): a, c, t, g, unknown or other
  misc_feature (371)..(371): n is a, c, g, or t
  modified_base (588)..(588): a, c, t, g, unknown or other
  misc_feature (588)..(588): n is a, c, g, or t
  modified_base (606)..(606): a, c, t, g, unknown or other
  misc_feature (606)..(606): n is a, c, g, or t
  modified_base (636)..(636): a, c, t, g, unknown or other
  misc_feature (636)..(636): n is a, c, g, or t
  modified_base (652)..(652): a, c, t, g, unknown or other
  misc_feature (652)..(652): n is a, c, g, or t
  modified_base (765)..(765): a, c, t, g, unknown or other
  misc_feature (765)..(765): n is a, c, g, or t
tcagacagtatatacacgaccggtgctcgatttagcagacgtctgaacacgacgaaaggggggagaggacgccccagccgtgagacttcccgaggtagtttccacgttggtgatcgagcactgacgacacacgaccaaccaactagtggtagttcggacttatcgttgttacttttcgttagtttaggtttttagaggtacgtccgtaggtcggacgggacgggtccgtacggtggggtccggggacggggggtcggggggggtctcgggaccacggacggccggtacgggtccgtcgtacgtaggaaccgtccttccgtacggtggttacgtacgtcgtacggtaggtcttaccgttagttacttaggtntaacttctaccgttacgtcggtaccgtcggttccgacggtacggtccggtaacgggaggggtcggtactcggaggtaccgttacttacgttacgttacggataacggtaagttaacggttaacggtggtaaacgtaagggtaacgtaaaggccgtaccggtcggttcggtagttaagggacgtaaacggtctacgtccgtacgtagtacggagtacncgtaacagtacgtacggngtaacgtataacgataacgcgactaaccgngtacgacccgtaacgngaacgtgtacccgtactttaccgagttccgacggaacctcggaacggcccgttggtacccgggtacgttcgaacgtgtaaccgtttaagttactttcgggttaaaccggggtnccgggggaaagtaacgggtaacg

SEQ ID NO: 226550 - DNA, 762 bp, Homo sapiens
  misc_feature: GYAE6OF01EVBLT.44.56.F01.1.454.CMB.1.raw
  modified_base (194)..(194): a, c, t, g, unknown or other
  misc_feature (194)..(194): n is a, c, g, or t
  modified_base (538)..(538): a, c, t, g, unknown or other
  misc_feature (538)..(538): n is a, c, g, or t
tcagacagtatatacacgaccggtgctcgattttagcagacgtctgaacacacaaaggggctgggagaggagccccagccgtgagattccccaggagtttccacttggtgatcagcactgagcacagaccaccaaccatggagtttgggctaatcttgtattttcttgttagttttttagagttgtcagtgcgngggcacgtggcggagggtcggggggggggcttgggacacgtacgccgacggggccggtctcgtggacgtacctctccgtggtgtacgtctcgtaggactttcgtacgtcttagtcgtattactacgtaccgttcggccgttacggggtcccgtacgcgggtaccgtacccgaagggggttacggggtcctttaggggaacggttggacttccgttacgttttcggacgtaagttaactaggtaaaacgtttggtaagggttaacggtaaagttaaacggacggtaaccggccgtacggttcgtagggttacggaaggtatacgtacgtactcggtacaagggtntacgacctaacacgtgttacggtacgtacgttaacttaccgaaacgttggaaaccgtacgtaccgtacggaaccccgtaaccggtaacgaaccgaaccgaccggttcccgtaagtttaccgtacgtccgacggtacccgaggtccgagtcccgggtaacggtccgttccggaattccggtatttaacggttagttaacggttttggttaaccgggggtaccggg

SEQ ID NO: 226551 - DNA, 830 bp, Homo sapiens
  misc_feature: GYAE6OF01BQJPJ.44.56.F01.1.454.CMB.1.raw
  modified_base (360)..(360): a, c, t, g, unknown or other
  misc_feature (360)..(360): n is a, c, g, or t
  modified_base (425)..(425): a, c, t, g, unknown or other
  misc_feature (425)..(425): n is a, c, g, or t
tcagacagtatatacacgaccggtgctcgatttagcagacgtctgtcggcggggggattcccagctgtttctgcttgctgatcaggctgcacacagagaactcaccagtggtagttggctgagtcgttcgggttttccttgttgtacgttaagttttaaaaggtcgtccgtagtggtgaggttgacgaggtgtagtaggtaaggtttcggggaccgtccgtagggttcccgggcccgggggtacccctaaagtccgtccgtccgtgtcgtccgttcctcgtaccgtaacccctacgttacgcgagtcctacgtcgagtcgactacggtcggtcctacgacgtccgtacggaggaacgtcnggtagtcggtcggtctacgtactaacgtaaccgaggtagtacgtactagtccgacgttacgtacncgtacgaccggtcgtaggacgtccgtatacgctacacgttccgaacgacacgtaactaaagtaccggtaaacgtaaaccgtagttaacgtaacttaaacgaaacgttaagtaaccgtaacgttaacgtaaaggtaaccggtaacggtacgtaccggtacgttacgtacggttaccttaacggttagttacggttcggtaaccgttacgtaacccgtttagttaccggttaacgtttacccgggtagggtttaacgggttacgtttcggttacccgggttaacccgggtaccccgtaacggtacccgggttaccggggaacccggttaacccgggtaacccggttttccgggtaaccccgttccccggtttaccttacccggttcccgtaccgttacccccccggg

SEQ ID NO: 226552 - DNA, 830 bp, Homo sapiens
  misc_feature: GYAE6OF01COLIH.44.56.F01.1.454.CMB.1.raw
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
  modified_base (442)..(442): a, c, t, g, unknown or other
  misc_feature (442)..(442): n is a, c, g, or t
tcagacagtatatacacgaccggtgctcgatttagcagacgtctgaacacacgaaaggggggagaggacgccccagccgtagagacttcccaggtacgtttccacttggtgatcagcactgagcacagaccaacaactatggtagtttggataattcttgtacttttcttagtttagtttttagagtntcagtgacggngggcgacgtgggcgggagggggtcgggggggtctggacgacgacggccgtaggggcgtcttcgaggactcgtcctcgtgtagtcgttacagnggttaattcgtaacgttagtttaggtatatttacgtacgtacgttccggtccggttaccgggtcctacggtacggtaccccgtggggaaagggggtaccggttgtaaggtcggttaacgggtacttacccggtttacggtttccgggtaanaaaggttaaagttaacggtaaacggttttagggaaaggttaaagggtaaaaccgttaaagggacccggttaacggtcccgtagggttttaaccgaggggttaaaggtaaacggtattaccgttaacccgacgttacgtaccggaagggtactacgtaccgtaaccaaggttaggttactaacggtaccgttaattaacgaagacgtacaccgtaacgtaggtaacccgaccgtaaacgaccgtaaccggtacgtacccgttaataccgtttaccgacgtccggtaacggaccggtacgtaccgttccgggtacggttaccgacgtaaggtccgtagtttggttaacgttaacggttagggttacccgggagggtaccgggttaaccgg

SEQ ID NO: 226553 - DNA, 922 bp, Homo sapiens
  misc_feature: GYAE6OF01CVAFD.44.56.F01.1.454.CMB.1.raw
tcagacagtatatacacgaccggtgctcgatttagcagacgtctgaacacaacgaaaggggctcgtgggagaggacgccccagccgtgagtacgttcccgaggtacgtttcctacgttggtcatcagcacgtgagcacacgaacccaccaacagtggtagttggactaactcgttagttactttttccgtttagttttaacgttttttagaaggttcgtaccgtaggttcggacggggtacggggtccgtacgggtcgggggtacggggtaacgggggggtcccggggggggtattcgggccgaaccggacgggtacccgggtagggggtcccggtttacgttaccggtacggtaaccggttcccgtttccgtttaccggtgggttaccgttacgttaccggtacggtacggttaccgtttacggttacggtttacgtttaggttacgttaatttaccggtaccggttccggttccgggttcgggtttaaccgggtccggtaccggttacgggtacccggtaccggggaaacggggttaagggtccggttaaagggtcggtaccgggtacttccggttacgttccgttaagaacgtaaggttaaaggtacggttaaggttacgggaaagttaaaggtaaacgtcgtaccggtcgtacgtacggtagtaagggaacgtacgttcgtacgtccggttaagacgtaacggtataccgacttaacgggtacgtacggttagtacgtaacctaaagttacgaacggtcccgtaacgaacctaacgtacccgaaccgtaaccgacgtaccgacgtcgtaaacccgtgtttaacgaccgtacgtcgaacggtcggtccgtaacccggttcggcggttaacccgtacgggttactttaggtacgtttaggtcgggtaaccgggtaacggg

SEQ ID NO: 226554 - DNA, 698 bp, Homo sapiens
  misc_feature: GYAE6OF01C2QW0.44.56.F01.1.454.CMB.1.raw
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (436)..(436): a, c, t, g, unknown or other
  misc_feature (436)..(436): n is a, c, g, or t
  modified_base (500)..(500): a, c, t, g, unknown or other
  misc_feature (500)..(500): n is a, c, g, or t
  modified_base (586)..(586): a, c, t, g, unknown or other
  misc_feature (586)..(586): n is a, c, g, or t
  modified_base (680)..(680): a, c, t, g, unknown or other
  misc_feature (680)..(680): n is a, c, g, or t
  modified_base (682)..(682): a, c, t, g, unknown or other
  misc_feature (682)..(682): n is a, c, g, or t
tcagacagtatatacacgaccggtgctcgatttagcagacgtctgtcggcggggggattcccagctgttctgcttgctgatcaggactgacacacagagaactcaccagtggtagttgggctgagtccgtttgggttttccttgttgtacttaagttttaaacggtcgtacctaggtgtggtaggtgagtaggtgagtagggtaggttcggggactcgtacgggtccgggcccgggggtccctaagcctctccgtgtctcgtactcctaccgtaccctacttgcctagtactagagtancgtccgtacgtcggccactacgactacggaaggaacgtcgngtagtcggtcggtactcaacgttaacgaccgacgtagtggtactacgtactagttacgtaacacggaccgtacgtacgggtacgaccgttacgtanactcgtaacgtacaccgagtagtaaagtctaaggtaacgtaactaagggttacttaacgtaaanaagtcgtaaactagtaacgaaggtacgtacgaacgtaccgtagtaccgtgtattacgtttaagtcggtaataggaccttaaggttntacgttgtacggtttagggttaggtaccgttcgttcgggacccttcgacggtcggtacggacgtaccggttacgtcggttacgccctttaccgntntcccggttccaaaccg

SEQ ID NO: 226555 - DNA, 318 bp, Homo sapiens
  misc_feature: GYAE6OF02GOMAF.44.56.F01.1.454.CMB.1.raw
  modified_base (315)..(318): a, c, t, g, unknown or other
  misc_feature (315)..(318): n is a, c, g, or t
tcagacagtatatacacgaccggtgctcgatttagcagacgtctgaacacacgaaagggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggagccagcggtcagcccaaggccaaccccactgtcactctgttcccgccctcctctatatactgtctgagcgggctggcaaggcgcatagnnnn

SEQ ID NO: 226556 - DNA, 215 bp, Homo sapiens
  misc_feature: GYAE6OF02GEP3J.44.56.F01.1.454.CMB.1.raw
  modified_base (213)..(215): a, c, t, g, unknown or other
  misc_feature (213)..(215): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 226557 - DNA, 215 bp, Homo sapiens; identical to SEQ ID NO: 226556
  misc_feature: GYAE6OF02ILB4F.44.56.F01.1.454.CMB.1.raw
  modified_base (213)..(215): a, c, t, g, unknown or other
  misc_feature (213)..(215): n is a, c, g, or t

SEQ ID NO: 226558 - DNA, 215 bp, Homo sapiens
  misc_feature: GYAE6OF02ITC2Q.44.56.F01.1.454.CMB.1.raw
  modified_base (213)..(215): a, c, t, g, unknown or other
  misc_feature (213)..(215): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnn

SEQ ID NO: 226559 - DNA, 216 bp, Homo sapiens
  misc_feature: GYAE6OF02HN646.44.56.F01.1.454.CMB.1.raw
  modified_base (213)..(216): a, c, t, g, unknown or other
  misc_feature (213)..(216): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnnn

SEQ ID NO: 226560 - DNA, 214 bp, Homo sapiens
  misc_feature: GYAE6OF02GKSAT.44.56.F01.1.454.CMB.1.raw
  modified_base (213)..(214): a, c, t, g, unknown or other
  misc_feature (213)..(214): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnn

SEQ ID NO: 226561 - DNA, 709 bp, Homo sapiens
  misc_feature: GYAE6OF02GTE27.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcgggggggggcttgggcacgaggccagggcggtctctgagactctcctgtgtagtctcaggattcagtcttagtgattatcacttggcctgggtccgtcgaggctccgaggggagggcttggagtggatcacgtttcgcagaatagaaacgttatggtaggaagtaaagagtacgccgcgtctggtaggaagggaagtattacgaccggttctacgaaaggggtatacggaacctaccgaaacgtaggttcggtttacgggacccttaaagttttaaaccgaaaagtttcggaaacgtacccgtaaaacccggttggaaacccggtaacccccgggtaacgaaacccgtaaccggaacggggtacccgttaccttaaacgtttacccgtcggacccgacccgaaggggtcccgtaacgttccccggtaggggtaacccgttcggaacgttcggaaccgttaagtttttgggaacgtttagggtttaccgggggg

SEQ ID NO: 226562 - DNA, 594 bp, Homo sapiens
  misc_feature: GYAE6OF02ILRYO.44.56.F01.1.454.CMB.1.raw
  modified_base (396)..(396): a, c, t, g, unknown or other
  misc_feature (396)..(396): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (501)..(501): a, c, t, g, unknown or other
  misc_feature (501)..(501): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcgggggggggggcttgggcgacgagccaggggcggtctcgtgagactctcctgtgtagtctcaggattcagtcttagtgattatcacttggccttgggtccgtcaggctccaggggagggcttggagtggatcgactttcgtcagaatgaaacgttagtggtaggtaagtaagagtacgcgngtctgtgaaggagattcgacgtcngaagggntgactcaacgngtgttgcctattacaatgagcaacgtgacgacccgagaacacgaggtccgtactaacgttacnggaccgtaccgagggtcctaacgttcccggtaggggtaacccgttcggacttcgggtaccttaaggttttcgacgtttaggtttaccgggggg

SEQ ID NO: 226563 - DNA, 218 bp, Homo sapiens
  misc_feature: GYAE6OF02F4JU7.44.56.F01.1.454.CMB.1.raw
  modified_base (211)..(218): a, c, t, g, unknown or other
  misc_feature (211)..(218): n is a, c, g, or t
tcagacagtatatacacgaccggtgctcgatttagcagacgtctgaacacacaaagggaccacggtcaccgtctcctcagcttccaccaagggcccacgtcttcccctcgcgccctcgctccacgagcacctctggggcgacagcggccctggctgcctggtcaaggactacttcctatatactgtctgagcgggctggcaagcgcatagnnnnnnnn

SEQ ID NO: 226564 - DNA, 536 bp, Homo sapiens
  misc_feature: GYAE6OF02JC3UK.44.56.F01.1.454.CMB.1.raw
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (479)..(479): a, c, t, g, unknown or other
  misc_feature (479)..(479): n is a, c, g, or t
tcagacagtatatacacgaccggtgctcgatttagcagacgtctgaacacacaaagggggggagaggagccccagccgtgagattcccaggagtttccacttggtgatcagcactgagcacagaccaccaaccatggagtttgggctaatcttgattttcctgtagttttttagaaggtgtccagtgcgaggggcgactggcggagtcgggggggggcttggcacagccagggcggtctctgagactctcctgtgtagtctcaggattcagtcttagtgattatcacttggcctgggtccgtcaggctccgagggaagggcttggagtggatcactttcgcagaatgaaacgttatggtaggaagtaaagngtacgcgcgtctgtgaaggganattcacgtntcgaagggatgactccaacagtgttggcctattacaaatgagcaactgacgacccgacgacacagcgtactattacngcgcaggcgactccgtgggactcgatcgactagtttgattagttgggccaggggtac

SEQ ID NO: 226565 - DNA, 262 bp, Homo sapiens
  misc_feature: GYAE6OF02HCGUB.44.56.F01.1.454.CMB.1.raw
  modified_base (222)..(262): a, c, t, g, unknown or other
  misc_feature (222)..(262): n is a, c, g, or t
tcagacagtatatacacgaccggtgctcgatttagcagacgtctgaacgacacgaaagggtaccacggtcaccgtctcctcagcttccaccaacgggcccatcggtcttcccctggcgccctgctccaggagcacctctgggggcacagcggccctgggctgcctggtcaaggactacttcctatagtactgtctgagtcgggctggcaaggcgcatagagnnnnnnnnnnnnnnnnnnnnnnnnnnnnnnnnnnnnnnnnn

SEQ ID NO: 226566 - DNA, 606 bp, Homo sapiens
  misc_feature: GYAE6OF02F9LHG.44.56.F01.1.454.CMB.1.raw
  modified_base (347)..(347): a, c, t, g, unknown or other
  misc_feature (347)..(347): n is a, c, g, or t
  modified_base (374)..(374): a, c, t, g, unknown or other
  misc_feature (374)..(374): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (451)..(451): a, c, t, g, unknown or other
  misc_feature (451)..(451): n is a, c, g, or t
tcagacagtatatacacgaccggtgctcgatttagcagacgtctgaacacacaaaggggctgggagaggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactggggtccgccaggctccgaggggaaggggctgggagtggcttgggccgnaagtaaaaacaagttgccagtctttancacagagtacgccgcgtctgtgaaagccagacttccaccctntacaagnatcgacttcaaagtactcattgatttcngcgtaatcgaacctaaccgtaaggaaaacccgaggaaccgaccggggacaagttagttatttaagtttcggttaggttttacgttagttttaatagttaccgtaagggtaaccttcggtaccccgacggttacggggggacccctaaaccggggg

SEQ ID NO: 226567 - DNA, 216 bp, Homo sapiens; identical to SEQ ID NO: 226488
  misc_feature: GYAE6OF02GR40S.44.56.F01.1.454.CMB.1.raw
  modified_base (214)..(216): a, c, t, g, unknown or other
  misc_feature (214)..(216): n is a, c, g, or t

SEQ ID NO: 226568 - DNA, 538 bp, Homo sapiens
  misc_feature: GYAE6OF02FT368.44.56.F01.1.454.CMB.1.raw
  modified_base (248)..(248): a, c, t, g, unknown or other
  misc_feature (248)..(248): n is a, c, g, or t
  modified_base (366)..(366): a, c, t, g, unknown or other
  misc_feature (366)..(366): n is a, c, g, or t
  modified_base (428)..(428): a, c, t, g, unknown or other
  misc_feature (428)..(428): n is a, c, g, or t
tcagacagtatatacacgaccggtgctcgatttagcagacgtctgaacacacaaagggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttggaaaatntaaccttgtctcttggtaccaagtatacccaggtaaaccccccaaactccttctttatgaagtcaataagcggcctcgggcatttctcatcgcttctcaggctccaagtctggcaacncggcctcgttgataatttctgcctcctgcctgacgacgaggccgactattatgctgctcatngcggtcctagatagttgggtcttcgggcggtagggcccggtctgaccgtccgtaggtccaggcccaaggcctcgccccctggtccacgtcctcgttccccgccctcctcc

SEQ ID NO: 226569 - DNA, 548 bp, Homo sapiens
  misc_feature: GYAE6OF02GX64Z.44.56.F01.1.454.CMB.1.raw
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
  modified_base (499)..(499): a, c, t, g, unknown or other
  misc_feature (499)..(499): n is a, c, g, or t
tcagacagtatatacacgaccggtgctcgatttagcagacgtctgaacacacaaagggggctctgggagaggagccccagccgtgagattcccaggagtttccacttggtgatcagcacctgagcacagaccaccaaccatggagtttgggctaatcttgattttccttgttagtttttttagaaggtgtccagtgcgaggggcgactggcggaggtcgggggggggcttgggcacagccaggggcggtctctgagactctcctgtgtagtctcaggattcagtcttagtgattatcacttggcctggggtcccgtcaggctccccggggaaggggtcttggagtgggatcacgtttcgtcagaatgaaacgttntggtggaagtaaagagtaacgccgngtctgngaagggagattcgaccgtctcgaagggatgactcaacngtgtgcatttacaatgacncaacctgacgacccgagacacgaggcgtctattacngcgcgaggcgatccgtgggacgtcgatcgctattgattgtgggtaccgg

SEQ ID NO: 226570 - DNA, 599 bp, Homo sapiens
  misc_feature: GYAE6OF02G4WYW.44.56.F01.1.454.CMB.1.raw
  modified_base (436)..(436): a, c, t, g, unknown or other
  misc_feature (436)..(436): n is a, c, g, or t
  modified_base (530)..(530): a, c, t, g, unknown or other
  misc_feature (530)..(530): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagtttttttagaaggtgtccagtgcgaggggcgactggcggaggtcgggggggggcttgggcacgagccagggcggtctctgagactctcctgtgtagtctcaggattcagtcttagtgattatcacttggcctgggtccgtcaggctccgaggggaagggcttggaggtggatctactttcgtcagtaatggtaaacgttatggtaggaagtaaagagtacgccgcgtcgtgtaggaagggagtagttcgaccgtctacgaaagggtntggacctcaaacgtggttgttcggacctaattttaaccaaattgaagtaccaaccgtggacgacccgacgacacgaggccttactacttaccgngccgaccgacggcgtacgtcccggtaggggaccgtcgatcggctagtttggaattcggttggggacccg

SEQ ID NO: 226571 - DNA, 620 bp, Homo sapiens
  misc_feature: GYAE6OF02IXDFN.44.56.F01.1.454.CMB.1.raw
  modified_base (394)..(394): a, c, t, g, unknown or other
  misc_feature (394)..(394): n is a, c, g, or t
  modified_base (531)..(531): a, c, t, g, unknown or other
  misc_feature (531)..(531): n is a, c, g, or t
tcagacagtatatacacgaccggtgctcgatttagcagacgtctgaacacacaaagggggggagaggagccccagccgtgagattcccaggagtttccacttggtgatcagcactgagcacagaccaccaaccatggagtttgggctaatcttgattttccttgtagtttttttagaaggtgtcagtgcgaggggcgactggcggaggtcgggggggggcttgggcacagccgagggcggtctctgagactctcctgtgtagtctcaggattcagtcttagtgtattatctacttggccgttgggtcccgtcgaggctccgagggggagggcttggagtggatctactttcgcagaatgaaacgttgtggtaggaaagtaaagacgtacgccgngttcgtgtagaaagggatacgttccgaccgttcgtacgaagggatcgaactccgaataggtgttcgacctaagtttaacaaagtgacgaccaaccgtgaaccgacccgacggaacacggagtccgtacttacgttcncgccgaccgaggccgacttcccggagggtacccgttagacgttacgcgttagtttggaacttagggtttcggggaccgtacggggtaac

SEQ ID NO: 226572 - DNA, 701 bp, Homo sapiens
  misc_feature: GYAE6OF02J0BAZ.44.56.F01.1.454.CMB.1.raw
tcagacagtatatacacgaccggtgctcgatttagcagacgtctgaacacacaaaggggctctgggagaggagccccagccgtgagattcccaggagtttccacttggtgatcagcactgagcacagaccaccaaccatggagtttgggctaatcttgattttccttgtagttttttagaaggtgtccagtgcgagggcgacgtggcggaggtcggggggggcttggacgacgaggccgaggggcggtctcgtgacgactctcctgtgtagtctcgaggtattccgagttcgttagtgatttactctacgttggcctaggggttccctcgtaggccttccgaggggtaacgggtcttggaggttggagtccgtacgttttcgacgtaagtaataggaaacgtttagtagggttaaggtaaaggttaaacgggacggtaccggccgtacgttcggtaggtaagggaaacgggtagtaccgtaccgtaccggtacgtaacgggaaaggtcgtacgtaccgtacgtaacgtggttacgtacgtacttaagttaaacgagtacgtactaccgtaacgcgaaccgaccgaacgacaaccggtcgtacttacgtacgtacgccgaccgacggtcggaacctcggttaccgggacggttaccgagtcgttacgtacgttacggtagtttacggttcgggtaaccgggg

SEQ ID NO: 226573 - DNA, 550 bp, Homo sapiens
  misc_feature: GYAE6OF02GEIX9.44.56.F01.1.454.CMB.1.raw
  modified_base (366)..(366): a, c, t, g, unknown or other
  misc_feature (366)..(366): n is a, c, g, or t
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
  modified_base (490)..(490): a, c, t, g, unknown or other
  misc_feature (490)..(490): n is a, c, g, or t
tcagacagtatatacacgaccggtgctcgatttagcagacgtctgaacacacaaagggggctgggagaggagccccagccgtgagattcccaggagtttccacttggtgatcagcactgagcacagaccaccaaccatggagtttgggctaatcttgattttccttgtagttttttagaggtgtccagtgcgaggggcgactgggcggaggtcgggggggggcttgggcacgaggccgaggggcggtctcgtggagactctcctgtgtagtctcaggattcagtcttagtgattatcacttggcctgggtccgtcaggctccgaggggagggcttgagtggatcactttcgcagaatgaaacgttntggtaggaagtaagagtacgccgngtctgtgaagggatattcacgtctacgaagggntagactccaatagtgtggacctattacaatgagcaactgacgaccgacgacacgagctctattacgngccgcgaggccgactcccgtagggacgtacgagtcggctagtttgattaggttgggaccg

SEQ ID NO: 226574 - DNA, 552 bp, Homo sapiens
  misc_feature: GYAE6OF02GD9AQ.44.56.F01.1.454.CMB.1.raw
  modified_base (270)..(270): a, c, t, g, unknown or other
  misc_feature (270)..(270): n is a, c, g, or t
  modified_base (308)..(308): a, c, t, g, unknown or other
  misc_feature (308)..(308): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
  modified_base (497)..(497): a, c, t, g, unknown or other
  misc_feature (497)..(497): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagttttttagaggtgtccagtgcgaggggcgactggcggaggtcgggggggggcttggcgacagccagggcggtctctgagactctcctgtgtagtctcaggnttcagtcttagtgattatcacttggcctgggtcccgtnaggctccgaggggaagggcttggagtggatcacgtttcgtcagaatgtaaacgttgtggtagaagtaaagagtacgccgngtctgtagaagganattcaccgtctagaagggntgactccaagtgtgtggcctaatttaacaagtgacgcctaacgtgacgaacccgagacacgaggcttctattacgngccgcgaggcgtctccggagggacgtgatcgcttattcggatttaggtcgggacg

SEQ ID NO: 226575 - DNA, 661 bp, Homo sapiens
  misc_feature: GYAE6OF02H3LTI.44.56.F01.1.454.CMB.1.raw
  modified_base (419)..(419): a, c, t, g, unknown or other
  misc_feature (419)..(419): n is a, c, g, or t
  modified_base (450)..(450): a, c, t, g, unknown or other
  misc_feature (450)..(450): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgattttccttgttagtttttttagaaggtgtccagtgcgagggcacgtggcggagggtcgggggggggcttggcacgagccaggggcggtctcgtgagactctcctgtgtagtctcaggtattcgagtcttagtgtattatctacgttggccttggggtcccgtcgaggtccttaccgaggggaacgggcttaggagttggatcgtactttcgtcgaagtaatagaaacgttagtagggtagaaggtaaagagtacgccgngtctggtagaagggaagtacttcgaccgttnacgaagggtatcggacctaccgaagaggttggtacggtacccttaaagtttaacgaaacttggaacacctaaacggtcgtaaaccggaacccccgtacgaacgaccgaacgggtcctaacttaacgtttacgccgaccgacccgtagggtaccacttcccgggagggtacccgtgacgtcgaccttagtttccgagtttagggttccgggg

SEQ ID NO: 226576 - DNA, 562 bp, Homo sapiens
  misc_feature: GYAE6OF02ITJA5.44.56.F01.1.454.CMB.1.raw
  modified_base (364)..(364): a, c, t, g, unknown or other
  misc_feature (364)..(364): n is a, c, g, or t
  modified_base (424)..(424): a, c, t, g, unknown or other
  misc_feature (424)..(424): n is a, c, g, or t
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagtttttttagaaggtgtccagtgcgaggggcgactggcggaggtcgggggggggcttggcacagccgagggcggtctctgagactctcctgtgtagtctcaggattcagtcttagtgattatcattggcctgggtccgtcaggctccgaggggaggggcttggagtggatctactttcgtcagaatggaaacgttntggtaggaagtaaagagtacgcgacgtctgtgaagggaagattcaccgtctacgaagggntgacctcaacagtcgttggacctatttacaaatgancaacgtgacgaccgacgacacgaggcctntacttaacngaccnccgaggtcgtagtccgtgggaccgttcgactggctagtttgagttcgtttggggaccgg
